United States Patent 7,365,185 (GENOMIC PLANT SEQUENCES AND USES THEREOF) - sequence listing, part 87

SEQ ID NO: 80274 - DNA, 74999 bp, Oryza sativa
  unsure (1)..(74999): unsure at all n locations
aatcccttatattatgggacggagggagtattatcatgcaagatcacgaattcataagtatccaatgcaatccagtccagacttgcctagtatttggtaaaaaccgtgcctattatttggtaaactagtgtgtgtatagctccttattcgatatggcaaattgttggattatattattctgttgacaaaaatggcggttagacaatagttgctgaacttttatcgggtcgtcaacctagaatattctgaattccatcagaagctacaatgatccattatgggcacacgtgagcgcgcgcgcgcgcacacacacacacagagattattatttgtgtgtataataaatctatgaataatgaggcgatacagtatgctaaccattatcaaggcaattaattcacatgaaatattatttcattttcaatgcatatcaaacaacaagaacatacataaaatatatgatcttagaataaaacccacctattttcagtccccatgtaaacagtgtaaaataaacgttttgcgagctctctgctatctttagggaactctccatccttgtactggccaatccgcatagcatctgccttaacttgctcatctccattctctatatctgcatattatggggactgaatagtcatcaatttcgaaacaggcacgtcagttataaattctgatgttacagaaacaatttcacaaaaaagaaaagcgtacaaccataactgatcaactggcaaaaatgatctaatggtaaatgggcaacagtacagaaaggataaagcttcttgttacatgaatggcccactcacactttggcactaaatttacagcatcacttatctcatccatccagtagttctctgccccattttactattctgttcttattatgctagtcaacatgatttgactacgttttgaaggcatttcatcaaaatcttttgctaaaaagaaagaggaagaaagacaatttggactgaccttttacgacaagctggcacatgcaaccaactattgctgcaacagatgaactatccgcaccaccagacagtggcagcaaaaatcctgatgctcgacttctccgcagataatcccataaccaacaactaggtccaaatgcaatctcctcttcaggacgatgatacataacctaccaaagatagatgcggcagaaagatgtcatacaaccttttcatctgcacagtggtcaccacctatcctctacactttgaggctgtaaatactataaaaagacaaatggagtattttgagtgcattaacaatgacacagcagggattcatgtgataatttgctcaggatagaaaaaaactgtatttaagtaacttcaagttcagtgatattataatagcaattgtatttgcaggcctactttcagagacaaccgcaagaagatcagaaaagaaaaagaggaactctcactacactaacaatctaaataactaatctgtggcagggtctaaatgggtctagtggtacatctcaattagtcaaattcatataatccattcattttagccttctgcaccaattaccaagaccagtgcactatgctgagttcttacatcctaaatattgcttattttgcagtctaaaactatagtccatgtacacaaaattaactccacagtaaatggcacctctcccagcaccaacctagaatacctaaagcggcatctagcagagaacaaagcccataaaactacgtctaaaaaagaatggagggagaaatttgacaggaagtctgttaaaatcagccatgaaataaaggaaatttaataaatagcaatatattagacaatacatatgttgcacgatagtttatgaaaatgaattagctgaacccacatggaactagttttcaaattgcataatatgctaaacaattatatgatgcttaatattgttattcccaataattgatgcttgaggacatcttaaatctcttatatttaagaaatcatgtcaagatagaatcaaaatagatatataaacaggaactgacctcaacaggaccagttggaaccattccactctgaaatggcttacaaagcttatatggtaccttaacaaaaggtactttggttcggtgacttgcttgctctctaaaactagaaacagatgctcgataacttgatacctgatggtacaaaataaatactcagtttatgcaagaatacaacccatgaacttacatcaaagactcaaagctgaatcagcattgtaagaaccagtaattttaaactcatagagaatagcagaacacagatttatgacttcagagaactgcaagtagtcatcaaaacggtggaaggacaagaagaatttgttaacattagatgaagcaaagaatgcagctatcactgaataaaactcacttataataattcaatactgccccgggttgatttttacaagacgtattttgaattcaaaacgcctttagattaaattttgatcattgatttctcactaaatgtattcttaatatctatgaaaccaatattttcacttcgaatacgatatttatacacttaaagtactagtaatttaacaaattattggtccaaatctacagattttgatatgcctaagaaaaatcaatggagggactaatagtattctttccacactgaggcaagaaaaggaaacaaaaaaccgagaaattgtttgtttgtttgtgtgagcatagctcattggaaagacgcatgttacgaagggagctattccttcacatgttcataagttataacagataaccctccattttgtatatttaaaaactcataatatacaggaaatagtaacggcaataatagtatctcaatgagctcgaacttactgcatcaagatctaccagagcatccaatacttcaacgtcttttaacgagaattgagatccctgtgcaacaacgtctccattgacagcgatgcagcagcaaccatctagcaggaaccattaaaataactttgaagaaatgaattaacctttagacctctcagatgaaggcaacgaaaacattaatgtaaaaaaatagcactattgttgactccttaaaggtttgaaggatagatggcattcagaaactttagaagacaaaatgttaaacagaagtattgtatcttgggtagacagttttaggataattcaatgtagaactttaaacattccagttccaatatatactattcgaagtacggtccatacagaaaatcaactacaatcaccaatttagtgctgtccctctggggttcaaatgctgaaagacaagtaaactagcatctactactagaaagtgcatcctcctcccacagttttcatgcactagccgcctccaacaaatgagcagaggaagaaggtgtttaggtcaacagaaaaaaaatccatgctatcttacaataggtgacaatggacactttctgacacatgaaaataataacaagagtagttatggatgcagggcagcccatgcggcagattgggttagaaataagccacttaagacgggagatcatctagttaggaaagaagtgagaattgttaatagggattgagatcctataggtgtcaagtcagtcctcctgatatatagaaggatccgatgtaccccaattatcaatcaagcaatgatgaatttctaaagagggtaagcatcatatcccctgatctttactcttattctaacccaatcgataacaaagagacctgcatgtccaactggaactagaaacaagaccacatgcactacgcagcatttagtctaaacaagaaaaaaaaaagcatatcatagatcagataacgctaaaacaatttttacagcacaaaaaaatggcattttgatataccataataaaggcgtccaccatcacaaccctgttgattagcatacatgtaaacaccaccacatgcaagggttgcatttctcatcgaatcaatcctaagactgagcttccttaactgatgatggcttccacttgcattcacaaaaacctcaacaccattcaacgctaggtcaatgcgaggggcatttgcagtgaagagctcttcacaggtttcagaagccaatgatctaaaaacatatcaattgaaataagaagctgtaacaggatcacatagtaaccaaataatttagcagttgagttgatcaagagacaaataggtttgtagacaatgtatgaatttactggttaacaccatattagcaaagagaacatttgagcatgctaataacagcatcacagtttaactgtgttctgataccatgttaacctaagtggaagccaactcgattgttactgcacaagacccgatggcagatatggtgggtacaagtgacatgatagtttaactgtgtgctgataccatgttaacctaagtggaagccaactcgattgttactgcacaagacccgattgcagatatggagggtacaagtgacatgaccctagactatcaccacgggaccacaaatatctctagtgcacacatgctaatacactagtacctttacctcggttaaaaagagaggtctaaaatgcaactcattaaaccctaatggttgcaacacccatgcgattatgtagcagatagtgcgggcactttgatcccaataaacaataattagtagactatctggtatgttaaccaggcaatcgtcaagctgaaatcacatctacatataaaagaataattcaagtagtagtacttacacatcaagaaattgaataaaaccataaccaaaaggcacagtatcctgggacgtaacctccgagatatcaagagggagttgaaagtcaacaagtgcatctttgaatgtccaagcagaaaaccatcgaaattcccgatagtttccatcatttgcaagagatatctttggcctaatcatgactatcttgctgtttaagcagaacacctggcagttgtaccgtacactcttgaaaataaccggcattcctatgctgcacaagatgccatccgtatagccgccagacaaaatgtccttcaagcactcccatctgcagattagtcaagtacagtggttaagagttactggaacagaatataacagtacatagagtgagcatccacacgagcatacgagagagatgctaagatctgagtaaagagttctacccgggtttagaattgagggatgaaaactaaaccaatctaaaaaacaataggtgctaactaatcaacaacaattagttaacttcaattgcaatttctggacgccgaagccaactcaaccaaactaaagtggaaatacacgtattaatttatatgacattaatagattctcattctccatagtttcactcctcgttacagaaccaaccaacagcatccgccactaataatccacaaattataacaggagaactcctaaacccttaagcataggcagctgtgactgatgatgacgaagattcagttcagagaaaggggggataaattagttacgcgtgggcggcggtgtcctgctcgaggaagtggtcctcgcagccgtagccggtgagctcgagctcggggccgacgcggacggcggcgccggcggccttggcgcgggcgatggactccttgacgttgcggaggttggtgtcgaagtccatcgcccactggttcaggttgcacgtggccacccgtagaagcctcatctcgctcctccctcctagtccctctcggatcggagagactgagacggctgggggggttcgggaacgaggagagcggaggaggtcgttcccgccgccggcgggcggcggcggcgcgtgcgagggaggcgaggcgaggcggcggtgaaggcaaaggcggtgtgcgaaaaagattttttattttgtttattttttgaggtgaagagacgatgaactcgaatgcgatgccgtggctgcggtgcggctcgtgcggctggcctgttcctggttcaggtggtgttcgcaactgaatgagacgaggattatggctacgtttgttctaagaaaattgaggggaagagttacatcgtttttttgtatgtttttcgttcataagaagattgctataaaagatgctttgaaaaatcatataattattttttaaagtttaaaataattaataatcgattaatcatatgttaataacttatctcgttttacatatattctcaatattctctttttttttctcttaaacataggcaagtaagattgtgaaaaggattaagaatgtgtaaaatgagaagatcattagtgaatgattaattaagttttaattattaaaaatgtgaatatatataagtaacttctatataataaatttcacatgaaatgtacttatagcagtttaaaaagcatgctaatgaaagccggatttcagccggacgagaaatcgcattataattagaaaagaatagatccagtgtttcttctggcataggagagtgaggctgtgttcggaactccaagttcccaaacccctctccgtcgttttctacgtgcacgcttttcaaattgctaaatggtgttttttttgtaaaaagtttctatacgaaagttgcttaaaaaattcaaattaatatatattttaaaaaaatagttaatacttaattaatcacgcgctaataaaccactcctttttccgtgcagggagatgggttcccaaccccaggagccgaacacagcctcgaatcaacggagaaaaaccactcgattgcttgatctaacggctgagaggaaacaggatactacctccgtagcgattgtatttgttctcacaaaacatagtataatgcaatagaatgaatgtggcgatatctcaatgcaagttcactcggtccaaccaacttttgtggtgatccccatgcaaaaatgaataattcgacagaacattttccgaatctagacaaaaagcatcgaactcgaaactaaatagcaaccacacttcagcacttcacagacacacgaaacaccaccacaatcaggtaagcttgattctagtacagtctagtacaaaagaaaggattaacttcagcagttcagccacaggattccaagtacaaaataacaaaaacttcagcatatgctgcagcgaacgagaacacacctcctgggtttccttttgccccgggatattgctgtattagtagctttgatacgtaattagaaatatttctgtacactagttgttgaatcctttttctttatagaggaatcgcaagtactaataacgcgacgtcggtgctaaaagtttaatagtttgtctaacttcacgagttctgggcgcctcaaaattgatgttctctgtcaatatcaccgagttgcctgttgcattgcttgagctggctccacaatgttctttgctagcatggaagtccgcatgttaagattcttcaagctttcgataaactgctcgtggctgcaatgaaaaaggatatgttggaaaaactccctcgtaaattgatgatagaaaaatagatcagtattcaagtgatgcttgcccagaagttagcatgaattgcgtgtatgggtgattggctgaagaaacttacatgttaacatgattggtcgtcatgataagagttccagacactgaatcaatcttggcatcgagctttgaatttctaactaagttcattatccacaactccccttcatcatagcgcatgttcagtttctgagagagcatgctgttcattgcaaaaaaattgaaataacttcttagatttgaaagaaattgcattcctacatggtccatataatataaagaataaaacgcatgaaccctgagaatttaataaactgttcctaactgagatgacagaacagaaagatgcaacagataactgccaccatgtagcgcattacagttcttttttctttttcctttttttttttgccgctaaacatgaagtgttgtccctacaatatggaaagcagctgactgacaaaattatgcaagacccaaccaggcacagaaccgatttgtgtattcgatatacagtatgatttagtgaattgataattaataactgcagttccctacttttcatctataggggacttttgcatgttaccagaaaaaaaaagtgagtagtaagacaaaaacccccacccaatatcaatggaccgatgaatacggcagtaagtttcaaagaataagcaaacaagcattttcaaggaattcatctctcaaaggaacagtgatggaattcccttcctcaatgcgctttcccaggaaaggatcattcaatatgacctacaaaggcagccattaggacaaagaaatgcaagactgcaatatgatcaccattgagaagacagtgctattagatatcgtatagaaatagcctagaatttggtagtgcaaaatcaccggtatgcccagagaagtggttctcatttaatttaaggagggaaaatagaaaagtaacaacaatgagctaatgacctaacgttcaactctggaaattttacaggccaggacaccgtcagacaccctcagacaggcctttctgatataaggatgtgaaagctgaactttgatcgcaaaaaaaaaagttaggcatcatatagcagtagtgtgtgaacatataacttttttttccaaacaaagaaaaagaggggaaattatctttcaatattttatatttcaacaataatgcattaagtaaaaaacagattaatcatggggatggacaaaaggttcaagacgcgctaatatacctcctcacactctatgagtttctgttgtgcgccatcaaaatcatagttaacaaacaagcattccagaaattcagtaatgggatccttgtagctgtgctgctcctgctgaatgactttaatcaactccttaagcatattccttctccttttgttcacaacaactgctgtagcaaggtatctcagaagatgtggtgcatttgtctggattgcattcaagtacctgaggagacgtaaaatgcaaattgaaaagttagctgagataaaatttgatatcacagacaaacatattttccatcatgggaactagatagcacattacaaataataaagcaaatgctttacggacgacaatagccccttggctctataatctcctctttgattctgctgttattttccttcacattcagcttgtccagaaaaacctacttcaaaatttttcactctttttatatcttaacgtagttctatgtataccagcaaaacacatcttaagagttaactcaatgtacgaaaaatatatagattttttaattggcagctttgcatggttctatcctagacattaaaccatggggcaaattattaataccttaccagcgaaaacaagtcatttagtgttagtttttagcggcattgcttattggttgttgaaccagggtaccattggctgtgtaactgcataagacaatagtgaacacaataatcatgaaattttagtaaacaaacctctcctggaagaacagatctatgatcccatttctgccgttttcatggttgtagaagataaagatactccagtgcatcagccatatcctattctgaagctgatttagcggtgaagagaagttctgggagatgaaacaaagaagtaacaaacgaagttatataaagcagctggccactcccaacaggaactattgataaagtctccaatcagttattcaagcaaacctttgaatcaataatctccttcaaacggttgagctcctccagtgcaacatcccagttctgcatcaaaatctcagctgccagctttccccacagggcactcaagctcctctcaatgtttgtgcacagagcacggtattgatgcaagtactgagcagcaaatgagtaattcccacagtcaaactgaaatttggcatactgatacagagtctcaatctgatcaggaccaatctgcaatgttaacaagaatacgattattaactgcatagcaacctaaatgacttggcatatggtaactacaaaaattaacaattgaaggggaatatcaagagttgtccctcacataaacggatgcaagacatcagaacatcccccagacttgatggcaatatacaattattctaaccatatacaccatattaagatcaaacaacatctgaagctaagaatcatcagatatccttctcccgcagttttaattcaataattggggatttatcgactatgtacacagtacacaattgctgggcacctgcatcccaatcccccacatcacacattcaactgtgcccccaacaagtgaacatacttaaccaatcccccaaccttcgcatcgccatctgcaaactacaacgctactcaaaacctacatacagctaacaccaactagacgatgaacagatctagtaagccgcaagccctgcagctagatcgaggggggcgtgggggtaagtttgggcctgacctgctggttctggtggatgttgtcgatggcctcgccgagcgaggtgagcctggagacgacctcggcgcggcgcttgaccatgtcctcggggacgtcgtcggtgccgtagcgcgacttgtggatgtccatggcgtagtcgaccatgttggtgccccggaggaggcggatcttcgcctcgaggatctcctcctccgggtagaggtgccgctcctgcaggaactccagcagcgggagcaccaggtggcagtccaggtgccccgccatccgcgccgtcaggtcgtgctccgccatggccgcttccccgcctcccctctccggtggattggtgcgcgtaggcgctagggtttttagggttcgcgggttggtggcgcggaaggcggaagagcggggaatacacgggactggggtgagtgggtttgtttcaataaaaattttgattggtaggagggtttatggttgattttttaatttttatccaaaataaaatcttttaaaacttatttttaaaatctaaatccttgtagtcaagcaatcccgtctaatatggcaaaacaacactagcacactacctgcaggctgcagcggatgtgaccgttttatcctaccgtgctagcgagagcgatgtggccaaataacgctgccacactagttggaggctggagcagcatgacggtattgttttaccacaccagtttggttggcgtggccaaaatgttcatatattgaaaatgaattttcatgagtttattttaaaatttaaaaaattaaaaggttcaaaaaattaaaagaaactctagggtaagacatgttttgtactagtaaaaaaataaatttcataaaacacctattttatggtcaaaattttagagaaccacggatggtcgcgatgctccgccttgctttcacaacaagtgtgtgagcttttatggctatccggttaattattggttaatccatgagtaatgccatgccatacacatccgttctcccctcctctccccctcctcgatttttttgtctaaagaaatgcaacaattccgcttttaaatactttcaaatactactgcatagcaaggttaatagtatcgccgattaccggctgcaatagtgtccaagtaatcttatagcctgcatataataacttagctataaaggatggcccaccgaattgagctggagaataaataatattttcaggagcacaccgatattctctctccaccttatcactttcaccatcgcaccatgcaccatccatttctttcttctatgttcttctcccttcatccatccccttccttgatttttctgtacgaacataagcataagcatgcaacatccaacagtcaaagcttgctcccaagctcgttgtaggcttgttgcccttgtatgcggctgttgcaccagcacacacagcactgcgccacgttcaaggcaggtctcgccaaaatggcctcgagctcgagctcctgtagtctgccgccaccgaggatctcgagcttcatgggcgaggaagcgtccgcaggtgaggccacaagttggagcaagctgagctcgaggccatgacggaattgagctggaggacgacgactccgcgacgatgttttagctccttctatcctcatcaatgctttcatccagaaagcgcgtgctgaagccaaatagtcgcctgctcacgttctctctcccttccaactcaacactataaccgacgtggctttcttatcaccggtccgcgatggtttattgcacctgctctaagtcgatacgtcggtttccagaaaaagaggataggaatataaatttagtacttggacccaccgcaggctgcccacgcccaaaccacttctactcgtagtgttctcacacaccactgacctgtgggtcccgcagagtcactcacaccacacgtggaccccatctatcagtgataggaactcacctttccccgcacatgcgggtccatggtagtagtctgtccccacatgtcagtgagcaaaacgtaaaggtaaaatggtaccgtcctaccgggtgcggaacgacaccacacgagcacgtcgcgtcggcaggtgggtcccatcccccgtgggccccacgtgtcatccacggtgaggcagatccgcgcgtggaaacgaagcgaggttgcgggcccacccacgggcgtcgtgggctcgtggcctctaccctttttattttatttatttatttcatcgcccaaaacacccaacttttctcacgcgcagcgattccacccccaccgccacccgcgaccacagactccacgattctctcagagagagagagagagagagagaggggactcagcgagcggtgggcgagagggggagatcgaaaccctagctagggtttgcgcgcggcggcggcggggatgtcgacgccggcgaggaagcggctgatgcgggacttcaagcggctgcagcaggacccccccgcggggatcagcggcgcgccgcacgacaacaacatcatgctctggaacgccgtcatcttcgggtgggtgtcagccatggacgcggaattcccatctgcctctacctctctccccccctccccctctcctgcgccggccccccggtgttctagggtttcggtgtccccggatctcgggggacccgaggttttcagctgtttttttttgtttttttgttgtagtggctgtggtgctaacgaggaattgttttccgtgtgatgatgttttgcaggccggatgatacgccgtgggacggaggtgaggcttgctcggtttggttttgctccgatctgtagctggtttagtgattaggttgtggtttactaattccttggggatggttcgatgtggaaattggaatcgttaggatggatatagcatcatgagtattttgcccagggagatgagaccgagtgagtgggcagctgattccacataaacttagaaggcagatgaggattgtctgttgttgtctatgtcggtcttgtcggatatgtggggagatcgagccatgcaattctggaagggtcattacagggttaggctattggctagatgtatgaattccttaacacgtaaaattgaaaacgacaaaaatacatggcatacttatgatgcctgtcacctaagcagctctaattgaggtgcgctgaaactgtcatttggtaattttggtttatgtgaattctacatgataattgctagagtaggcatggtttcattagactagtcaacaaatgaaccttgccatatctatcacatattcaataacagaaatgccgatttaggtcctgttcgaatccactgaaagaagtgtataaacttttgggtaaaagtggcacgcttttcaaattgctaaacggtgcgtttcgtgcgaaagctttctatatgaaagttgttctaaaatatcagattaatccattttttcaagtttgtaataattaaaactcaattaatcgcactttattaccacctcattttgcgtgaaacacttaatccttatcttcatcttcatcttcaggagattcaaacaccaccttaaacatactctagaaattagagtgactgctgcatttactgtctaaaatggagtaataaagttgggagttggtgtgagcttgcctgggaagtaggttgcatgtttggttcaggaaggtaggttctactatttgaaatatattgttttggaagtgcataacacatgaaggaataaataacctacaaataattatggatagagttaaccatgttgccatgtgacacttattgtgcatgttttgagcatgtggtgccccgaattatctgttcgacaaatcagggcactgtatattttttgctgttttgtcttaatcagttcgcaacgaacttaactatttgactgaatctgattatgatctgcacatatataaatttaagttaagttatggtgtcagatattttccaacaactaacattgccctttttatggaaaagaactttctgtttttttctcagagttcaggtcttcttcttttcccctcttctatttgagttgcgtaaacctcaagttacgtcttagatatatgattgatgatactacggttctgttgcacaaaccaatttgtaaggatggatgttaaatcctctatgcaaatcttggtgcctgtttattttatactgtttatgtaggttttagtgtaagttgagctgtttaaaagatttactttgttttgcttttgagtttcagtcttgttttgaaaataaaatgagtacacacttatcttttaaatgcatagcttaactgcatgcctacagtgcaagaacccttaaaattcttaggccatgatcctaccaaaagaaaagagaatgtcatgatgatgtggttatgttatgggcgtagaaaaaggatactagtgggaatgcttgggtttgcgtcaaattttacttcatttcttctctgtggttgtttattccagtgttgttgaggcggtaatgcagtttaaggcaacccaccactgcgaggcgtaaggcgttgcgacgccctatgagatggttgaggcatgattaatggaggatatggtagagaaattaggaagaaaaaaagggaaaccggtaaaaggcccactaatccaggcagccagcccaccaaagcccaacataagtcttcatacctacgtgttctatgccctaagaggcatcttactccaccaggcaccagctgccatgatgagaagaggagtccccagctgctggcctcatccacatgacctctactagggttctaggatgagcttacctcttcttctttccctttctttattggttttgcttgtaaggcctttttctttccctttcttcacagtggacaccttggcctctgtgaccgccttagcgctatacgccttaacaacctgggtttattctttaattcttctcatgtgaaatccttgtctgtaatgtagtaatgttgtatgacatattatcttccctacaactctatctgcattatgtgatactgctgcagctctgtacccctatagtcaggccatacagttaaatactcagagccaggagagcttgcactagcactattatttttatatgatgaaagatgtggtcttttgtgtattggttcctgattgttcttatctatcattgatctattgcttatatgacatttctttagcctttgttgtttaatttcattagttatagatagccttgaatcatctacagtacggcaaaagtgatgaatgcagatgtttgggaattcgggattatggttattagtaagacaatagttctgatacaggacaacagacaaccaaaagccacataatgattaatcatgcttcaactttttgtagctaccagtctgccagcatggtaacttgagaagtcgactaacagttaactcttacgtatctgtaggcacgttcaagcttaccttgcagtttacagaagattatcccaacaagccgccgactgttcggtttgtttctaggatgttccacccaaatagtaagctctcttcccgtgtgattatatattgttcaataattaccttacatttgtaaacaaataaagatcttcgtttttgaataatggaaaacttatttaacatcatactattcatgcagtttatgcagatggaagcatctgcttggatattctacagaaccagtggagccctatatatgatgttgctgccatattgacttcaattcaggtacctttttgatcaattttcagactagcaaaaagcatttgtaatgccatgaagagtagtgcttaccatgagtaatgagatctttctaggtgcattattttacagcttccaaggtcatgcaaattactttttgtggagaaactttaaacttagttgcactgttgtgcgtaaaaacctctttacaacattgtcatggaaacctactagaatgaacctcttacactttacagattggcagttggagcattatttatctggcacatttattcttacgtaagaatgaatcctcctaaaaattttgcacttgaatggaggttttcccctgtaactttataactagctctggttgatcagttcactgactgggggacagtgactaaaattgaactcattttattggaagctaattccaaagctccctcacaaatgtccactacactatttatagccagttagcacttagcagggtgccattgtccgaactttgtaagcatgttagtaagatcatttgatgatataatcggttaggttgtttgcttctacacaccaccatttccaatggttgtataggctacgtagcatgcatgtagcatggtattgtatcaaatacttgaatcgctgaattgtgatgcatttgctttgcagtctttgctgtgtgatccaaaccccaactctccagcaaactcagaagctgccagactgtttagtgagaacaagcgagagtacaaccgcaaggttcgtgagatcgtggagcagagctggacagctgactagggcatgcagcagggcaacgggtggtatccaccatgccagaaagatgcaataagcaaccgtgaaaaacctgtgcgtttctggctctccagatttgctgtcatcttaaaacattataagatctccagtgattgcttgtagtccgttgatgtttttgtgttcccatgtcccagttactcttggctgcttttatgtagtggtgttgacctctcatgcactagggcattctgctcatgtaaaaaggggattatcatcataatatgtgaatggaagcgaaatgggtcatgagatttgagtctgcttgcacaatgcagtttgtctgcatgatccttttgccatgtagtttggctgttggtgctgtcctatgcacatgcttaatattctctgccgtttggattttttgcaacattttgtatttttgtaggaacagaaaaaaaaattcccgtgatacttctcatgatacaaatggtaccaaactgaaatttatcgttcctcgagtgatgctttcgtatggtataaagaagggtttttaggcccctttgaattggaggattgtgaattttggaggatttaatgtcctaaggattttttcctatgaaacctttgattcataggaaagtataggaaattttctttaggattgcattcctatagcccaatttcataggaaaataagtaagaggtttaacctcttggaaactatcctttgctttgtttgttttctatggtgatattttctgtgttttccattcctgtagaattaggaaaacatgccacatcaattcctacgtcgggtttttaggcccctttgaattggaggatttaatgtcctaaggattttttcctatgaaacctttgattcataggaaagtataggaaattttctttaggattgcattcctatagcccaatttcataggaaaataagtaagaggtttaacctcttggaaactatcctttgctttgtttgtttcctatggtgatattttctgtgttttccattcctgtagaattaggaaaacatgccacatcaattcctacgtttttcctattcctttgtttgtttcctatggtgatattttctgtgttttccattcctgtagaattaggaaaacatgccacatcaattcctacgtttttactattcctgtgttttttctattctgcgtttcaaaggggccctaggtaaagtagtgctcttgattggtgtcgggggcctggggatatctccttttacttgtccatgtaaaggtctaaaacaacaaatgcgatacatggtattgacaccattgacacaatgataaccgaagtgcccctacagaggacatgccataaacgaggtactgaaccatgattacatttagacctagattcgtagtgagacatttatagtcctagattcaaagtgggaaaaattacaaaattacagttgtgcttagcttcttacatattcaaaagaaacatatagaaaaggcggtaaaaaaaaagaagataaaaaaaatgtgaagaaagtaaaagagcccactgacttctactggtctacaccaagaaggccctatacacatcttatcttatagggtagtagtacaccatatgccagttccagtctagcttcagctgcagctgccatctgaattgttctctcatgttcggttcttgaaagatcacactgcaaaatgtttgcttcatgtaatgtttcccgctgaattgccgttgctgttcttgcctcaacctagaaatccaagaaaacacaagaaaatatcatctcagatcatagctgaatgcataacatttccctcaactatcagccatggatgatcagagcatgatagttcagatgctcaaagtgcaaggtttggtttgtttggtgatagatacctgcaggctatgatggagtatcatctacagatctactggtcgtcttctaagtctctggggatctgcgacggcgacagcggcgactcctcgctgctccgggagtcccctctccagtcatcctgcacctgcgcggcgaactgcaggttccacagcacgtcctccaccgacggcctctgcaccgcctccttggccaggcacctcaggcagatctccatcaccgtcttcaccgactcgtcggagcaccccttgctcaccgccgggtccacaaagctcctcctcttcgccgtcccctccgccgtcagcgccgattgcagctgcagaaagaacacaggtgagtttctttttttctttttcagaactttcagaagtggacagtgtgatggtagtatctgaagtctcatgaaaaattcagttcagtttcagtctttggagggagtttgtgttgcacctgttctttcattatctccacctcgtagatggatgtgatgggcctgcctgagataacctcgagtagtatcacgccgaaatcgaagatgtcgagcttatcaccgttcggtacactgcgagaagaaatttgcaacagaaaagttcttaagaaaaccagttgcttttagtataatatacatagattctgctgtaaggtgatttgtcaagtacctatcagatggatacttgttgccagatcctccctgaattcatccacaaaagatgatataaaacaacaatgttagttcagagttcagacagtgccaactcaaaattcagcggtaagtttacatgatcagagtttcctgaatcatacctcggatttcatggtttcagataggatggggatattgtagctgcctattttggcaacaagattctggtctagaagaatgttggtgatcttcagattattcgcaaataggccaggtatgatccctccatgcaagaattgaattcctttggcaacaccaatggctgttgatatcctctgcacccaggtgagctttctcccttctgttccttctgaagtcaaaagtatcaacaagttcagtgacattcagctaaccgagtaactgattattggagaccgatttcaggagaagatggtaaacttacgtgaaattctgcctctcaggttgccattctgaacgtattcgaagacgagatacaattgcgtgatggtggaatcgtcgagattgtattcgaagcagtgtccaagtgcactgaccaagtgcctgtgcctgagcttggagatcatctcaatgtggtgattgaagctctgggaagtctggctcctcttcaccttcagagacctgattgtcaccggagttccattgcttagccttcctcggtacatctgacagtaaaaaagagcaaaccattttagacatggagcacaacaattttagttgcaaacttgctatgttacaacttgcacatgcctcaaaagaaaaggtgattcttgaatagattgaaaaatatgtatggaaagatggctttggtactctgacaagaaaaaagagagaaagcttgtaataactataaaaactgttctctttaatctttataccccaattgtaatctagcagtagtatttaactcattagaataatcagaaaagtgaatgggggcataaagcatactgtcaattaacaagaacatgaaaaattaggttcagtgaagatgaagtggccataactaatccagcaatgatattctgaacaaaatgtccctggattgtcagtgggagcaatggtacaaggagtacctgtccgtgagaatcttgccccatcatatttgatacttcgaaatcattagtagccgcttcgagctcgaccaaagaaaatgatctgtatgctggaattcccagagctcccaatttcactgtctgagatatgtaacctgtttggttgttccaggtaaatgcaacaagaagttagtatttcagataaagtttcagaaaaaaaatggtgctatcaagttagttactcttaacactaggcaaagttccagagaaatgatgccaaagttaacgaatctaaaaaagagcaaaagatgtacagaagtttcagtcaaagaatctgaaattcaacaaaagtttcagagattgtgccaagttggtgactctgaaattcagcaaaagtttcaatgaatgactgaaatttagcaaatgttccagctaatgactgaaattcagcaaacttttcagttaatgaatctgaaattcagcaaaagattcagttaatgaatctgaaaattcagcaaaagtttcagtgagtaactgaatttcagcaaagtttcagttaacgattcaaattcagccaaagattcagctaatgaatctcaaattcagtaaaagtttcagtaaataaatccgaaaaattcagcaaaagtttgagagagaaattgacagggagcaagatcatacgcgcatcggcgaagagcttggaaggataggcgctcgacgcgtgctccacgagcctccgtggcggcctcgcctgcgccctcctcatgctcgccttcctcacggcgaggaagaccgccacgccggcgagcaccgcggcggcaatggcggccgccacgacgccggcgacgaggccggacctggcgccgctgggcttcctccgcgcctggtcgggcacgatgccgacggcgatggcctggttcttgcagaacggggacgggtgctgcgtgtcgtcgccggtggcgaggcagttcgccgagaagagcaccgtcttggaggagtcggagtcggagtccgccgccttgccgacggcgccggcggcgaggcaggtcgggaggctccccgtgaggaggttggacgagacgtcgacgaatttgaggttgttgccgcacgacatgttgccggagagcatgccggtgaagcggttgccggcgacgctgaggtactcgatggacggcagcgagagcagcgccggcatgaacgggccgacgaacctgttcctggacacgtcgagccgctcgaggaggtagaacgacgcgagctccggcgggaggccgtcgctgaacctgttgccggcgagcaccacgctggccaaccttccggcgcgagccgcgggaactccggcccgagcgagttgttggcgaggtcgatcacctggaggttcttggcgccgctcatgtccggcaggttgcccgacaggttgttgctcgccagcgacagcgaccgcagcgacgccatgtcgctcaccgaccccggcaaggtgccctccagcgagttgttcctcaggctcagcacggcgagcaccggcagcctccccagccacgccggcagctcgccgcttagcatgttgtcgtcggcgatgaacgtctgcaggttgccgagccgcgacagcgcgagggggagctcgccgtagaggtagttgccgctgacattgacgatctcgagcgcggcgagccgcgacaccttcccgggcaatgggccccagagtccgagtccggtgagcgtgagcacccggaggtcggggagcctcgacagcgtggtgaagaaggagtcgatggagaacgtcttgggcagcggcggcggcgtcggcgagccgccgccaccgccgatgatgtgcagctgcgtgacgctgtcgccgtagcactcgacgaacgccgacgtggtcttgtagtcgccgccgtagcagaagtcggtgtagttgtgccagtggccgagcaccgccgggtagccgagcatctgctggatcttgagcagcgaccatgtctgcgacgcctgcagctgcgtgctccctggcaccatcgccatcaccaccgacaccaagaacaacaccaccagattcttccctcccatttcttcagcttctcacaagatttcttcagctcctgatcagttcttgatgagcaccaatgtgcaagaaccagcagcaatttctgaactggagcagaggagatgagcagagcagggaagatagcaagaacagcaaaatctgtcttaactttttgtgatcaagaacagtgacagaggtgatagattctggtgatgtgatgaagaagggggaattttctgaagatttgatgctgggaggaggagcaaggagagattgattagctgaaggacagcatgatggcatcaagcaactgaactcttcagaaaaggctgagctgagaggaactacagttattggagagatagctactggtgacctgaaaaaaatgatgtgtgccaaattgaccaatcttttactacagggatctatctgaccactaattcatttcatcccaaagcaagaaagcactggatgccaatgactgcagcagcagaaacatctccagatttgcttctttccttcaagaactggcaacatgagagaagaaaacaaaaattatagtagtatcaggttagagaccaaagcatcacttgtgtaccaagatttgtagcactatcactaaactacagtacttgcaagaaacctcaccttgttatcagtcactgagaaaacataactactgaagatgaacagtgcattggataggtcaaggagatgaaatgccagcgagtgaaatgaaatgtggccaaataatatatgttttttgggggtttgtgagggaatcatatgcttagtgtcgtctactactgccctactgtcgctgagcaagtgagcatcacggggtggcacaaatatgaggcaaagagacaagggtctctccaaaagattgagctggaaaatggaggttggcataaggacattcagatgggagcccagtgcactcttttccttccattgtcccctttataattattcagaacttgaattatgataggaaaataatggttaactttcttttacttgtaattatgccctttttgtgataacattctttgcctgtgctttttttttcttctcttttttcattcttaagatttgctaaagcaagactacaagagtgtaacaaacctgttgttttcaccttccaggaaggaaagaaaaaacacaacttttgttttctggtaggtcaatgtttgcagtgcaatcaatagacatacaatttgtgaggtggtggtagagcacaacaccttatcacattgtatgctctacagttgcttcatttattatattactttgatctggtgtttagaacatgttgtggtttcttttgctttattcccttacttaagcgacagagagaatactaagtatgcatactatttggtgtcaattaatctatacacaatgtttagaatacgcataaatcatctcaagattgatgagtttatttaccaaatgagtgtataatgtgctaaaactctcttctaattactatacattttatcaaatatttatcaagatctgtagtggttacatatccattttattttcattctacctatgatttgacttaatccattttttctctcctttgctgccttttcctttgctttacttaaagcaggcaagacaatggaagcatcgctttctcttaggtgtcaaacatgcaccaacctctcctttcatgggctaagaacattccataaaaaaatatgaacaaatatagctcttgtttatttcccaacttttttttcaaacttccaactttttcatcacatcaaaactttcctacacacataaacttctaacttttttcttcgaacttccaattttagcgtggaactaaacacaaccacagtataaaattagctactatctggcaatctgcattgcaaaatgtactgtgcccagtgaaaaattgggaatctgatatatattcatcaatgcatgagtgttcccacatttgacttggatgaatgtttgtcagggtgtgggccccactttactcactgtagccttggaaaaattattaaatgatatattccccaaccacctttgggcaacttggctaacagtaaaccattacaatggtactgagggcctgcttggtttctagagacttattccaagtccctgtcacatcggatgtttggacactaatttagagtattaaacatacactaattacaaaacctattccataaccttggactaattcgcgagacgaatcttttgagtctaattacgccatgattttgacaatgtgatgctacagtaaacttttgataattatggattaattaggcttaaaaaattcgtctcgcggattagctctcatttatgaaattagtttttttactagtctaggtttaatactccaaattagcgtccaaacatccgatatgacatgggctaaaaagttttagccccatctaaacacccccgaatgaaatgtcccattagaacacacactttatgtgagacaaactgatggtaacacatggctgtagatgctcttggggtgattagttaagatgtttgcttggccagatttcctagatttgtggtccacaatataatattgacattcatgtgagtgttaaatacaatgtagatttatgtgagccacattgtaggtcgatattttttgtctcttttaagtcaaagcaacgaaatatataaccctagaatgtaaaataaatgaggagtgatgaagtaacattttgacaatttcagatattacatcttgatatttctgttaaaaaaatgctcttctcatatttctctcagtgaaaaggattagttggcgttattcaggatatttcgagcacttagttccttccaaaatacagaaactagaatttcagtttgccaataaatattttccttttgtttcaaaaaggaaagaaaattttccactttaccttacaagccatatactgtatgtcacatgagataattactagtaattcttttttcatcggaaaaagggttgcttttggagagatacaaaacggcaggcagtaaaagtgaagaagcccttttaactgacactaaaagaatgtgaagagaaagcagtaactagctctaataaaagaaagcttaaagaagaattaatttggtcgataaatgcgagcgtatgggatcgagtggcgccacattaccacgttggtgcgtgcgtctctattagggttggtgggcagttccttcgtgccatcactcaattgattctttgctccccttcttgatctgttcccaaactatactgccataacaaaaattcctgcagtttgatttggaaatttaggacttcttttactaattttactaataagttggttgaaatttcaacaattttgtagaaaggaaagaatcctaagaaaagttggatgacaattaggctctttggattgttctgtactcacgtgcagcattgagccaaggaccatgtgcagatgtgtgaccttgagcttctcttgcatgggtggggttactcacttaggtcctgtttgatttagcttatgattattataatctgaattattaggagtaagctgaaacaaacaaatagattattatgctagattgttataatctataagccagattactataatccaataatctcctctagaggagctttttccagattattgagtggctaaagaccccactacccttagatgcctctaataatccagagaaaccaacaactcgtagcttattttatatcagcttattataatccagcttagagtaatctgatttaataatctagattacaataatcttaagctgaaacaaacagggccttatttggatcagttgtagcttgccacttctttgagctatatcaactctgtttcttgcgtgatgaattttacgatggtctctgctggcagtatactttacctagattttttgttttttcctatttagtggaccacatctatttatcacatctatttatactaccactcaattacatatataaaaaaagctatatcgatgttattaagaagaaaggtgagtgtgtatgtgaagatttggacgcaggccttcgggcgaacaacggcaacccctgcccaccacgctacggtgcaattctctaccaccttaatacttagaatacgtattagtagagaccaccataaaattacccttctttatatcctcttaacttggggttaccattatgttgagcacaattaatggcatgccctcatgatgcttatatcaaggatagacatgaagtgaattggccttaatgcccaagagctccaaatggagtccctcgtggtggtggtgccatacacccttcgtctccgaatgatgaatcttttatggtggtgccatctccttcacctccaaatgatgataattcctgcaacagaattgcagtacacttgtgcatctcaaaggtttcaatcatgcatttattcagcaactgtgaattgctgccgtcgctgaaggagacagtggagctgcactatgcaaatagctagtacattcatcatccataattctgctcaaaataaataaaaaatggaaaataaggtggggaaaaaaggttctgttactgctgctgttagcttttttttttctctcaagatgcatgtagctactgtatactgttccatatggttggtgccagccactcttaatttgattagagagcacagtaacagtgacatgtcaagaaagtcagtagcacaatagaaacttatattagttcacatgaaaaatataggtcattatgatgtgtcctgtgtttggaatggtacataattgcatatgctaaatttcatccgaaatcgccacagtgcaggatgcgccccactacaattaggctcaagtgttaggcaaaaaggtttcttaaaaaaagtgttatgcaaattaaattcaggtgaatgacagacaagtaaataggtactaaagttctgcaaagcatttgtagttaagaactcatgatcagaagttcagaactgaatttttggccaatcaattgcgtcagaaatgtacttcacgatcgtcactgcagctagccaaaaatctgaaagactggaaggctcccaactaatgtggattctatgcatttcgagtactttaattaacgggaaaacagcacccacttgaaggtgaaaattcctcattcttgtcaaaccattggtagccagcttagctcagagaaagcatcagcaggcatctcatcctgctgggcacaagaatctctgacgacagtgtgaagagttcatattagcaaatagcaatatttgttgctagttgctactacttgctatcaactatttggctctgattattccagtttccaaccaacacaattagtcataaaattgtactactagattattcagggtgggtagatttgtcagctgtcacttcacacggaggacaattagattagtgctaatcagaggaggacacatagccacatatacgtactatcatgtcatgtgaatgaaccatgaatgcataccagagattcagagaatcagacagacagacatgcgtgaggtgaggccaactgccagcgaccatgtaatgtcatccactgcaagcctgcaagctgcagcaatcacgaattaatcgaggtgttaatcttggtttatgtcggtgattagttcccttggttaatgtgctctgcagctgggcggtgaggagcctggctgggccagagagcgatgcggctcgagctctccctggcctggttgaatccatggaagccaagggtatttcaggcaggtgatatgtaaaaacgtggtaaaattattttagtttgaaagaaatgaccgaaatggcattcaagcgtacatatcctagttcagaattgcaaactatcgaaactcatttgggagagatatttcgacgaagccaacttctaacgattgcatatatccaaatttctcgctaggagtggctgtgttagatgcatggggttgggaacccatctcctccgcatgaaaaacggaacggttcattactacatgattaattaagtattaattatttttttaaaaaaatagatcaatatgatttttaaaataaactttcatatagaaacttttttttaaaaaaaacacaccgtttattagtttgaaaaagtgcacgcgaagtaggaggaagaggggttcagtttgaaaaacgtgcacgcgaagtgggcaacaattacaaactaccgaaactcattttgaggtgatatttcggcgaaaccaacttttagttaacgattgcatatattcaaatttctccctaaggagaacataatagtcatggcacttggcagctggtctgttgagaagggcggcggcgagtgggtgaagtcggtatgtagtagccaagtaaggactggtttgcatacattcgatggttagcacttatcaggggtgtaaatgtatacatttgataaccgccaggggtttaaatgtatatacatttcgaccagcaccaatggcataggtcgaaataggggttgatacatataaatttaattatttaccctaaatttaaaccgtgatcaatgatggaggcaagtaggagttgatttgcatgaattcggtcagctgacagtaatgagattctgagatgggtcctatttgcacaatttcaatttagctgtatggcttagcttccccaaccaaaatttggtagggtagagatgagaaagatgtgttctagtttaatatcaaattatgatttgtgagttgaatagatagatacgagtactaaaacatgcttattgtagtatcctaatgaagtgtcaccaaatttctactatagtgttacgaattttgttagtagcatagcaaaccaaactaacactcagtacatatatagacaagtattatactgtcaccaaattttagtagcatagcaaaccaaactagtacccaggcaagtatttggtaaccaactaaccaggcaagcagccaaacacatagacattgacgtgacagttatcaacttctaatcccagtttgcattgtatagactactcgtcaagcttaatgacaaggtaaacaagctctctgaatatgaacatttaattatcttagcctttccagtcaagcaaatacatgaacaaactaggcaccaagcttattttctggaacctgctgtgcctgtccagaacaaaaaatatttttggagatacttaagatgtaggcagaacaattctaagaagcatgaatcaagcaagcaaagcaattgacgagctcaagttaattatgctggatatcaaaaaacacaagacgagtagtcgagtacaacagctatcaggacacacgatgaaacaggctatccaagtccctaactcttaacatctacgtacagtcccctcgcatagaaacaagagtgctccactgataataaaaggattaatatctcttctctgagctgataccgcaagaaaactacttgtaaccccaatatgagatagaacagtgaagcaaaggtggcaccggtgaatcttccatagttggtatagcaagaacaacctgtgaaggagagaacgaagagtcagtataaatcacagtgaaatatgtgcaaaatcaggtgcaatgaaaggctacaaatgtatatttcctgaaaagggttgtgatgcaaagtcatgaaaataataacattgccataacatggactcaaaactcaatgatctctgagactctgtgtggtagctctgctgttcagttaaaagtaacatacaacttcgaattgaatttgactaccagtaataacggtataaactacttatagtttcattcttcaatggttacaagcattgcatttctataatttgtatgatcatataactcaaagattgtcctctgaactattcttctagaatggttgataacaatagtagtcgtggaatgcaaggtttacagattaagcacatcgcacaaccacacagtacgccaatcaactaaaacaaaattttcaaaagcttgtacctacaacacttgtaagaatcaacagggagtacaacaaattagtgattatttcttaatatcatatttgctccaaacaagcactacaaataacatttagcagcagtgcagcacaaggtcaatgacataggggtgtatattgcaaaacaattcaacatatggcccagacataagcatgtctaataatacaaaatgatatgtttcattgaatttaaaacttctgtcaccgctaactggccactaaaagagaaaagtgcaagtaaataatatgagtgcaaggtataaggcacacaataaccacaaaccgtgacaggctttacaatgcaacaaactagggaaaaacatactccatccaaactaggaaaaaacatactccatccgtcccaaaatataaggggttttggacggatgggtcatcgtagtactaggaaatgtctcatacatccaaaatcccttatattttgggacggagggagtagaaagaaaatataatctactcatatgaagttaacaaaatctcaagagcaagtgattagcagaacatgtgaattatactatgtaacaaaaacattagaaacaggaagattcagaagacatcatcaacctataattgcaatttgcaacctacatcacataatatggttcatccatctcaaatgcataaatcattagcacaacataaccatctaacagatttaaatgcatgaatcattcaagtttaccagcaaagctattgcggagggttttgtccaggttgctgcggaccgggaggcggcggtggcatcccaggcctgaagggcggaggcggcatccctggcctcatccccggcggcggtcctccaggcatcccaggcctcacctgcggcgggcccatcggcggtggtcccctcatgaacgggccaggaggcggcggagggccaccagggaacgccggtggcacgcccggcgggcgctggaacgggatcggcatctgcggcggccgcatgggcggcggcatctgccccggcggcgggcgcacgacctgcgggtacgcgaccggcggcgccgagaggttcggcatcggcgggcgcgagatctgcggctgcatcatgccgggggccggcccgcccacgccacgcaccgggccggcgagccctggctgggcctggagcatctgccccgcggggacgccgcggccggcggcgcggcccaccccgggccccgccatcgccgcgccggcgccggcggccttggcgcgggactcgtcgggcggtggcgggccctcgacggtcatggagacgacctcctcgccgcggagcagcaggaggcccagcgtcctccgctcctcgcgctcgccggtggtcttggaggacttggagggcgggagcttgcggaactcctcgcagtcgccgaggacgaggttcatgtggcggtcgaacgccatgaacttgccgaccagctggcgcccgtcctggatcgtcacgcgcatccggtagttgacgaactggagcatcttggagcccttcgggttcgacatggcggccggcggcggctagggttagggtttcggcggcgaggcggaagaggtgggggaggaggaggaggttttcgaaggggtttgagttggcgtcggtgtctcgggttgggttgggtgtggaggaagaggtgggagtcgtgggctttgtgggcgttagtcggttggttatgggccaaaaagctcatgggctttagatgacctaactgggcgttgggaagggctttttggacgatgggtttcccctttggaataagtccactttgactccctaaactggtaaccgaatcagattcgtatccctgaacgacaattccagatgtctggacccctaactattaaaaccggtgcaatttgactccttttatggttttagagggcggtatcgctgacgtggcgcctacgtgacggtattcacccgtttttgctccacgtggtgttaaggtggcattcgaattaaaaaatatgtggaacctatttgtcattaaaaaatatatcatgtaacccactgacatacggggccttctctcgttctctcccctccaccgtgtcccttctccttcatcgtcgcttccttctccctccctctctctttctcccgcggagggcggagcggcggcaggcaagcagagacggcggcgagcggcgaagacgcgggcatggcgcgggggcccgcgagcggcggagacgtgggagtggcgctgccattcacaaatccaccgcgcccaaatcagaaggagaggtaggtgacgggaagagatggaaggtggaggcgacgacggccatggacttccacgcactctctcccaccgcgagctgcangcgatgtgcaagcgcaacgactgccatgccaacatgaccaacgccaccatgaccgatgccctccagttgctcccctcggtaagaatcccctgattgattgattgattgcgttgtttgatctgcccatttcgagagtttggatgattttgtgtggggttctcgtgtatatgttcgtcgtgtgatttggtatggtggtggtgattgatgagttgtgttggttgcggattaggtggatgggatccacaagatcgacacgacggcgctgtgcctcccgacgccgagcaggttgacgatgaagtcggctttaaggccgcctcggcggtcggcgaggaagagcagcagcagcacgggagcccactcccccgtggccgccgcgtgtcggtgaagtcgctggaggccatccagatggacttcgaggagggtgaggacgagatgaagcgggatcgtgaggaacggaacctgggcgtggcgctgcgtagtaccagccgccgcgcgagggccacgccaacgccaatcccaaccccctgcgaccactaggcagaccgccgctgcgcgcaaggtggagaaggcggcgccgaccccagctactctgcggaggagccagaggacggctgctcggaaggccgcttctccagacttcggtgcgtgccgccgctcgccaccgtctccgcttgcctgccgctgcttcggccctcaccgcccgccgcgggagagagagagcgtggtgggagaaagaagcggcgataagggagaagggacaggagggaggggagagaaagaagagagataagagcatttgtagtgtgtcgttgaaatagatggagagaaaaaaaaaaaaacgaaccaaccacatagtgggactgtgggagtcgactggtacgtgtcagagccgtgtcagaaaaaaatcgaattgagtttggaggtcgaacagaaggcatttaaataatatttgttggcatgttaccgttctaaaattaatcggctagcaatgtgatatgatagaataagcattgatacgaaggtcaaagcatgcatcggctggaggtccgatgccattaaatccacaagattgattaaacagtgtaacctttgttgtcatcggctaaatccaacttatatgtatatacaatccttataaaccgatgcaacgtccagataacttatcggctatcactccgataaaacattagcatgaacctatcggcttaacaagatttatattatcaacaacaatctagtaggtcaaacctaaccgatgcagcacgagattgtatatgataatctaatactcgatgagccgatagatctatctaatgtgatggatataacaaatctatttagaataacattgtgattgtagagatatattggctaagacagaagatcagacctaaccgagacagttccaactaaaccgatgcgtctctaaacacaatacaattagagatagaatcgagatatcaggtaggcaaatgtatcaaccaaaacagagtaatccaagagatcgaagcgatacagccttgaacagcaccaacgtagcagacagattcaccaggacaggcggaacgtaggacttaccccttcgccggagatcgaactgaaccgatgcagccccgcgtcaggtgccaaattccgtcggatgataagtaaaaacatcggtaaagagggtggcgatgcgccgagagtagttgtattgatctagagatgatagattacaatgaccccaggtgtacatatttatacccataggaagatactagtccttgtaggagaagaaagaaactttcctaaaaataaaagaaaaacataaagtccttattggacactaaacacactttcctagagataaaagaaaactaaaccatgcctaattaatagataacttgccatgccgcatcctccttggactcggactcttctagataagcttcctttaattgatccgactccatcaagaacacaacttctggcgacttgacgactcccatcgggtgattccagtactctaaagtcgatactgactcttagccgatgatgacttcggacttaccaaattttggcgttaacaatgttctatccatgacgtgcatggagacccacccaggttcatgaaaaaggcccccaaatatccatcatctaactctctgccaccgtacacgagaaaaataacatatgtaatttggatttcctatcgcaacacacgagcatctttgctattcttaaaagaaagagaaatgagagagatgaaaggaaatggttcacttgaggtcccttgtcgtcgagtttcaaaattgtccctgaactgaaataccagatataacagagccgtaatcttataaaaccaggtcacattaggtcccaaggcactattgctccccggttttggtgacgtggtggctgagtcagcatggggcccatgtgggtcccacatgtcaaccgataatcttctcgacctacacggcaaagagcgcgaagaagcgaagtaggaagggctcctgacacgtcgtcctctcaggttacactaccacatcgttgcgtggcagctcaccacgcccgcatcatggtcgcatgtcagccacacgtcgagattggtagaggatctccaagagttgggagatggagtacgttgcgacgcctgagcatagttgcgagcaccactgactccatgagtgtccgtgcatgcacacgaagaggatgccagacgctgaatcgcgggagaggtgtgtggtggccggtgaccagcagggataagggtggcggttgttgggtggcggcggtaggtagaagctcaacgacggcgcctagagatgggtggggagaaggctggtagccaacaagaagcttggcagtggcgagcggcggggagaatggcgcatgcattggggacgatgcgaccacaatatggtgtagatggagttgacctcgaagatgatgcgacggaaccacgcgtgcgcctctgcagacaagaggtagagctcggggacacctgaacacatcggcttttgagcagcttgacccggggcggggggggggggactatgagcttgggggataggagcttagtcagcgtgacaaggcagaagccccagccctcgcgcgtgcaagtgaagacgacattgcaattgtagttgggacccgcgccgcactccccgcgcgcgcaagtctatgatgtgagcgctcccgaccgttgggagccacgtcagccgatggcctccgccgtcgagcttttccccaccgaccaactatgttacccagatacggggatacggatacggatacgcgatacgtcgatacggggatacaccattttccagaaaatatagatacggggatacgcccatatatatttatatataagaaaattattaattcttgaaagaaaatagccgattacaacgtagcaatcttttgtaatgatctcttgtagttgattcaggtggagactagttgagaaatagcaccagcagtaaacagatatccatcgattaaaaaaactcagtgtatttcagcatactctgacttttctacttcttctctaacacttaaacatatcaccacatcccacaacggcttcttctcactatcatttggatgaatgatgaatttgctgctagattagcaaccgcgctagctctagatgcattgacacttctagtcacaataatcatcagatctataaaatatatatatactcaagcatcgaagaggccaacaagaaaacaggaaaggggaacaagaatagataaaatcacatgcagactcaagcatcgaagaggccaacaagtcaatcgttcaatggaacttgcctaactggggaacgaaggaatcaagtcagtggctgcgacggcggcgatgttgtgccatgttggcgttgcgtccggtggtggaggcgatgaatacacccagacacagatatgcattcagcgcctgaaggcccggcatgcagctacggcgccagcggcgttgcgctcggcgtttggtggcggtgctgagttcggccttcggcatggtgggcggcggcgccgatgatgggaaagtgccgcgaggtggtcggcctcgggcgagaaaagtggaggcaacgcgttcatccttactagggatgaagccatacggacgtatcgagaacatatctgatttattttaattattcgaaaattgtgaaaatcgctgatatgtacgggatcgctgatacgtatcggatagtatccgtatcccttcacgtatccgatatggatacgacgctttctggacgtatccaggtaatgtagccgaccaacacctttctccccaatcattagcggatgccctgaaggtttggattgagatgagagtagagtggagtgaggtggaagaagattgccggttgacttgtgaggtctacgttggactcagccgccacgtcaacaaaactggaaagcaatcctaacttgagataaaagtgatccggttttaaaatattagagggttcaacgacaagaaaagggaccgtagatgaactttttggggagatgaaaacattccagcctagtgcatatgagtatacggcagcagagcgctgcacgacctccgttccgcctccccaatccgtcccccgtctcctcgcccgccgccctcgactcccgtcttctcgcctcccgctggcatcctgctagcagaggtggcgccggcgttctcctgctcccgccgcattcgctcaccggtgagcatcctaatccatcccatccggcctcggcctcgagtttcgtctcctcgccgccgcttgcgccgatccccatcctgcgaggagaggtggcgcccggcgtcctcctgcttccaccgcatcgtcgctcgccggtgagcatccctccctacccacacctcatcagctattctgcgttatccctcaaaaaagtttcggggttcaaccgaaacagggttagatctgcctctgcccagttccacctactttcaacttgttaattttgatttttgtttttagcagatgtaatttggttactgaatctcatccaaacactcttagaatagttgcattagaacggaaaatgtaagctcacataatttgtactcatccaaactcatataaatttcttaagaagaatctataccacaaactactcatagtcacacaaaatagctttttattaaggtatattcttataagaagtttttattccacaaaattttctaaaagacatactgtaacacttgcaattaatctaattaaacattttttttctttattaggttataaattttctaaaagacattgtgccacttggcatgaatctaatttagcattctttctttatcaagttataaattgaaaccatcaaacttactttgtcttcccgtctctaaaacattgtgatatatctataatattttaatatttttgatattaaaataaatttagactaatcatatatatatatttaaattaggtaattaataaattcaaatcaactatacttttatataccaagtacaaatctaataacaatagaatgttagaaacaatgtgaattcaattttttttataaagtttaagtacgattcatatataaaattaaagaaaaatataaatttatatataagtgataacataataaaatgcaagttaaaattattaaaggaaaaatattattaataatcaatgttattgatgtatttctaaatattttcacgttatttttattaaatatcaatgagtaaaacggatgatttgccttatgacaaaataattattaaaattgtttttatccgttgcaatgtacggatatttcgctagtttatagcaaaacaaaaacacaccatatgcacaaacgcctttggccttttgagaattcgcaattccagccgatttgtaattttcaaaccaattgaataatactcctaaattgtttcagactagtacacgacatccgtataaaataatgccctacttgtcgttctttacttgtcattctcctttttcaaacccatggcctacatgtcatcctctacaaggcattctctacttgtcattctcctttttcaaacccatggcctacatgtcatcctctacaaggccaaagaaaagtgagcaactcatccttccttccccttcttctcatcttcagcgaggagcggagcaaatcctccgccgcctcgcgagctcccccaccgcctgacctatctccggtcgctggaatccgagatcggcctccttctcgaatccgcccccgcctgtacagtcgccgacggccgccccagctgatggttcgccaccgccccagctgatggttcgccttcactggaatccgagctgcttgaaggtgcacctttggccttttgagaattcgcaattccagccgatttgtaattttcaaaccaattgaataatactcctaaattgtttcagactagtacacgacatccgtataaaataatgccctacttgtcattctctacttgccattctcctttttcaaacccatggcctacatgtcatcctctacaaggccaaagaaaagtgagcaactcatccttccttccccttcttctcatcttcggcgaggagcggagcaaatcctccgccgcctcgtgagctcccccaccgcctgacctatctccggtcgctggaatccgagattggcctccttctcgaatccgcccccgcctgtgcagtcaccgacggccaccccagctgatggttcgccttcactggaatccgagctgcttgaaggtgctcccgttggtataccttcttgcttggttactgttttgagggtggctcttcattggtggttgctgtagaatgttcgtgctgcttagaaattggatatgaatttactgaattaccgatccgggtagttcggcttgatggcatattaggtttggtgttatgtttatgtagatccagctactgaaaatctagttgagtgactgcgtggtgggtgtagatcataccatctcccccaatccccttttaaagaagtgacagtattcgattccaaataagcaaagcaagtagttgtcttttcctgtcagttctaatcgattcatcgaggagaaaataatctttgattttgtgacgattccagcttcagaggattatagtgtctgcttcattcggaggttcatcgtcgccaaaaataaataaaatttggccgtgtcaactctacaattaggaaggtttcggatttctcaacgtggaatgataagaaatggcatacagagcaatgctgcaaagtgctgcggagtctgctatacagtccattggtcttggttacgacattgctcatgatatacgtctcaagtattgcaagcagcgcagttcgcctgacccgttgctcattgagcttgaccatgacgaggttcaggatattgtgctccctggtggactgacagttgcaggcgtgtccaagtcgattaagtgtgacaaaggggagcggacgcggttccggtccgatgtcctgtcatttcagcaggtacgtatcatatgcccaattcatatcttgtgtatactgcatattgccatgtttaagactgagaaatatatcgtaagatgctgtgtaaatgtatgctactatgatgtaacaataatcatgatgaatcccttgctatcttgatctaagaggttaatatgatagcattcatagttccaacttccatgatacctccaaagtaatataaccttttgcaattctataaattaatagaaaataggattattatttattgtaattaggagaatttctccagcaagaaaatagagtaggaacacaagttaattcagtatctcagaattacttgatatggatggtttcaacaatttgaattattagcaacatagactttaatctaccttgtattctaagtagatttggcataatttgaggcctgcagaagtgcagagatgcgagctccctacaaaatgataattccacacttgcagtgtccgtactagaggtttatagagacacacttccgttgtgacatctcaagttttgacagttaccagagcagagttatttttgctcaattgcatggctagacgtttagtcaaaactgtaggattctatccggtttgctggttgcgtgcattttttggcatgtggcactattcaacgccacctatctcaggccacagttatctgactcaggtgttgtggcacatgaatcaattagactctgcaatccaatgttttttctgttccaattcagtatgattctgtagtgatatctcatataactgcaatatatgtcacgcaagcaattcctatataccttgttcataactgttctatgtttgccaactgatgagctgtgaactgatgtaccattgctggctgaacattatgtctcaatgatacaagtctttgtccatgtcatgcttcttttcctcttcagctgtcatggaagccgctttaagtcgcagagtataattacatctataaaaggtaatatttgtgttcctgaagttgtgaagcattttgcagatgtcggagcaattcaaccaggaattatctttgtctgggaaaattccatctggtttattcaatactatgtttgaatttactggctgctggcagaaagatgctgctaataccaagtcacttgcctttgatggttggtgtatcacactgtacactgttgcactctcaaaggcacagattgtactccgggatcatgttaagcaggctgttccatcaacatgggaacctgctgcattagcaaggttagattcaatttgagtccacgctccatgtggtgatttaaattctgaatgaaaagttgaaaacttagtatttatatccttcagaaaaatcacattaggtttagtttttatgttctgaaattttcagaactgttctgagtgctcatttttcgttggtaggctggaagtgctcatgcctaataagttgctttgtaatgccatttttaggccttactaatttattgtgatcactgataaataacatcagtttgctttctacagttagtatttgacctattctaccaatgaatgaagactatgcacatcaaaacaagtgctgaactaaaattttgtttgatcttgtttgagaacaacgtactttactcttacaggtttattagaaagtttggtactcatgtagttgttggtataaaaatgggaggcaaggatataatttatttaaaacaacagcattcatcaactttgcaagctgttgatgttcaaaaacgattgaaggagatgtcagaccgaagatttcttgatgcaaacgggcaatctgacttcagtttcaaggattcctatggaaaggataaggtgattcctcagcgtctaaattttttctgccttcttttctcatggcatgatttttattcggcatcagtgatcagcattaactgctgtatttttttataagcatccttgtagccctctcaatagttaagagcatgttgtgtaaagatcctttttgttgaacacatctcattgtctcaccatatgtataattttcttctatagtggaaatgtggcttttcaccagttgaaattagtgttaccatttatttgatactattatcagaaacttatatcgttgattggcgccacattattttgagtttacaacttttaaagatttgaagtaagaaattggcatatgcatgtgctatgttctatgaggctgcatagccaaggagtatcttgggtttagcgatacagttataccatttcacaattattctcaatctcgatctctgtaagtctgtatatgtaggttaattggaatttaataatagatttactgttctctggcagactggcagtaccatttttgtacgaaatatgttggttttgcatcaattcctattccctttttttttctcttctaaaatttacaatcttagtttttctgtgctgttcagattgacacaagagagcatcggctgagatttgtggactccagtccattgaattcttactcttcaaaggaggtatagttcttttgtgttgatgcatttatctttgttcacattcatatcggtaagttgtggttgtgccactcaggatttggtgatgatgcctaagcggagaggtggaagggataaagatatcctttctcacagcgagtggctgaatactgttcaggcagaacctgatgttatctcaatgtccttcatacctattacttcactgttgaatggagttcctggctgtggatttttaaaccatgcaattaatctgtaccttcgatgtaagtcgagttttccactctacctctttgttagttaacatgaaactgcatctgcaattatgactaataataagagagcctggatcttcatcctcagtggtttacttttgctttgcacttctgttattggcataattgcagcttgcttattcatggtttataattgacggtagtgtctagagttaagaaaagacgattatggcacgctaatgtcaagtactgtctgtttttcaatatggcaggatttaatgttatctgtaggctgtttgaaatttgaacctggaccctatccacctcaaatggtcaaacatgtagaaagagggttgactggcttctctttcatatactaaaaatagtagtcgatgttgtttactaattctaataaaagaaggtgctgctggagaatagattatgtaatatttctatatttcatagctttgttcaccgactgtgcttcctatattttcttctgtggcgtgtgaaataatacccaatttagtatggtgtcacatcatcagctagtcagcttgcatttgcatggctctcttccccctgtggtagttctcatctttagtatggctgcaaagcaggtgttctctagtaatgagcttcagaggaaaaaaaatgtacttccaattgagttggatctttttaggttatgggtcactgtcgtatcatggcatacagacaatcattctagctaggaaaaagatggcattaggcctgaaacaacacaagcaactgtgtgacatgtgtaagttctgtgcagataagcctcaaattgaagagctgcaccaatttttggagttccagcttccaaggcagtgggctcctgtttacagtgacctccctcttggtcctcagaggaaaagacaaagcactgtatctttaccagttaatttaattggtccaaagctttatgtttgtaccaacatggtatgtatcttttttttgttatcataattgaaacctcccttgtttatatatttcttttgttttatccttgcatacttatatcataattattgtagtcttgtactcactataacactaagtcaggataggctagctctagaagcatttgataatgatgagttaatgatgatggtggtgatagtgttatttgacttttgcatatttagagtctgcattgataaccttgacatttttatctgtaaaaactgcaaaattgagttttcatgcaagtttgccaattgcactatatgaaaaatctactctaacaagcctgaaaaatgctgtaaccttttttactggatgtaatcttatcatttaagcagtattcgatgatggttttttccttttttttcttctatcactcgatttattttaaaacaaattggcacaggttgatgtgggcaaaagacctgttacaggaatccggctgtttcttgaaggaaaaaggagcaacaaactagctatccatctccagcatctctgctctcttcctcagattcttcagcttgaagatgatccttacaatgaccaaactccagaagcatatgaccgcaagtactacgaaccaattggctcatggaagcgtttctcccatgtctgcactgcaccagttgaatcagatgactcctccattgtcacgggggcacaattagaagtggttagccatggcttcaagaaaatactgttccttcgcctccatttctccaaggtctgcaacgccacttccgtcaggaaccctgagtgggaaggatctccaaacctggctcagaaatcgggcctcatctcaacactcatcagcacacatttctccacagcagctcaaaagcccgcgcctcgccctgctgatgtgaacatcaactcggcagtgtaccctggtggaccccctgttccagtgcagaccccaaaacttctcaagtttgtggatccaacagagatgatgcgtggaccgcaggatctgccaggttattgggtggtctcaggtgcgaagctgcagctcgagaggggcaagatctcgctgcgggtgaagtactcgctcttgacagcaatgttgcctgacgacgatgagtttgcgttcgatgaagagttttagaaccatgaaaccgagcgaagaaaagaaacccacctcattttgtttttatcatttatgtgcagctaacagcaggaactcgaatgctcaatctaggattttcgtagcatttgtaagtgaactagctggaagtctatgttgtatacagttgcgggtttgaaacatggaagcagaaatgaacggtctctggcttggatgacgcgagagtttgttgtacttgtaacaatgtaccatcccttcgcagcatctgttccagatgactaaggatagatgatcactagaggctggggcgagccaagccgcgccgcctgcatacaactcggttgattaggttaaattatttgctttcagactaaatcagtgattgtctaagacaaccaagaaaggactattctttcttgagcaaagttgtaggcacatgaatcgaacagcatacacaggttacccattgatgagtaatttaatagaaatggtgctaaagattctgatgagaacaaagctctcacccaccattacaaatttacaatcctaaagattatgcacactgatgcatataaaaaataaaatcagagttttacacgataaatgcactgatgtatatgtaaaataaaatcagagttttacacaataatgagataaactgatgaaaatttgctacgaggagattcactctactcttgcaaaccttatgtcacaacttgaacttggtcaggagggtcaggtcctgctttcctttgatgagcacaaaacatagataaatcatctgagggaccaggttattttatttctagtttattatctgtgaactttgtacaggcatagcagtcgaagcacaaaagaagcttccgaagaaaatccaaccataagctcgttgcttggtgatatttcgaaaatcatacaaggcgctctccacaaactactcttgcgggcatacataaatttctgtcacacagcagtctcaaactatgaagcatacatatggctttgtcatgttgaaaacataataaaccattcattatggacatgaaatggttgtcatcgacgaacaaatattacccaaatcaacattttctagaaatatattactgtgaaagagagcatgataggattatgtaaataagccaaaatatattccagagagtgcgatggagagggatatacctgataaatatattttagagtgcgatggagagagatatacctaatggtatcctctggtagattaagatgactctcaatgtaacgtggtactactccatgttcaccatttctgtaaaacatcaaattagtgtactatctaaagaccatgtcaaaacattgacaatactaaactccaaaagcctatcaaatacatcatgatgggcacactggaattgaaccctagcataaaggcagtgaactttagatgcaaccaaaaaaatggaaaaactatgtattttttattataaaattcttatgtagaactgcaaagcatacaacatacaacagtcgtgtgaaagtgcactttaaaatggtctgcttaatatgtttataagctagcaaatgacatgaccttgtttgtcacatgatatttcaaatctacataggaacatacaagatatgcttggttagctttttcttgtggttgattatttgaataaatgctataaaaaactttgcatatccattcaattgtataacaaacatgtgagggcgaaatagtgagataggtaaacatcttacttcagaggacctgcaagcagccgctgatttgagcaacagaatgaatatagtggtaaagtgtgaaaactaaattgagcagcaccctagtcacctgctagtaaaaatgtgctacgtaactccagacatagaggagcgtcgaactcgatgttctatgaggaacactgaactgttgaagaaaattctcattttaattccttctttcatataattatcctgcaaaactaaagggcacacaagtatatatgagttcaaatggatgcagaagtgcttatcacaccctctttggagaaaatggcagtgtaaagtatgattctacatactgattcatgtgctgtataaacaagaaacactaataaccaatttcgcatttgaaattagcaatccaaaaaaagctaacagagcaaggtaagcagtcgcagctgtagcaccacagtaacaacgtttctgagtagaatgaaaaggccggccagccaccacgaattttgttgaggacggataagagcatcccatcccctgggaggtatacccaacagcaagcaacatgagcatactctgaactctgctctaatttgctctttaaaaataaaaccccaatatttatacaaattttatgaggcaagtacatgaatttaaaatgacaagaaaaacaattgacaagttttataccttagatttcacatcaataatattacgtattgcaattgtataatatataacaaatatagcacataattcagtatgagtttatatgttcttaaaattgatcatagattgaagttgttgaacaaaaaaaagtactaattgttcacagtatgaaacatgtaaagaatggaaaatgataaaataatactaaattatataatttaaaccataactgtttggtagctactgctctaaaaaaataatgataatcttatttttcacttggaagaaattcctctcaatgaattataactgaacaatcattcaagcgttattgccttgtcttgtttcatttatttacagtatctaacagtactactatctttgctatacagattgccctacataatgtttatttttcatacctatataaccaaaaatgagacaccgtaaatagaaactaaaagtacctcctaagagtggctgaatttaccttggttaatagggttctgacataattatctgctgcctcctgaaatttctcttcttccaggaaatcaaggggtatgcgttgttgcaattagagacaattttagattcacagcttctacagtgcatgccccactcaccatatatatggatagacaacttgggattcagcaaattagttattagtgttgcaatatagaacgaataaataccacatatatcaagatactgttgtgtgcccggagaacccaacaatttaacatgaaggaacaaagaaaaaataaaaacaatttgaggtagtttaccttaacaacagatgaccaaccatattcttttttaagtgagctataaaatgtgcataatcggtcaacatcatcagtggaatactgaccattctctgagtatagaccaaggcacttttgaatagctatgaaacacctgtgtaaaaccagtgaaaataaatcatttcctagagtattatcaagaaggggtacaatgtaagtcagaagagtgctatatacgcaatccctgaatataagagaattccaaaattgagttgatatttgcatctcatatcccagtgttctgaaattattctgcaacagctacactttacctaaatgttctttttaagtcatagaggaagattgtagcaccaaaagatgcatcaaacttatcctaacacttagccttacagcatcactccacctaaaagatgagcccagttggcatggatgcagatggttccgaaagttttatgtccaactatctagggggattaagccaaccaatacgcatgcacatggatgcctattgcagtgaccttacttgcactgaaagtttgggctcttggacggatgctttctgacatggtatactaagcacctcccttcttcgccacttattccgttatacaagccttagcagacagaaaattggttcatatcaggccacatatttcagataccatgcacactaggtaaattctgaaaaaccagaggctaaccatcctcacttatcctaaaagggcaagccaagtcgttggtaagcatgatcaccccattgtttatatgggactactgggtttaaaccggccaccacccaccaggttaactaagaaccctcctacaagctaaatataatggtatagctcccctgtcctcctatgaagagcatgtgatatacatatattaggcaaagagagaacaaacacaagaaataacttaaatcaatcccatgcaaagttttgcaacatggacattaaatacgtgaaggactgaaggctcataatcaatcgtgataacatgtgatttttgcctcgtggatagttcatgtggttgcagaccaaattgttgtcatgattaactacagaatgcaagtaccgataaaattggttgaattagccgattgacaaacactttatttataaaatagagctagattatcatataactcataaactgggagatagtattttacagaagttgctaaagcatgcatcatcacaaaattctaaatttaaaaataacaataatctaaaaatcagatattatatatacgtcaaaaggaataaaaatggcatgtaaacaacatattagcataagtccatgttgaaattcaaaacccatattcactgttttcagagtttaccagaagaccaaagcaaagaaatttaagtgaggaaaaaaaagcagcacaagtgtctcacttgtagttatcaggattcataaaaagcatggacctatatgttttctcagcctcctcaaagcggccaactttcaacaaaacgtaggccatttgttctttgaatgatagcttgtcaacctagaaaaaaaaataattatgtgcgcccatctgtctgagtaatattttcctctttacatgattgaaaaagataagacttacaattttgctatcctttttctgcatctcctcaagagctctgtccagcattatgcattcctcgaacaatgaaatctgtggaacaacaatagcattacataacaagtaaagatgatgcgagtattcaaaataacacaaattctttccacctagtttccagagcatgaaaagtacttgtatataaataaaagtgatggcataaaatcagaacataagtaaaaaaaaagaattcattcagaaagttagattgcttgaagaagagatagccagcagcaagttttcaactaatatgaagaagagagtgaatataaatcatcattcgaacacttcatatttacagacagcattatgcaaaatgcagcgcataagttctatcgtaaccttatgcctagcatgtaacatatcatgacttatgtcatccttcgaaaaattgaaagatgggtgaaaggcaccgacatgcatctaatgcaccaaaagaagcaacaagaaaaatgacacttttttccgacaactcgattcacatagagcaatctgaagcaaagaaattctagtaaacaattaatttaggcacaataaaaaaaatatcatcagaatttacttgtgttttttgggtatagtacctttgctgaaaagacacgataatttcctggaagaccatcatgctacagctgtatgtccttattaatttggagaaaacaagagagtagattaggctgcagtatttactatctactatattgattagaactttaacacatatagccagatttgtcatttgtgatttgatcccaagatgcatatttataactcatagaagtaattaatctatgtatggaacaccaccttatttctatttcgggagggattatgaccctatacacataactaaatcgatgcagttttagagagagagagagagagagagagagagagatcaatttggcgctagatccggcggtggctggagcagggttcactctatcggttgaggtgtttgtatcgggggtcaccgaaatctgaaaatttcggtccgaagtttctaaaattttgagcaaaatttagttgaatttgaataaatattactcaaattcatgaaaaaattaaaaaatttcggtcaaaataatatcgtatcggaagtgaccgaaatttcggtccgaaatttccaaccctgggctggagtcgtcctgcaagtagaactcgacgatctccgacaggtcggcggcggcagattcgtcgtcgtcgtaggctcgtatctcagcatccccttgtttctggccgcctgcagccacagcaggtgctcgaacagcagtccgtccacggcgaccgccaccgcgccgccgcgggtctgccgcccggccgccgcgaggaggcgccgcacctccacccttcgtcgagcacgtacggccgggtcgatgtggaacaagctcctctcccccttcgtcgtatatcctgaattttattttttttatgctgacaatcatttggaatcggatttgtattccgagttgttgtaatattggaaaggaatagatctccactgtcgtcttacgtggctgattcagcttcggtttcggttcaaggtgattgcgcctctccattttatagggagggcctcaatccaatcagttcgtgcgtcgtcccccgtttttgaggaattttaaccctcacatcaccacagatcagccgatcagatcgatagccatcgccgacatggccggtcgtttcgtgttccgtaaattagcctctcatttgtcttccgaatcgaccaaggcttttccccggcgctgctgaggttcgtgtaccactcccatcctactcccatccttcaattcagttaagtgtgatttctttagataatgaaattgaatataagagtagttacttatacttcatatcttgcatctcaatctatgccttttactaaagagtttaggacgctaattcataatgtgacaggatgacatggctattctgttttaaattatttgtcgttttggatttttcgtaagtaaaacgttcctaacattgactagcttaacatcttaagatttatgcttttagattcaccataagaaatactttctccgtttcacaatgtaagtcattgtagcatttcccacattcatattgatgttaatgtatatgtctagattcattaacatcaatataaaatatgtctagatttattaacatcaatatgaatatgggaaatgctataataacttacattgtgaaacggatggagtatattcacaatatatattattcacgtgttgccaaactatatgaatttttagatattgattgtcaaagttaggaatgttttgatctaagacacagctaaaacgaaagtgatttgaaacggagggactactaaacaatgccaagacattatatcttatatatatttcatgtacttgcaaagaaaaaaacttggctcaattgcctgtcctgatttgttatcctgcctaatgcaggcgtcgaggaacttcaacaccttgccaacaactgggctgtcctctgttcatcacaccaataatcgcgtgatcaacacctatgcttgtgttagaggcgccaacacaaatgctttattcagtacaactgccaaggtcgatcgacttgccgcaacgtcagacttcactccgtaagtatatactattagcactaattaattaattatcttctagctatatgtatcgggtcatgtcctattatatatccatcactgtgaaactgcaaaatgtagaaaggcacactagcactagctgaatcaagtttgatgtgaactcgatcagaaaaggtcatcagtatcttttttatttactgtatgtaattaccctcttaaaccagctggaacattaatttgactagacaaactgttgtaaacaaaaatagccattactgtttcgctttcttaaactacacaaatcggtcagatagaattaatacgtggctagctagcatatagcaaatcgtatttgtagaatgatgattgattttagccaatttatctttttttcccctttgttcaggaggcgaccgatacttgataaagtactccatggcatgatcttatactcatatactatgggcctttgtggattgtttggtctatttctgtgcattgataacaagcgcgccgcccgccgaaattcaggcagcacccaatgctgttcaaagcaccagtgtagttccaatcatgaggaccaatgaggagctccaagtaccctgaggcagtggtggtttgttatttcaagataactgaagctttattgtactcatgtcaactactctctccgtccaaaaaaaaaagacaaaccctggctatgtatctggacatgcatcatacatgatgcatatataagatacatacaaccaatgagtgtgagcctatatatataagtgatgtttacatgttgtgtattttataagtgatgtttacatgttgtgtattttgttccatgtcactggcctacgagtgtattgagtgatgtttgcatgttggaaaactttgttctgattgaccaaaccgctaattatcaaaattgacctaattatgcagataacatttttcttttgaatttttattactagataaaatgtttattcaatatatccttttcttccaatttcgcgagacattgcctggctgtaattcacccctccctccctacgctcttttaactcttgtgtattcactgttcctgcttaatacttcctcgatccgtcctaaaattgaaatacaaggtattttagctatgtaaaatgcatagtcctttttattctttcacgaatttcaaagttaattaaccaagaagtttttccctcaaaaaaaactaataattcaacataatattagaactttaacatttatagtatcgataagaatatctcgtgcaacgtacggattagcaattagctagttattagtataataataacttaaaacttcaagagataaccaggaaaattattacaataatacctcgagagaacctaggtttcatgagcctgagagttttcaaaagtgccaatcacttttctcatccattggatatgatgacctaatatggttcgtcgcttccgtacttttttttattttaaaaaaatgtttcttctttcttggataactttctcacccaaacatgaaacacaattataattcaataaatttacaaacttacatgaaaaatatttaaacttggatataaaaataaaatcaagcttagataaaaataaattaaaaccatacatgacaacaaattgcacttaaaatacatagcaagtactccgtataggttaaaaataattatcgttttgaacgagaacatgatctttaaaaagtaacttccattactattttctattataactagcaaaatacccgtgcttcactacgggtataatgaaaggttaaatgctataaatacacagttaacatatatgtaataatgtttcaagatggacaaaacgtccaatgcaaggttaatgataatcaggacggataagaaacactattgcatattgatatactcatattgtcataacacacgctctctctcaactcttgcatggcaagcgtttgataatttccaaaatcgaacacggactcgcatggagacggatcgtttcacggctcatgcgtggactatagatggtgcgaactctaatatgttgtgttttgcagacgacgaaaagaaaaaaagtaattatgtttgattttcgaatttaaagctggttcattataagatttcataataactaaatatctgttgaagaaagaggtgcaaaacttttgatttttcaaccatcggatgtgcatggtccgtgctagtggcactggatatctgttgaagaaagaggtgcaaaacttttttgattttttaaccatcggatgtgcatggtccgtactagtggcactgaatatctgttgaagaaagaggtgcaaaacttttttgattttttaactatcggatgtgtatggttcgtgctagtggtggagagaaaaaaactaaatatctgttaagaaagaggtgcaaaacttatttgattttttaaccatcggatgtgcatggtccgtgctagtgtcagagagaaaaaaattgcgcgcaaataggatttgagacgtgggaggaaaagtagacttattccgagtaataataagcataaaagtttttgatagggtaatctggcctaggagagggacaacttttttgattttttaaccattggatgtgcatggtccgtgctagtggcggagagaaaaaattgcacgaaaatagaatttgagatgtgagaggtaaagtagacttattctaagtaataataagtgtaaaagcttttgatagggtaatttggcctaggagaggcccatagacagtgcaaatctatatctatatctatataccaaaaataagtaaggcttccgtaaatattttcatacgttattaagcgtgggcccacatgatatttcgtcgctaatcatgattcggaagctgacagcgatctcttaagcccgcaaataaaagagaaaaaaaaagagagaaagcgcatccaaagcagccctgatttgtggattagggagaaatattgcaacccatccaaagcaacagcaggccggcccagaaaaaagcagtcgcagcccaccagcgcgcccacagagcagaggagctacagcccagcacaataatgcgtgatactgtagcaatcaagtaggaataaagtttggactcatgcctaccaggtatcggataaaaaatagttcattttgtaacttaaaaacatgtaatcaccacaaaatgaactatttaccgacaaaataaattatttttaaaaataaaaaacaatcacatgtgtctttgtttttaaaaacatgtaatcaccaacaaaataaatcgtgtttacatccggatttttttccctcatcaatttctcattcgtcatagaacatctaatcacatcactttttttccattcattgtatgatttattctgttgttaagagtgaaagttattatgcgatacaccactttttttttctttccattgattgtatcatttccttctgatttttttagtgagcgattatgcaattggagtacagtgaggttgatctgatagctagcgaaaaatatatcttgtactatggctactctttataatatgaaaaaacgtttatcaataccgagtaccaaaaaataatcatgtattgcaactgactcataataatacatgaatcttgtactatggctactctttataatatgaaaaaacgtttatcaataccgagtaccaaaaaataatcatgtattgcaactgactcataataatacatgacaaaaaaagtagcaaataattatatcatgttagtgtcttatttgctcccacacactaattattattattattttttcttcacactaattattaggatggtgggaatcgaatcctggtggccagggcgcaaattttcttcactaaccaagtaggcaaactgctacttgtgcttggtggttacatgaaagaacacatattctatattaaccgcattttgtattagattggaaaatgtccgaccggactattaagggattaaaacagattttagtaatgggatcaggatgatgggcgaaaaaaagaatatccgaaaccttacatatctttttattaggtactagaaaaaatgcccgtgcgttacaacggataaaacctatttaatcttattattattatacggtttagctaaggtgaaatttactatgggaactctttttttttcaaaatcatgagctacaattagaagtccgatcgtctcaagttagcatgtgagttttttttaaagagatgtcttatacgacttcttttatatttctaaaaccgaaagaacttaaaaaccaattcaaacatggatctgtatttccaaaagtgaatgaaattaaaagccgactcaaatacggatgacataccaaagtaccgacaaaaacatcttcaatttttataataactagaaaaaagcccgtgctttgcgacgggtgaaggctattttagttttattgttgttgttatacggtttagctagggtgaaaatcatcgtaggaatttgcttggatctttgttttagaaagtcatgagttgtaattaggagtcgactcttatctcaaattagcatgaagttttttttaaatgatttcttatatggctccttttgtattttcaaaagcgtcataagttaccatgcaggtttttttaaagagatttcttataagacgtcttttgtatttcctaaagcgaacaaacttaaaaaccgactcaaacacagatctgtatttccaaaccaaacgaacttaaaaaccgactcaaacacggatgacctaccaaagtaccggaaaaaacatcttaaattttttacaatagtagagactagataaaatgcccgtgcgttgcaacgggtgaaatctattttaatcttattattgttatatggtttagttaagatgaaaaaaagttagcatgcgagttttttttaaacgggtttcttatatgattccttctatattaaaaaagtgaaggatcttaaaaaccgactcaaatacgaatatatattttcaaaagcaaacaaacttaaaaaccgactcatacgcttcaatttttataatagtagatagagatatatagatatattgagaaatatctacaaatatatgattttattgaagtacattttaagagtaatctacttaaaatctatatgtatggtctccatgtttctaacacaaatattttagaagttattcatagttgaatcgaagtttttaaagtttgacattgatattgtacaaaacgaatattattttcgagcaggagggagaagggagtagttttaggtgactgaaaatttgtaaatcttttcagccgcatgaaaatctaccttattataacaatatacttacaagtaacatgacaaattaaatgacatatatagataagccaagtgacatgacaaaatgatataatataatcaagcagctgccaacatccagcgatcgatcgactacctagctagaaccacacgagcgccgccgcagccacggcgccggcgaccgcgccaccgcgggccctgtagttgagccgcccggcggacgacgacgaagacggcggcggcggcggcgacgccggcgccggcgcgttggggtcggcgacgtcgacgacgagcttcatgcccagctcgcagtggttgtcgacgttgcagaagaaccacctcttgccggccttgtcgagcgccaccgtgtcgttgccggagttccacgtcatcaacgtgttgccctgccggttgcacgcgtggaacgctgcgccgtccacctccgtcaccgtgtgcttgcccttagtatacgtgaacactgcgattattaattaaagaaaacaaaaagggttggaaccatgcatataattcttttaaacaaaatggtataagtcagaaataagtatcgaaataatcgagaaatgaaaaagggaactattcggatgaaaacatgccggcatctattgggaatatgtaattcatgtcagaattgtgaaatataaaatagaatttaaaaattatcatgatgaaatataaaatagtataaattagttcatgcttatactatgcaaattgtggacaatctctcctttaaccacatactcaaaataatggtttaatgctagagttaattaagcacctgtgctatggatgaagtggagtcctgggccaaatgtatatattgtcacatttataagtacggtaatgtaccatattatataaaactttgcctgaaaaaatggcaaacctaaaactatttctggttccatttcaattacaaatataaaaccattttcagatgattcggcccgtaaaaacatttttttaaaaaaataaaaattaaaacgacagttggttggtcggaaattacagaaaacgttttcaaccccctaagtataaatacctagtttgtcgccgatttggaatgatttgccgtcggcccagttggtggaagggtactcgagagtccagccatggccatcgccgacggtgtaatccgtggcagagaccatcgccgggagcaacgcgacggcggagacgatggccaagagcagcacttgccgggaagccattggtcttgcggttggagatagcttgctcgaacttatatatcaacttaattctgcttctaaacagctcttaattagtatcagagctttattagcaagctgtaggattcaatgtcttggagagaagagtgtaaatgatcacatctatttatacagaggtaaattaagatcaatattattccatgacaggtcgagatagcaagatcgatgtgcaggtagctgacgcagcagatggtatgctagctccaggtggcgcatgatatggaggcaattaatattaattagttatttgtctgtgaagagttcaattaattaaattaatcttgtgtatgctttggtgctatcagtggctgggtgtacgtattatggctgaagccaaggggaagaaacgactggcacattgttgtttcccctagctagtagctaactcgctctttgctttttttcttcttctttattttctttttttcttttcttttttttttttgcttgggtcgacgttttcctgatgaattagctgggtcaatggccggcttgatcggttgtcagcaaaccaagttactgatccaacagagattatttgttgtagagggaattgaatatatataggtggctgattccattttaagtgtccatgtctcagtatatataggtggctgattccaacatggatacttggtggcatttggcaaaatttatgtgttttgttttccatacattcaactaggatagtatacgtagtggtgccacaatcttaaaaatagtcatgagacttttgttctgttttggataggacagtacctatagaattagtgcaaaaaatctatatgatttgtcttagtttttaattcagatggtcatatatcatacgcaatggtgctacactcttaaaattagaagccaggagacttttgtttcattttggatagcgtagtacctacagaattagtgctagaatttatatgatttgacttaaattttgattcaaatggtcatgttttacaaaagttggggaattgttccatcactcaatattgtttttccttttctttatcaactcaatgacttttgtttagaaaaatagtacaaattggttgcgtgtctgttgaaaaaattcgaagatgtatccatttccattatctaaagaaaagtcctcatgttttttaccaagcctgcaggatatacataaagtgaattggaatttcagtattcaggtttagaagtaggcaaataatcgttgcctgtcatcaatttcaattattacttggtttacttaagcaaggtgaaaatagtactgttagatctgtcatcaaaattactttaaactggtatgtttgtctatctatctgtgtataaatatttccaagaaaaatgaatagtcaaaacaaattacaaaaaccaatttcttcatatattaaaaaaacatacacacagagaaaacttctctaaagctacaatcaattaattaattaaacaaggctacaattaattaatcaacaaacaaaggatcgaggccttgttcttcgtcatgtatgatcaagctgaagtacgaaacgagcagccagagcacaccaactgctaggatgaagccacacatgacctgcacatctaaccgttgatcagcgatgctttgccctggattcgggtgcaccgtggagtagatcgtcgtgctcgacgccaatgcgatcaaggcgaagcagatgacctgcatgcaattaaataattactcctttcgttctaaattataggacgcccctctttttaaaaaaaattaaactcggtaacttttaactaataatcataataactatatctatattaagtattatgcatgttatatcactagattcatattcatattttaaagtactttcagtgatgctaattttatatttgttgggaatatatatacaatagaataaaatactggtcaaactatgttattgcaggccgtgtaaaaaaatatagggcatataatttgggacaaaggaaaaggaagtaataaactattgtcataaacaagttaatccatacatataattatctatatttgattattattacgagaaatgcctagggcatttctggtggccagctccacaaggtggtgggttaaacgacctgagttttaagcctcaccacttctaattatttgatattagctaggtcattccctaatattcactctttattattattattattattattattattattattattattattattattattattactactactactacttccttcgtttttcatattataagtttgattaagttaatagataattagaaacatttacaacatcaaattggttttaataaaactaatttttaatatattttttatcatatgtttattttgtatcaaacatattactatattcttctataaatttaatcaaatttaaagtttaactagaaaaatagtcaaaacgatatatttataatatgaaacaagaagtattaatttgatctatcgtgaagataatatactccactgtatatatatgatataccttgaagatgaataggacggtgcgaatagttttgttcgcctcactagaaggacgaagacgaggctgaaacgccgctgccgccggcaagatgcgaggcggcgctgcagcacgggctggcggcggcggaggtggcggcgcgaggtccttgatgacgtggatgatgaactccggtgagtggccgtcggaattcatggctgacacaccgaccgatcgaacgaacgaacgagcgtaagtgcaagcaaaagcaaaattgaggatggtcaatatatatcagcacgggattaaaaacaaattagtactctctcctcccctaaatgtttaactccgttgatttttttaaacatttttgaccatttgttttattcaaaaacttttgtaaaatgtgtaaaactatatgtatgcataaaagcatatttaacaataaatcaaatgataggaaaagaattaataattacttaaattttttaataagacgaatggtcaaacatttttaaaaaaagtcaacggcgtcaaatattttgggatggagagagtacttgtatatccgattcggatctatagtacttacagtgaatcgaattcctagtaggattcctctaaaattggacacacaagatcgaccgtccaatctaagcgttattccgtcctcaaacaaacctccgtaaagacattttatgcctcacataacatgcttcttacttaacaagtttcaggtattatgttctgtatcacaaacagaacaaacgcaacataaggcaccagaagcatgcgaagtatgcatacgcaaccttcaattgaattttttgagagctttcaaaagaatttgcagcaatgaatgttgttaacatgcgaagcggccaaagaaaaagaagtccaatctgaccatatgaaactgtgctgatctaaagaaattgtgttttcaaggtcttactagatactaagttatgtatgtacctaaaataagggagtatatgcacccgaaaggttttctgcagcaaatttgagcaaacagctttaagcactataccatggtaatgaccagccaatgtgagagtacgtgcagttgtgggtaaaaaaaacatttgcaatacaatatatccaattggatatagaggccgtgtaaaaattactcttctctaaaataaataaataaataagcctttgcaagtaatattcacatcgcaatcttctcgttcctaaatcatacttgtgaactgctaacaactttgctgccaacgtatcaaaggcagatctctgagcttgatggatccaactcgtcatcaccaacaagggtatatctgtaaatgaaatgaagcatcgcctgcaaagagtcagggtgcgcaggggcgagcaactggcgacgatggtgcgtggtggccgccggcgagctcttccggcgtttctatgaacacgagacgtacgtgagcgaggacgagcacgtgaacacgaccgtgagcaggggcaaaaacgtccgggataaaataaattggatgaaaaatgatttagaaatagcgaaaatagcattctagcgaatgcccacggcttgacagtggtattcgagctaatcccactttaacgacggtattctagcgaaactaatttttaataatggcagatatacaaatttctcctcgctgaaccaaccggtgggagagccctccaccttctccttccattggaaaaaattactgatccaccaaactaattcttatatatatttttgaaggaataaaaaacaatactataattcttaatttttcaaaaatattctcattgaaacaataaaaaataggaataggtatttgtttgttaaagtcaaaagaaacaacttcgttccctagttattataaggacttttattaaaataaaaaaaagattgaattattttacctcggtctgtttagttcccaaacaaaatttttcatgttatcacatcgaatgtttggatagatgcatggagcattaaatgtagacaaaaaaaacaaaccaattacacagttcgccaggaatgcgagataaatcttttaagcctgattgcgtgttgatttgacaatatggtgctacagtaaacatttgctaatgatagattaattaggcttaataaattcgtatcgcagtttcctggtggaatatgtaatttgttttattattagactacgtttaatacttcaaatatgtgtccatatatccgatgtaacattcaggggcaaaattttttgccaaccaaacaaacccttaggcctgctttagttccccaatttattttcctaaaaacatcacatcgaatctttggacatatgtatggagcattaaatatatattaaaaaactaattacatagttagagagaaattatgagacaaatcttttgagcctaattagtccatgataagccataagtgttacggtaacccatatatgctaatgatgaattaattaggctcaaaagattcgcctcgcgatttccagacaagttataaaattagtttttttatttgtatcaaaaaccccattcaaaatccgatcaaacatctaatatccgatataacatacaaaaaaatccatttcacgaacccgttagtatccttcccgggcggcgctgccgccatgtcccgcgtcggatgggatggaggagggtttgggaattttgggctaaggcatagctttggacctctcggctcggctcatctcctctcggctcggcttaaaaacagccgggcggctgccacgctagctgcctctccccttccctttctccccgctcggacttaaacccccccacaaaaaaaaaaaaaaaatcccccacctcctcggattcccctctcctcctcctacttcctctccggcgaaccccacgcggcggcggaatggggaactcctgctcctccgtcgacgagagcgccgccgccatcgccacattagcggagagcgctgctgcaggggctcgggaaaccgtcgccgacgagttcgccagggcagcggggtcgggagcgggagggcgaggcgacgtcnccggatcagcggccgcaggagtcgcctctggagcgggagggcgagacgacgccgccggggacgaggttgtgatcgctggcgtcctgtcgctggccgacgggcagaaagccgccgccgcgggcgccattagcggggtcgagtcgatgcagtcctacatgagaggtactcgattcttctgtttcggagagcgcgtgtgctcggaccagatggccgcgctcaagatggccgccgcgtgtggttcggccgccggcatgagggcggtagccatggttgccgcccgagctcggcacgccgcacggattgccgcgaatccagacgttgagaatcctctgcatgatatccccgaggtaattttctcttgtttttcatttgtgatgttgcaatcgatgcatttgtgtgtcaggaacccacactctaacctcaatagatagtatccaatacaaaacagtagtggatcggtgtggaattgatggtggagaaattatggaatacaaactgaatagaaggttctagtagtttctagataagtagaggaagaggaagggtagagaagaagatcaacaagggtgccaagcccggccacccaagtcgccgccaccgccgattccaaatgttcgatgcctctaagtgattgctgttgctgctcatatatgctgctagttgtgcttgtgtgggccaggattgaaacatgactaacttatcccatctgcagcccaactgtgttcctaacaatcccctctccttaatattcgacttgtcctcaagtcgatgcaaattattgccatgccaccaggatcccaaggtgtctgaagttcttgcatatagttagcaaccctctgaataacaagtgattgtggattattaccagcaacgcttctcgatttcatcttctggttatcatccatcagccaatgcaccaaaagttgattttagttgatttgcaattctcccttattactgaccttttctctccctttttccaattgatgtgctgttacaggatcgtcctgattacatgctatccgccgctgccactggagcaagagcaggggttctatgtgcacggatgaagatacaagcagctggtggtgattctacttcacatgttagtgccagatcccaactattttacatcttctttaaacaattagaattagggcctgtttagatcccacccaaaaattttacaccctgttgcatcgaacgtttgaacacttctatgaagtattaaatataggctaaaaaataactaattgcacaaatttcgactattttgcgagacgaatcttgtaagcctacttgctccatgatttgacaatgtggtgctacagtaaacatgtgctaatgatggattaattaggcttaataaattcgtctcgcggtttactaatggatactgtaattagttttttattagtgcccgaacaccccatgcggcaccctatataatacccgatgtgacatgccaaaactttacacccctggatctaaacacccccttcatcgtaaaaaaacacccccttagtatgctttataccaaattcatagtttgttacttacaaagatttgttgtttattgtattcatgactacaaatagtatcaaattaccatgtttgttgatgtttattgtaggcgaagtatgtcccttttctcgcaccgttcattggaggtgcactaccagggtcatatgcggcctatcacctcgtgaaacattctcctgaatgggtcatgggcgtggtctttggtagcatttctttgggtttcttcgcagcttgcacaggaactgtttctggtttactaggcacgtcatccgccacattccagtacagcagatttgctgccattacaaccttcacggctgtatggtttttattcagcttcgctatgacttccgtgttttcaaaaacatggcgcaagattctctgtggatttatatgtggtgtgcctggggtaactttcgtgggggcctggctatattcagggtggtaagagttgttaacccttagctagtaaaaatcaactcagtatgtaaattatttgctcatttttgttattttttttattgcaggtgagaacgagttgcaacaaccgtttcatctgtggagactatagtttaccatagcttgttttctttgatgtggttgtagagacttccatccacatagtacagtctttacttcagtacattttcgtagtgattacagaacatgacaaagggagaacagatcatagttcctacccatatacagggtgaaaaggtggtgctaaaacctctctttaaatcaaatattttccaatatgcaaggggcctgtttgcaaatctttttttgcccttgcttttggatgggaccattcctatcaaaacagtaaatactgttgttctgggtgtctgaactgtgtttcttgatgtttacagattttttcctccccgtatcaatgccaagttcttggttctatgtgtgtttggactgaaggttttgtgtgttgggtggcattataatcgatagttcaatttcagattagtaatttaatcctcggtaagacaaatattgactgaatattaagggctttgttatatattagtgttgagaattttgatattcgtgttctaattccaatactatgttcgctgaaagttcactgccatggtttagccccagttaattttacttatgtatattattatatattttctttctgcatatgctaatatattctttctgaagaatatatattaggtcttctgtaatgcataagcacatattcttcagaaagaatacctaatacattttttaagaaagaatacctatcatggtttacactgtagtgtcggtactgctaataaaaaaatattctttccgaagagcgagtaacgagttgctggagtgcattttctatatattaagtatacctgaaaaaatatgtatctgtactgcattcaatgtagccaagtaatgctcgatcctaatcgtactatttctacatcttatataccgaattcaggggtagaaccctggtatttgattgggccacatgccactaccattacaactgctgctgaattctcggttagagaaactagaatggggatgcgtggccccgcacaaccaccaccgcacacaaatctctactattataaaaattaaatatgtttttgccggtactttagtacgttatctatgtataagtcgatttttaagttcgttcgattttgaaaatacatatccgtatttgaatcggattttaatttcgttcgcttttggaaatacataatgagttgtataagatatctctctaaaaactcgcatctaacttgagatgatcggactcctgatgctcatgattttctagaaaaatatatatccaagcaaatttgaatagtgaatttcatcttaactaaaccgtatctttactattataaaaattaaagatgtttttaccaaaattgaagatgtttttgccggtattttagtacgtcattcgtgtgaaacaatgctaacttgaaacgatcgaactcctaactgcagctcatgattttctaatatatatatatatatatataagcgaatttcactttaactagaccaaacaataataagattaaaatagtctccacccattgcaacgtcggatattttcttttctagtataacttaaacataaattttattaaacacaaaaattagctatcgttgatcaaatgttctccatttcgtttaacctaaaagggtaatgtcaaatgtagtatatatataattacaaagtgtgtacagtatcaaccttctatgtgattggaccacacgcaatttaagactaaaggaggaagaagtaaaaaagctgcaaaaaagaagaaagattgacaacgatatttaagtcaagctttgtgaactaaagtacaatggtctaaagagagataaatccatgtgtagcatagcatattttgcatgaaaaaaagataatatagatcgctaatatgcatgaataccaccatacccatcacggtgagcagcattccaaggatgatcttcacggtgagggccgagtcgaacataacccagataagaatcaacatgcactcggtcttcatgtggccccaggaaaacttcatgatagtaactgttctgtctggttagcaataacttcatctggccttcagggcagcacagaaaatacaataccatctgaatccatgcagcaagattctttacttgttataattaagctcaacaaatataataggctttcattggctgattcaaattgttgaattgaagggtgcctataaaacaaagcaataaaaatgaattatttttcttgaactgttaattaaaagaacatgacaatataagagggaaaagaaactaatacgaaaacctcctgtaaatataataggcttccgtagggcaagttgttatttggttagtgatcgatctacggaagaattcagcagttccataccttttgatttgttagagagacaaaccaataacatatacatatttttggtgcaaaacacaaggcattttaaaaataagggatgcatgaaaaataagatctggaatagattaaagaagcaaggtcaacttctaaatttcaatgttgtacccaccacaagtgcatcgattctttaaaaaaaaagaagaggagttaacatatcatccagaccggtagttctatcaaacatttaatacttaaattatgtgtagggaaagtttatataacatgtaagtattccaattagaaatacatagaagtattcagattcaattcgaaacttaatcaactaagggttaaaaactgtaaatcaaatcaaaatttcttattgtggaaatataagtacccatacagagatatcagcagctaagcatgaccgttgatcattctgtgcagcagtacagagagcaatagaaaactccagctagaggctatggaggcacctatactcgtgaactcagcttcacctaatactaacgagccaagacctgttgcagttcttgtagtggagaacaaagtgaaagggcagatcgatcaatatagttgccatcactgcatgcagtttatataaatttttatgcatgattgacgaaaattatgaagggatttgcagtataatgttaaccatggattgatccatattagtaagatataaaactaatattcaaaaagaacaccaagccactaaaacttcttaatggagtggaaagaaggccaataagtaagcatgacgtgcgtacagccataactgaaaaaggccgaataatagacttgcagttttggacctttggtaggattatagaaggtccctgctataaacttgattgttgtagcaaatgaataagtccatcaaagaacatcttttggaatcacaaggccattgtttattntacagcaccagtgctgcagctgcaagagcattgagtaggaacatgcccatcatgaacataaaaatgggaagagaataacatcaaagtattgttcagcacatatacctgacaacgttctttgaaggtggctctaaaatactttgctctgactcccaataaaaatctcaatagcctcctcttgaaggaaagtaaatcaaaaggaacatgtcaaaactacttatcaaagctaaggatagtaatatttattcgaattgaagtgcataatagcaagcctagaggaagttgaaaaggcaccttcatcggtcttgaaatcaaatggctactgttcatcatatcccttcttcgaaaatattgtgccatcctgaaatattctaattattttaagtgtcaacaatgaatacaactttattattatcagtagtaatcacacgcagttgacctctagctgatatatgcacaagagaaaataacaagatcaacaaccattgtgctttagcatacttttgtcagctgcaccttcattgtgacgctcatacccttgaccctccttgagaactttgttcaaaatattttcttaatgacacccatttctatgagtatttctagtgaaaacaagttaagatcaagtgataaacacgaagagtggcattttatttggtggtacagcatcttcctcaatagctgtaggtccaccactctcaccaaatctatctaccattacaaagttttaaatcttttcaatcaactcagagaaagagatggcaagccatacaaaagagagtgtgaaatcaaagaagcttacattatggcttcttttcatgatcttgacagctttcgctagtgcaggacagaaaaaccctggaacaaaaataccgaactttcattagttagcaagcaaccgattgcgttcaatactatgaacgtgaaatgctgacagggagataaagggagatggataatgaccatcgttaagagtaaattcatcatctttaagaacacagcagaaagcacacaaaagataaagaaggacaataagataatcaaactcatgttatcatccagattcacaagaaagtctttgcctgactgctagaaagtaccaattcgtacaatacaaccgatctcacacattccaaagaattcatgatttgactaaagatcattttgtgatgatcatgaataacatgtacatgcaacaacgacgaatgactaactatggtctaagtactatgattactcaataatgataggtaaattatacaacacagcgccgccgcggatcacaacgccgccgcgaggagagtgggacacaggcatcggctccaacatcgtcaccggccacaacaccgtcgcggggggatagagaggaggaggaagggggacaccggcgacggtccccaaaccgccactggcccagacgtggccgcgggggagggggacacctacgccagccccgctgctgccaccgctgacggacttgcatctcggcggctctgcagcatgcccttttgccgccacagggggtagaagaagaggggagacgacgggcggcggtcgagcggccgatttcactgctgcagcagacccctttgccaccacatgtggcctgtggtgaaggggtgtcacgacggcagcagcagctcaagaaccgggcaattcaaatcacgaagcaatgggccgaacggggggtcggcccattcgttaatgacagcccgacaagcgctttccagcgagtgagtggacccagtaactatcggctgggccacggctagtgagtgaggcttgatagcgtattgctatataggccagcagcgatagagagaaggcgtattattataatcaacaaacagaaactcaattcgaatatctctgctgcttctatcgtcttcctcctctatcttcctcttcttcctcaacaaatccctctcgattctctctctctctcgaattctccttggtgaccaaatccttcgcgagaaagacctagaatcgtgacaagggggcgtcggctccgacggacgccatgcctatgcgctcctttgccacggaagagggacggcggaaggcacccgtgccaccgcagtctcgtgctccgccgccaccaacctcgtcgactcctgtgccaccgcggcctccccgatccccgcctatgtggccatcgtcaagttccacgacggcgaagcaggacttcgcctccagagggaaggggtagggggaaggttggtgctggaggattagggggagggccgacgccgccgtggggcatgggtggtcggtgccgaccacgtcatctccctgcaaccccagccgaagtagccgcgtgcggccgtcctggccttgcgtgcggccctgctgccttgtcgccgccttcacggcatggaggggagcctcgcttaggtgggcagcgccgccagccaccaggaggagatgctgaaacagcggttgcggcgatggcaggaggagggcgagaggcgccggtccacgggcggcgttgggatgggtaggcaggagataggatttggatgtgtttttgcaaaaacacccttgtatttccttggattacagtgccatccctgaaaacagaattttctctttttcgtgttatatttctcagaagtatatggggctttcattaaaaagtgtagtaaggtaaaaacggtggaaggattgcttcaagatttcttagagtattaggttttttctgcaaaaacaagtggggtgcgtgtggcttgcatgcatgcctcaaccgcccattccttgttaatcacaccggacacgaaggggatacatgtctatggaaacagagaaatgaccgtgggaaccgcgaacaaccagtcacattcgcgcgcacgaggagccttaaacacaaaacgaagacgtgtaaaaaatgagatagccagaaaaaattgaaaaaccgaagaaaaaggaatggttaggggagttattgattgatgatgtgccacgtattcacaggcctccctcagccgtttgattgtaaatcaatgatagatatgatgcaacggtccaatctgtgatttcttaataaatgattggttgttctcaatgcccatcagtacacggcacgtggcaaaacatacggaaccggaaacggattgcacaggaaaaaaaagaaaataaaaagaaaagaaccagaacaaaaggaaaaaaaaattcccattcctgatcgtcaacgctctcgccactcggccgctgcagccactcaatacgccgtggtacatggcggccttccccgtactggaccatttataacccaatgattaggatggtgtctatatcattgaataagttaccacctaagatgaaaaataatgtgtcaaagtgaataaatgaggaaagagaaagaaaccatgtcttgtatgagacatggtttctacacaacatccaagacatcatgtgagataagtagcattaaatttaagtatggaatagtgatgtttgcattggaagagtagtgtctagtactagtttttttatgatgtagagtttatggaaattatgtctagtgtcttgggttgtgaatggcctaatccactcattaagaagatgccacatcatcatccactaacaatcatcacatttaaacatcatgcaaacatattatatctttatagtttttatagtttaagagcttttcaaatacaaacatgttaaattatcacccaacataatttacataatgtttcaatgtatatctttattatgttttatgatatcctatatacttatatagttcatcttcacttagttagtgcttaaatgattaatctatggtccaaattatctttctccttttttcctctaattaagtcatatcacatcaattatttttagcctttagatgattaatctacggtccaaactatcttcctacttttcttcttccataaagtcataccaccttactttttacgtttgaatcatcattctacatactatttaaatttaaattagcataaaccataataatttacttaatctaatgttatgtagctatcttacacgttattttttttattgttatcgtactaaattcccgcagcaatgcgcggggtttcacctagtattactaatttgtatgcctttgtttgtcttaacaataatctgaaaatgtatgctttcaatcatcctctcgcttatgtttttccaaataactcattactatatttatctgtaaagcatatgtctttagtgattcacaagcaaatactataaaacaaaaaatttggctcagagtctaggaatcgattaaatatgtaaaactaagattcaactcgacaaaaagctggctggtgcataactaagatggtgaagaggaaattaggatacgcaaaacgagaaaaccattagcgcatgattagttgtcctttaattattacaaacgtgaaaaatgattttatttgatattttaaagaaatttctatgtagaaagttattttctgctttcaatatagttattttacgataaatagaaggagctaaaatgaatttattacgggacagaggacgtagaattcactattttttctaattgtttttcatttagtctattagagcaaaatcatgcttaagtgattatagataataagataaccactaaattttctgaagggcctttcacatatagatttgtcgggtcctagattttaaaacatgatcgacgaccgctgcttgatccatcttttttccatttcatatatgaactattttttaaataacctatacaatacttatgcacccaaaatatacaatatctacgggttatccattcagtgtgccaaaaggcacgcttattttctagtacttctctgaagcgagagctcatgaaagtggcatccacagaggagctaggatttagacacgagaaacgccttatatactacttcatccatattcgtagtgttgctgacttttttatttgaccatttgtcttattcgatttgttttataaatataaaaatatttgggcgcgactatgcatcggtcgtccaacggggagagggggaaagcgcccgatt

SEQ ID NO: 80275 - DNA, 16063 bp, Oryza sativa
aattgatttttctcttaaattacttatccaaatcatgatccgattgcacaattaaattcgttgcaattaaatcttcaaaacaagaccacacatggatatattccgacaaaatttttttaagcttattattgaattatttttaaatgttgcatgatgttccactaggtatattggaattgtttggctaagcagattaaaaatgttttactcgtttaaatcgggtgttgtttcaccttatataaaaacaatgtttcagcaaataacgaaagattgtttcagttcattgcaatatttgatccatatatagtgaaacattataagtacactaggtgaaacatttttcggtggaacaaaaaataaaacgaattcccttaatagggggtttcaaaaatatgtgggtttttttgttgcaatgaaatatttcagttcactgcaacattagatctatacatagtgaaacattgtgagtacaccaggtgaaacatttttggtggaataaaaaataaaccaaattcctttaatagagggtttccaaaatatgtggttgatttgttgcaggtggggacatgtattgtggtggggcccagcaatatcaccgcgcgcggggggagcgcccgatttttgctcccgccacccggccgctcgaagacaagtattttcgaaaatatttatgtcatgcttaaccatctgaccatttgaacatatgccttagactttgttcgatacatggggttggaaacccatcacctccatacggaaaacggagcagtccattagcgcgtgattaattaagtattagctattttttttcaaaaatgatcaatatgattttttaagtaactttcgtatagaaactttttttaaaaaacacaccgtttaatagtttgaaaaacgtgcgtgcggaatacgagaaagaggggttgggaacccccttcatcctaacgcagcctaaagaatattttatgataaatctagtcacaataaaataatggaaaatgatgccatccgggcgaccggcgtgggggtgccggatggggcgctcccccgcgcggccctctccccaagcgcctacatgcatgccgctgggctccaccacagtgcctgccccacctgcaattgcaacaaatcaaccacatattttggaaaccctctattaagggaatttggtttatttttctgttccaccaaaaatgtttcacctaatgtactcacaatgtttcattgtgtatagatctaatgttgcagtgaactgaaatattccattgcaacaaaaaaaatccacatattttggaaaccccctgttaagggaattcgttttattttttgttccaccgaaatatgtttcacctagtgtacttataatgtttcactatgtatggatcaaatgttgcagtgaactgaaacattctttcgctatttgctgaaacattgtttttatataaggtgaaacaacacccgatttaaacgagtgaaacattttcgatctacttagggaaacaattccgatatacctggtgaaacatcgtgcaacatttaaaaataattcttaaaaaatttttccgtcggaatatatccatgtgtggtcttgttttgaagatttaattgcaatgaatttaatggtgcaatcggatcatgatttggataagtaatttaagagaaaaatcagtttaaagtagttttgcacgtaaatcgggcgctgacgtcctcgcccgatttagcgcgtcctaaaataattaataattacattatttttttaataaaacaaatggtcaaacgtcgataaaaaaaagttaacggcgtcgtgcattaatataggaagaaaatattatcatcctagatgattattatgtgaaaacatagaagggttggccaccaggccactgaacatggccccttgtctcagctactgggttgccagcttgttgttcttcgtcgtctaggattacgcacttgtcatcgcagctgaagtaggaaaggagcagccagatcacagcaactgctaggatgaagccacacatgagccgcacacctgatcgttcatcggcgatgctgtcccctttgatagggtgcaccatgaagtagatcgtcacactcgatgccatcgcgatcgcggcgaagcagctgacctgcacgcaataatcaatcatatattataacaagttaatatatgcatatttaagaggatgactataggaaacgctatatcattactttcgaggcagatttagtaccaagggtataagataccatacccatacccatatgagtgacgcaatcatgccatcaacaatggtccaaggcccaacacttaaccctatttcgaagcctaactactaatttgaccctatttttttatttgctaatttaacctcatttttcaaaattgaatatgccatctgaccatatttgcactgcaccattaggatttcacaaaaagataataccaaaaaatcacatttcacttcaaccctatctctctcatctcccgacctcccttctcatcttctctggcccaaccctctctcttgcccgtatctcctatggcacgaccagctgccgtggtgcggggagggaggaggaagcggcgacgtgcgaagggaggcagcggtggcggtgctggcttgcaaagggaaggcgcggcggtggttcctgcgcacggaggtccggcttgcaaagggaaggccggcgcggcggtggagctgcgcgcggaggtaggcgacaacgacagcatcggcatgcggactgaagcggcggcggcgtgtgaagggagggcacagcggtggcgccaatgcacgaagggaggagcggcgatggggccggcgcaaggagggaggtggggcggtcagcgcacgaagggaggagggaagcacgggcagtggtgtgccgacatgtggagggagggggtggcggcgcgtcagcactcggagggagtactatatttttctataaactagatcacaattaaaaaaaaataaaaagtccaaattaccccctcgactaatgtggcagtacgaattaccgcttcattttaaagaccacacattctttaccctcagactacggagcggttttggtccatacgtgacgtacacgtaacagtccagtcaacataaaaaatataataaaaatggtggggcacatgcctcttctcttgatcaccacatctgggctctacatttttttatattctttatgcttactagactaccacgtgttcgccacgtagggctaaaaccactccggtggagagtaagctagtgtttgggtgggagggactaaactcaaaaaacataagtccctcccatcccaaacaccgggtgggagggactaaacccacaaaaatataaaagtcccttccattccaaacaccacctaacttatcaagtacaacaagttgagggtcgtttttgaattgagagggataatttataccgctattatagttcagtggggtaatttggattaatttcttaaaagaaaatgagtgaaaaagaagaccgaaacgaagatagtagtatatataccttaaaaataaaaagaatgccacgggccgctctgaccgcctcactaggaggcggaggacgtcgtcgaaacgccgtcgccggcggcaagatgcgaggaggtactgcaatggcgtttggcggcggcggcgcgagatcgtcgacgacgtggatgatgatctccggtgggttgtggacggactcggcgttggaattcatagccggcggccgaacacgtacgtaacgtcgacctagcaagatcgcgcaactccacaagacacaggtgccagagaaaagttaattaagggcgatggatgtatagtatagattgatactacatcaccacgcgatattatatatacatatatagtctacgttacgtatggtgaactaatcctagtaggattattggactcgatacggaggcgtgttaggagcactgatcagtgccccatctccgacttggagttggaggcgctcaaggcagcggcggcatgtggctctgccgccggcttgagggcggtggcaaccatggccgcgcgacgagaggaatttacggtcgttgagaaagtatctagaggaatatggtcgttgagaaagtatcttgcggtacttaaattttacattaaaatttttgatatcttgaggtatctaataatatctaaagacatcaaattttacactagaaaatatggaaccttaatatactttcttattttgaagcccctaaaagtagattgaggctatccccattttctaacactactacaaaacatcaaataggtgtcaccactataggtgccggtaaccttttctcacctccgcggattgaaatcgtaaaaaaccgatatctttaaataattataggtatcagttctaaataaaaaccgacacatattatattttgtgttagtttttttaataaaaccgacacccataatatattaaaggtgccgttttttttaaaactgacaccctaccaaacgagccgagccgagggacagccatatccactagccgagtgagggagcaaccttatcctctcacccgtgaggccgtgacctctctctttctctcacgctctccattctctctcggcctctctctctctgcgctttcgagggaggcgccaggcggtgcctgcggcggcgggaggagaggcggcagcggcgggtggcgacgggaagagagacggcagcgacggaaggagtgcagcaacggcgggcggcgccctcccctccgccaggtctagcggcagaggaggttgcgtcggcggcccggcggtggaagtggatgcggcggcggcgggtcggtggcgggaggggaggcggcggtggtccgacggcccggtggcggcgccctcccctccaccagatctagcgggagggatggtggtggcggcggctcggtgttggctcagcggcggatggtggcaacagcggcttcctcggcagcggcagcatagtggcggcgccctcctcctctccatccagcaatggcggtggtgatgaaggcagcctcctcctcgatccgattcattattgatgaatgtgtgttcttgatgaatgtgtgactgtgttcatgaatgtgctcttgatgttgatgtgttgttcttgatgaaattttgggatttgggtgttagattggatcggcttgatggctcaatgcatgcattgagccgattttttttttggctcatgggcgcctcaaaggccaaaactggcacctttgaccttgggaaaaccggcaccgaagggggtttcccagccggcaccctttagagtttctgtagtagtgtaaggaccaagaaatgcctccaactccagcagcaacccctatttcttagtccatactcttggttatcttgtattttaaaatacaatccatatttacactacgtttaacaccacaataattcaaacataaatatttctaacgcatataatttaaccatacttaaattcacaatttcaaacaccacaattcaaattcaaaattaaaattttcaaacatgtaaatatggtgtgggcacagtgccatatacaacaacaacatgcacccaagattcataattcaccaatgaaaatgaaaattgctcatcaaaaatagactttgtgaatccaatgatcaattatataaattaaaaataacacatcctacaaccatgaatggttccattataaataacaaatctgaaagtaatataaattattgcggaaatatttaacaaaaaagggctccaaaggccaatcgtggtaatgacatatcctactagtaaaggacacatggatcatccaatagaaaccaatttattccatcgaagtgctcaaactctctccattaccgccaccaaactcacctccaaagccactactcccatcaaatccatcattgagggcagccacatttgaagctacaatatgtgccctcatagccaaggtggaaacatcaaaaaacatgatcttatgttgttgatcccacactaacttacgttcagcaaataggagcttgcgctcttgaatctccttagttttcttccatctctcttctttcaattttgcttctttctctttggcgtcaagcaaatctttcattgcctccctgtatggtccatcttctcctccattcttcaacttctcctttgcttgcttcctacatattggtctctttttagcactcgcctgtgataaatcaagatttgtactcttgctagcatcatctccttcttcattttcttcatcaactctctcaattggtgtcgaagacttcctagaccttggcttcttgtgggattctagtgtttgaaactttggagaattcctcaacttgaaccaacaatgattaaattgaaatgccctgttctttggtgcattgaaagagtacaatgcctcagcttcaagaacctacaacaaattcaagtgttagttctcatacatacaacatcgttattaacaataacgaataacaatttaacatacaagctcttgatgttatatgccacttggatgtcgatgctcaatttgattgtagcagccctaaaacttgcttacttccttctgaatgttaccccaacggtgctcaagagagtttgcattcctatcagactctgtcgaggagtgatcctctctagcgggaggttgtgatgtcacaccctgaagttctcctcccaatcctaaaatttaatttataaatgaccctaagaaaataccggtgcaaatcaagagaaaaccctaagaaagtaatacaaataataatcgaatctggcatgtggaatttttcttgagttctacatgtcgaaattcactaacaagatttttagtggaattttcagagccctagaaataattttaaccaattaaaattgagcaagcaatattttaattccagggaaaatccttttcttcctttttctttttctttttccccctttttcttttcgagtgggccgccggcccattctccttcctcctctcccctccgctgggccggccgtaggccgaggcccagccaggccaccccgtctccctcctcccacccgggacaccgacaggtgggccccacctgtcgggcccgtctcctacctcgcgcccgtgccgccgcgcccacaaccgctgccgcgcccacgcctccgcctcctccgggccacgtcggtcacgcccgcgcatgcgccgtacctcccgcgcccactcccctctctctcccgcccgcgcccgcgcccgagatggccaggattcgattttcgaatcccgcctctctctctctcctctcccactcccccacgttggccggcggaatctcgcccctaccggccacgtccgggactcccctcccctatttaagctcagccgtcgccccctctctctttttccccatttcgccgaactccctcgtgctccccatcgctcccgcgccgtgcacccacccgccgccgcctttcccgccgctccggccgccgctagccgcccctaggctcgccgccgcaccgcgccgacgccgccgtcaggtttgcaaggacgaactccaccccgtccgcccttcctccgtcgggattcgtcgccggaattcgcatcccctcgcgctccgatgagttctacctctacaaacgccttcggccatggatgccggccgccgtggttcatctccctctctctaatctctctctcctccttccttagggcaccccgaagcccgtccgccggttgccgtcgtccccccgtggcttgccgtcgccgtttgccgtcgtcttcctccgcgccggccaccctcggtgaggcgtcctctcccctctactcccctccctctccttcctagccgccgcttagcaccgccgccttcacgtcgcctttgtgccgccgcctccgccgccggttgctgtcgccggcaacgcgtgcgcgcgcgccgtcgccatcgccgtggccggtcggccggccttgagccgagccgagccgggtcaccgccgcccgtccgatcaaccccggggacgatctgggccgtcggtcccgtggaccggcggtggaccacctgcgtggtcccagtccacggtggaccgcccccccttgagccgcagacgagtggggcccgcgtgccggcaccccttttccctctcccccgagccgctgaccggtggggccagcatgtcggcgccgcgcccccccccccccttgatgacgtcagccctgggaattattgcgcaataaattatttaaggactttttgttatagtaataaacacagtgaatcttctaaaattcataactaattcatccgagctccgtttaagcccattcaagtctcagtaaatcaagaaaaatgcgtagaatccattaaaaatggttttgttctctgtttgagtagtcttatagcctgtttgtattgtttgctttgtatgtcgcctagattccggttcttccgacgctccggtgtacttcgagatagtcgccaaggttcctccagcagcagagcaaggcaagtcatgcctgtcacttgaacatgttgatcctatattgcaaatgctctattgtttttcttcaaatactgcatcgttttataatattactatggggtgtttacctattgttacagccatgccatttttgataccatgctcctttgttagcttgggttataacatgaatagacgttggactaggagttgtttagccatgcttagttcaactagcacacaatggggaaatcccatttaaaatatagactgtaggttcatatgataatgttggtttagtaccaccgctttgatgttggttaattaaaatgaatcacggtgggctgtgggtgcatggttttgttggtcgcacccatggcagttaaggaccagttcgcgggatgccctggaagaacttatcgtacttaccacaagccagcgtgggcaacggctgggcttgcagtgtagcttttctctagccgacgcatccaggcaagggtgggcgtgatggagtttggatgggccctacgacggcctatgtggcttccggattcacctaggcacgagaggggactgcccgctgccttgcgaggagtggggtgaaacctgaggtgtggtgtgcttggttagagggggttatgcgaagggtcctgtcacggcttcttttcggtatgtcgtggtggcatgtcggcgcacggaaacgtgtcgtgaggctgtgtcttgtgggtacagttgtacacctctgatcagagtaaaactattcgaatagccatgcccgcggttatgggcggtcaaccagattcaccgtgattagtttcaccctagtttagtctaatgaaattggatagtataggtggatggttgggcctattgcaacgtgggatagcgttggacagcggatgatcaatattaattaattattgcaactgtttaattctttcaacttctgtttataaatgctcactttatgcaaatgaaccactctagctctcctttgataattccctgcatcatacccctattctggtatgacttgctgagtacagtgggtagtactcagtcttgctctattttccccaaccccagagtacgagtatgtgtccgatggcgggttctccgaggagtaggcttcgtccgtgccgtcgagggtgcctgtggagtggtgttcccactgcagttcaagtccaggcttagccccagttatcttttgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcaaagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaacaagtcagtctagggttttagtaaaattattgagatttattcgtcagtcagttgggatttgatgggtgaaatgcattaggtcctagctcaggaatatgggttgcaaggtacttatgctcttattgttattattagtatgtatctaatttccccattattttatcgttatgtaagtctgtcttatttattcgctctcatgcaaaatgatctatgcataaaatttcgctcttattcgattctcttatttgagtcctttattgctttatttaaaattggttttgagcatgcattgatcctactcctttgtcttctctagatggccggccacccacccaaccaccgcggagaaggtatgattgactttgtggcagagttagcacgtatgacgctggtggtgggctaccccaacgcgccagagtacacgacggttccaccgctcagtggcgagcttcctcaccgtgtccgcctggaggtctatggctatgtgggcacctgcctcgctaatatggtggttgaggcgtccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacttcaccacctttggtcacatgtgcgttgtgatgagggggatggacaggatgcactcggacctgcacaaggcgtccaaggccttgaatgatgggaagctcatgaggatcatcgctctgaaggacgagatagcgcgcctgaagagggagaatgctcagttaaagggtcttcccgcgccaggaggagtccggatccgcactacgccccgcaagtcgacaacggcacccgtgcgcatccagcttgcgcccaggaacccacctccatcagcagctccggcagcacctccagttccgcccgcagctccagcagttcctgcagctccagctctagctcctgttcccgtgtcagctcctgcatccgctctctccttcgcgcctgcatcagccgtcagggtcccctctagtggcaatggaggttggttaccagctactcccagtggcagtcgcgacctcagcagcagcagctccagtggctcagagccgggcagcggcgagacttatctgccaggctccaggagtcgctcagagggacctggtgacgagcaggaggacgccttcgactccaccgaccgcaggagccgttccgagcattaggctcattttccattagtttatcgactgtctagcatttgtttgttagtttgtgtgtttaggttgcttgcttgtgggtcagtcgacggtcgatatcatgtgcctatgatatgactgtcttaataaggattttttcttgctttttaagtgttttaattcagatcagaacaattgtagtttaaattcctatataataaagcttagttcttgagcatctgtttttcttcttttccccgtctgctcttcctccagatggtctacaccaggaatggtagccgtacaacaggcgagggcagcaacggcgaagagcgcactgatggtgtgcatcccaacagcgattccggcaatggtccgccaccacttcccgagaatccgacgctagcccaagtgatggcacatcagactcagatgatggcagccatgatgcagcagatgcagcagcagcaccagcagatgcaccagaggatgctgcaacacgccgaacagcagcaccagtagtttggtccccctccccctcagtccaagttgccagagtttctacgtgtcaggccacccactttctccagcaccaccaaccccatggaggcgaatgactggctccatgacatagagaagaaactgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaggcgcaggtgccagacggggtcgtggcacaaaagaagagggaatttcgggcactccatcagggcaacaggactgtgacagagtatctccatgagttcaatcgcctcgcgcgatatgcaccagaggatgtccgcaccgacgccgagaagcagaaaaagttcatggcaggtctggatgacgagctgaccaaccaactgatatctggggactacgcggattttgaaaggctggtggacaaggcaatccgtcaggaggatcagcgaaacaaaatggataggaagagaaaggcggcacagttccggtccaaccaaggaaaccatcagcgaccgcgcttcgctcccgggcagcagggtggacctaccaccatgatcgtccgccagtaccgcccgttcaaccctagcaacttccaccagggcgccagtggcagtcagaaccaccatggaggtcagcccaaccgcggtgcagctccacgcctaccagtggcaccggcacagtcaggcccgtccgcgcaagccaagaaggagactggaacaaaaccagggtcctgcttcaactgtggcgagcttggccacttcgctgacaaatgcccaaagcccaggtgtgccgggccaaggtttgtccaggctcgtgtcagccacgcgtctgcagaggaggcgcaagcagcaccagaggtcgtactgggtacatttcctgttaactcaatccctgcaacagtactttttgattctggtgcaacgcattctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaacctcattcttcttgaatccaaagacctagatgtcattcttgggatggattggctgaccaagttcaagggagtcattaattgtgcgaatcgcatagtcaccttgaccaacgagaagggagaaaccgcagtgtacaaatcactagtctcaccaaagcaaggggtcgccttgaatcagatggaggcggaaatcccagtggtcaccgaggagaagaatccgaggaaattggaagagattcccatagtttgcgagtacccagaagtctttcccgaagacctcactaccatgccacccaagcgagagattgaattccgaattgatttggcaccgggaaccgcgccaatttacaagagaccgtacaggatggcggccaacgagctagcagaggtcaagaagcaagttgatgagcagctgcagaaagggtacattcgaccaagtacttcaccttggggtgctccggtcatttttgtggagaaaaaggataagacaaagaggatgtgcgttgattatcgcgcactcaatgaggtcacaatcaagaataaatatcctttaccgcggatcgatgatttgtttgatcaactgaagggagctaaggtgttctctaagatagacatgagatcaggctatcaccagttgagaattcgggaagaggatatttcaaagacggccttcaccactcggtacgggctatatgagtgcacggttatgtctttcggacttaccaacgcacccgcattcttcatgaatttaatgaacaaagtgttcatggaatttctggacaagtttgttgtggtattcatcgacgacatacttatctatccaaagtctgaagaagaacatgagcagcatctccatttggtactcgagaagttgaaggagcaccagttatacgccaagttcagcaagtgtgatttttggttgacggaagtcaaatttctgggccatgttattacagctcaagttcagcaagtgtgatttttggttgacggaagtcaaatttctgggccatgttatgtcgcaaccgagaaaaatacattttcccgaacgctagtgtattaatccccgtcccaggaaaagccggggtacaccacacaaacatgatataaaagacacatctttattatatcgataatatttacattattataaaggcacttaaggcctaacaatcaaaaataaacagcagcggactagcgggcctacggctccatcttcacaggcgctcaactggggtataagccaggactccacctaagacttcttctccaaagcttctcttactgaaggggggggtgaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccaacccaaccccacctacggccggaacctccgggacaggcaggcaggattgagcccctagcagcaggacaccagccctgtgccatgacatctcgactaccgggccacagctcgtgtagccttcatttgtcctagagatgtccatcgacccccgacttcgtccatcttcatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggagatgtgtgtccaattccaacataagccaaacattccatagtgtccaaatgatatgagaattcccaaagtctaaagttataaaaccacctaatgttgcctaattaatcagcgaagcatctacctaaattcatactagtggaaccatgaatagagtacccactagttggggtgttttttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagagaacggccttccgaaccttcggcgacgaccgcgaaccacgcttcgggaacctctggaacgacagaagctacgcgaagcacacaagcaaagctacaagcctataaagaagcaataacaatacataaaaacaaagcacagggttctttaggttataacaaacattaggagacttgaacggatcgattcggagctcgtatgaccaagacatggtcatccgaagtttaatgctgttatatggagatttgcggattattataattaggttttgcaactataaaacatgtgtaagcgctagcctggaaaagacaggaaggctgcgctgttgacatgcggaccccacatgtcaacctaagggaccacggcagaccgggtacacagagacggtccacgggtcgatggaagcggatcccgtgtgtcaaccgaggcgagtggccgataaacggactccactagacaccgcgcgggctgcacacgtggaaaccacgtggctaccgagcgtgcacactaacacggtcaccacacgcacaagcgaacgactaccgacaccggtacacgggtaccggggtcga

SEQ ID NO: 80276 - DNA, 16462 bp, Oryza sativa
cgatgaccggggccggcgaggaggcgacgagggacagctagcagcagctgcacggagacgaggacggcgtggaacacgccgctgcgaatccgacaacggaggcggcgcagcgagacgacgagccggcgaggaggaacgaccgaccggaggagtcgtcgacgaggacgaacggagacgacgataacgaacactggcggggttcggatggaggggaggcgaggccgagggcgaccttgccgctgcgatgccggaggtggagacggcgacgtcggccggcgcactggcacggcggacggggctgccggaggaactccggtgaggcggagggcgagaccgacgcgggcgacggcgttccggtgaaaccgagggcaggccggggtggaggtcgacgcggcgacgccgagggaggagacggcgcagccggcccgcacctgagcggcgcggcaggggcggctggaggcagtacagtggcggcaacgccactgttttgccggcgaggacacgtctccggtgatttccccgcgaaacggagggctgaccgggggagagaaggcggctgcgaggccgagggcggcgacggcgcgaccggacggcgctcgggcgaggagggagaggcggctggaggccggctggcgccggagagagagaaggagaaggcggggagaggtgatacgaccacggggaggctcgggaaggggctaaaacgatagaacgaaggatggggattccattttataggcgtggggagggatccggccacgggaggagccgggaacggcggcggaaaagccggccggcggccatggaaggtggccggagttggcgcgtccgttcccggcgattgggggcgccattcaagggggaattaagggggaaagagagaggagggaaaggggattaattccccctaataaattttggaattcccggtttgaatcacgtggattttggggaggtttggcgctaggtttccggggagagagagagcaggccgtgcgggaggaggaagacgaccgcacgtgctgcgcgcgtgcgaggagcggctcggcgtgggccaggtggctgggtggcgcggcttgggccgggcgggaaggagggaggggaggggcggcccagaaggaggaggagaggagggagtgggccgggaggggaagaggaggcccaagagaaggagagggagagaaagagagggaggagagagggacttcggccgcgggccgagagggagaggggagaaaccttgggccagacttggcccaaagggaaggagagggttatttttaggtttttctttttaataaactctgataattgttgttgttgtttaataaatatttttggtgctctgaaaattcaagtaaaatttgagggctccttttagaccaaggataatttaacaaaaattctccggaccacattcaaatttttctggcacgtattttagtgtttgtcaatttcttttcgaattttaattaattctattattccttttagaaaatgatttttattttgggatgaatttatcaggacgtgacatgttattacagctcagggtgtggcagttgatccatcgaacgtggagtcagttaccaaatggaccccaccgaagaccgtgtcacagattcgaagttttcttggacttgtaggttattaccgccgattcatcgaaaacttctccaggatcgcccgacccatgactcaattgcttaagaaagatgagaagtttaaatggacagctgagtgcgacaagagttttgaggagctcaaaaagaaattagtatccgcaccagttttgattctgcccgaccagatgaaagacttccaagtctattgcgatgcatcccgccacggacttggatgtgtcctaatgcaagagggcagagtggttgcgtatgcctcgcgacagttgcgtccacacgaagggaattatccaactcatgacctggaattggcagcagtggttcatgctttgaagatccggaggcactatctgattggcaaccgctgcgaagtatatatggaccataagagtctgaaatacatcttcacccaaccggacctaaatctccgacaacgaagatggttggaattaatcaaagactatgatatgagcattcactaccacccggagaaagccaatgtggtagcagacgcattaagcaggaagagttactgcactgccctaggcatcgagggcatgtgtgaggaattgcggcaggagcttgagcgtctcaacgtgggaattgttgaacacggattcgtagccgctctggaagcacggcctacgctcgcggatcaagtcagagcggctcaagtaaatgatcctgaaatagcagagctgaaaaagaatatgagagtcagaaaagcccgggattttcatgaagatgaacacggcacaatttggttgggagaaagattgtgtgtacctgacgacaaggaactgaaagatctgatactcaccgaggctcatcagactcagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagtaggtttactccaacctcttcaaatcccggaatggaaatgggaggagattggaatggactttataacaggactgccccggacatcatcgggtcacgattcaatctctgtcgtgaatgttaccccaacggtgctcaagagagtttgcattcctatcagactctgtcgaggagtgatcctctctagcgggaggttgtgagacccccctttgtgagttcggccgggggataaggcgcgatgatcaagagtgtatctccgccagggatctggctaacgagattgctcacaagcgagtgagagacaagggattatacaggttcgggccgctaggaagcgtaataccctactcctgtgtgtggaattaagcttgtgctgttataagggagttctaaccctaggctcaagcttctcaagtggcgtccctcctttcggtgggcaaggtcctccttttatagttcaaggggataccacatgcaccgtcttacacagttcatcattggatgggggcccacatgtcctgggtcgagctgtcgtccatgccttcgtctggaagcaaggcggtcgtttgcccccaggtggatcccaacgccgtcctccggctgacacgggggacatccctgtcattccctcttaattccatggagacttttgtggactcatgtacggggaggcacgctcggctacatgccgatgggacggggcatacccgcccccactccgcctgacagagggcagaacgtgggtgcgctaccacccgtcccatacgcctgtgaccggtcacagaccggtcaagctcgattgacgcacgtcaatcgagcggcgcctcacgtccgcccacgccacattaactttggcgggggacaattggggcgctactcatttaaggcgcttggcagcgcctctccctccgcccactcgaccgccacgtggcagccgagcgagcgcctcggggcagcgtgctccaagggcctgaggggtgcgacagggcaccccgaggtcccttggccgcttcatgaccgctcgttctcccccgaggtggggaggggggagggacaggccgcgcggccacgtggccagacgggaagatcctttccctctatcttgcgtacccccgggcccatattaccgacagactcataatcacggttagcatggcagtgctctgtgatcctcttcaaatatgccttccctggttgctcattgccaataataggatctgagctaatgctctgccatgaaatgcacaattgaatgtcctccttacaagtatagttgcttgattttttagtacttccttttgcaccatttgttgaagtacgaaggtctacatttggcattggcacttcgacatcagtgtcctcgaacatcatgtgcacaaagggatcacctctacttgtcattgcaatctagtcactgcaataaatatataaattgacaacctttccaatcgatctcagaaacatcaacaaatgattgtaatgtacattaggttatactgtttataacatgtatttgtttagcatatatattggttctacattactaaggactcagtacaaacacaaatttctctcttcaatattatatatgctctgcaagattagctctctgacatagaaaatgcaataaaaaaaagctataagacaccgcatataaaacatgaatgatagacaatgttttgccgtgcgaatgattttgatgggcctaggcacctagtaagtcttagattcagtttcaatcaaaatttcaatagctacaagacactgcatataaaacacaaaacatgtgcatacttttgtaaacacaaattctttgttcaaagtttgcactctttctattaaccaaaatttaagtccatacttgatttgcatattgctcaaacaaatatgaaaacaaggtacatcgatttgcactattgaattcctattaactatgctatagcttatattcagaatttagatggattgcaagaaacagtgatattgtccttaaagttgtaaaaatcattcagatttccaagttcagataacgcaaactgagcaggctatattatgttaatcacaatcaataaatgaactgtacttcatttgataattaccagtaataatttccaagtacagtgatgaagaacaaaatgataattaccagtgataatttccgcgactgagccctcaggactagggactcgagaagatgatttgggtgccttcctatgttggccctttagtagggcatctcagtttttcgcctcaactctcaaaaatcatttgatgctcttaaggatgtaaaaattacccgcgcgacgaataaatgcagcacgcgttggtgcaaacgtggatctcgagaatccggacatacccgaggtatttatgaatccaggaatctgctattccagtgttaagtcttgcatccctgatgtattcgaagtccatgaatacgcatttgtagtgtctaaatcgatcttgtgcatgaatataagtttctcattcatttaattttttttactgacctcacctccaaacatatttaattttggtcaattacagcaagtatttaaacgtaagccccaatagtactatgtagaattaatttgttaagataatgttaacttttgaaaacactaaatgtagtcgattggatgccaaatgaataaaacaaatagttatactcccttcggttttaatagatgataccattgatttttaatacatgtttgagcatttaccttgtcaaaaaatttgtgtaagtatgaaaaacatgaaacttctgattaaagtacatttaatggtaaaccaaaccacaataaaataaatggtagattttcttttgaatgagactaatggtcaaacatatttcaaaatgttaatggcaccatctattaaaaactgaagagagtattatattggggctagtgtattatggaaaatgtattagtgtagttatatttttatttatgaatagatggtgtagataaaattagaggtagcaactatctctactagtattaaatatgcttttgtgattctgccatgggcatgaaagtagataaaaaaaaccttttagggtgctttttttagataatagaatgaagcattccggcctttactcaagaggtagcttatctaaagtggatctggaagagtagctgtactatgaaagtaaaagtttttggctagcttctgctcattgatagattgaatactcgtgatatgcttgacagaaaattttgtaccccggaaggaagtgatttaacatgtgttttatgctcgacaggggaaagagagactcttcatcatcttttcttttcctgttcattcagtactgaatgttgggctcaatttggcattgtttggaatctctccctgtcttttgaaaatatgttgacacatgctaagaattcctatcaatcctcacacttcctggagaaggttctttatgtagcatggaatatttggaagcaacgcaatagtttcatttttttataatgttcaaccctctgtagcttcctggatgacattcttcaagaatgatctatcccttcttgtttatcatttaagattagatgagatatcagctttctgttcctggataaatcacttgtattttctgtatatattttccttaataaaattatttaactgtgggggcttcccctacagtgctttcctaaaaaaggcttgttgagatcgttgcataaatctatcatatcgatatttgttaatgctaaattttggtgctacaaagttctaacagggttggatgtatttggtttgaaaccttaacaaatgttggtagtgtttttaagagctttacccggatggacacacgacggatggcgccgggtcggtgtgggagtagctggtggagtatcctgtgatcagcgccgtgattgtacaatatatgcatattgtaccggaccgggtcctatacatactacttcctttcctttcatagttgagttatttttaaacagagaatacgtacacatgctagaattgaataatccactcgaaatcctttgacccccgaaagaaataccaataattattacttaaaagtaaacttgttttagaataacaagataaaaaatgattatccttgcaaaaagaaatagttacatatctcaggtcatctacaatagtcatattcgtcgctgaaacgacaattaattaattaactaatagtaggaataagcaagggatcaaggtcatgttccttttcatcgatgcataagcacttgtctccgtacctgaagtggataatcatttttggtaaaatttgctacaggacatccaaaaaagtgtaattagcttgaggatatcgtaaaaacgtgtatttgctttagggcatcgaaaaaattagtaattggctgctggacacccacgacattattttattatttttttaaggattaggaaagagaaacaatgattaaagacaagattgcccctttggctcaaatgactctgggccccacatgtaaccctctctctctccttctttctagacgggccaggtggcagagcagcgatccgcggccgcggcgctggccgcgttcgccgggtggggggttggggtgggtacgtgcagcctctttcccctccgacattggcggcggcggcgacaacgacgacgacggcgacgggagcgggtaggtgtagtagaggaccatggccgagttccggcagcgcggccaggtcccggaggatatggacaagtccatcggcaccgtcctctcctacatccacttcgccatccccgatgtgccggtctccggcccgcctctccgcgctcttgcccgacgacggcgtcgaccgcctcagcctcctccccgacgtgctctccgccggatcgtctcctgcctccccgtcaaggacgccgcacgcactgccgcgctctccacccgctggcgcaaggtttggcgctccacctcgctcgtccttgtcgacgccgaacaccttcccgtcggcatgtccgactccgatacctgcgccgcgcgcgaggatgcccacgccgtcacctcacctccagcttcatggaccagtaccagggcctgctcgtgagctcgttccaggtcctcgccgtcaagggcatccaggagctcatcctcgtcaatcgcccgttcccacccgttcctggctccaggtccacgtcccagctccgctctggccgccgcgtccggtacagcttcgtcccgcctctcgaaccggcacttctcgacggcgcgctcgactactccatggacggcgctcggggacgaagagaagaaagaagaaagagcaaagagagaagagagaaagaatgagggaagcataaggaagaataaagaaaaagaaaaaaaattcgaagggtagaatagtagtttctctctccaattccatcagatataataaaataatcctgcgggtgtcccgtacttaattagcagttttttggtgccctataacatacacgcgtttttacggtgtcccctaactaattacatgtttttttttatatcttgtagcaaattttaccttataataaacacacatgtcatccgcacgcctgacctttcatcagcaatactttcctcaggagaagggtgcaccgtgagatagatcgctatgctcaaattgattaccatcatggtgaacatgcagacctgcacacagtacatatatataatcaatcacaatattgaacgtagtctcagtcgatgcatatttatatagagaggtagactacctctgttttctgttgatttttaaaataatctttaaccatgcatattattaaaaaatattaatatgttaaatataagtcctacttaaattctttttaatgataaaacatgtcacaataaaataaataacatttatgtatattttaaaaggatgaatggtcaaatattatgtaaaaattcaactacgtcttctactaaaaattgagagtattaatttgattatgaagtaaattacacttgtggtttataaacttgtgagttgagtgtaatttaatacataaagttttaaatcgcttatttcggtgtataaacttatctagtgtgtgcaaatcaaagccaaaaaaacatgtcgtaactaattttactaagttgaacattgactaagatgttatgttagctgacatgtcaagatgatattatctaaatatgcatatgtttaattaaacataaaataagtaatgtcaattatacatatttttaatacatataaagggagtatgcaatggataaaaaataatataagaacaaaataactatgcatggaatgtataaaggttaattatttgcacataatatatatatatatatatatatatatatatatatatatatgtacatatatatatatgtatgtatatatatatatatatgtatatgatgcctcttgtgtgtgcgtgacattttataacgagactaactcaacatcatttggattagtttgcactccctacacaaatttatgtaacgagtattttacaaatttgtatactaatttgcactcacctaaaaagtttatatatcactaatgtaatttactcttgatcattgtataatcatagagaaaaaaaagtgtctgcgttcataaagagttcatggtatatagggaaaaaaatgatggcatgtgtatatacctgaaatacgaaaaggagggtgcgattattggtggcctcgtcccttggaggaggccgaggtcgtcgtcgttggactgctgccccgtgaaacgccggcggcgggagcggcaggatgcgaggagggacgagggccggctgcgctcgcggcggcggcggcggcggcggagcgaggtcgtcgacgacgtggatgatgaactcaggcgggtggtcgtcggaatccatggccaccaccgtgccagagcaaaaaggacgtaagatgaatagatagattataccagcacacgattaaaaagggataattataatctagtatacgtacgtgaatcctaataggatcagtagaaagagaaattcggaaaaaaaaatatcgaaagcgattcggaatccctttcgattaatactacagtaatgaacccactagcaaaaatattggtgaattaaaattaaccgcaaaagaaattagctatacgccaagctatttcctggaaataaatgaagagatccatattgcttcgcggttgggagggccaaaaatgacatgttaccttgatggtgtagatcatattaagttggtggttttatgatttcttagagctatgaaaagctaataacgaccgtaattttcttatcggacggactgctaaaaaaattcggtgttaaccgtcaatgaaaaggaatttccctcccgcgcacgcagaaaacagagcgacacattttcttatgattaattaagtatttaatttatttaaaaatggattaatatgatttttaaaagtaacttttgtatagaatttttttaaaaaaacacaccgtttaaccgtttgaaaaacgtgcgcgcgaaaaacgagaaatgtgagttggaaaagcatggagaaaaacacactcgtatagtagctggtggcgtctcctgtgattaataggcatatgtacattacagatatgcacgttcgtttgctcacgaccacgatagttacgtgccgtggtgacgtagtattgtaccggggcgggtcctatacatactactctttcctttaattgagttattttataacaaagagaatacatgcacatattagaattgaataatccactcaaaatcctttggcgccggaaccccggagcagtggcggatctaggaagggatagcaggggttctaaataaactagacaaagccacatacgatctttccatctacatgtagcaaaaaattttagcaagagttttgtgggggctcccatagtattcatgccagtagtgaggcctcgagaccccgctgcccctatgctagattcgcctctgctcggaaaaaaatgccagattgcttaaaaataaacttgttttgaataagaagataattgcacaaagaaatagtgacatatatctttaggtcatttacgatagtcatcttctaaaacaacaattaattaagagatttgctccggtccaataaaaatacctcgaggtaccggtacctcacggtattaaatcatttcttatcgttagatctaacaatacgcattctgtccaactagattcaacgatcggaaatgatttgacaccatgaggtatcggtaccccgaagtatttttattagaccagagcaaatctcttacagcataataataagcaaattattaagaggcaaagggtgctgatgagcttgtgtatgggcttcagggcccatcagcgactgccgtgccacctatcttgtgtgtttgatcgtagtaatatcgtacgtgaaaatcgtacgtgaagcattttcctttccgattatcagacggtgatcataaacgagcttaattatgagggcaagactaattaagtttttaatgttggacggttgcaaaatagatttttagaaacaaaattttctttaaaaagttttccaaaaaatcgctctgttcagttgagaaacgtgtccgtgataattcagaggagtggctaatccaactttcacttaagaacagtaccaaaagaatatccaagtttcagtggattccacatggatgcttggagtcactggatgacacaagaatcattcctttgaactttggcatatcatgatttgttttttgggagggttggcatatcatgattgatctgatggaccaacaaaaccaggattacagttaatcttccaggaacactgtactgtagtaagtagcaaccccttaattactcccttctcttgatcttgggtgattggtctcctctcaaatggccgagacagaaccaacataattttaccttcttcaaaatttgctcgagctacagcaattttactaggatttgtctgatcatatgaaggccaaagcctctgctcgccactgctcctctgtttatataaatatttcttttgcatgcatgacgcctacaagctacgcaaatcattttagtggctctcaatgcatcttctcgggcagttctttgccttgtttttttcctctgcgtttaatatattttttttgtcttctactcaactttaagttgttaataactagtttttcatatatgtgtccctatcaaagaaagcaatggctaggccctatcttaaaaaaaaaaacaatggttggttggattgtgctccggggtccctggaatatgcccaagaaaacagctgggtatcaaaagcagctggtctgattgctactataatattgatttattgaagctcaagtctgtgaaaaaaataatttattcaggagaattagtactttttcgtgaaaacggcctccagaaaattgaccattttaatttgcctcctgccggagtaaccaaaatgggaacttatcatgtacacaagtttcgggtacactcatcgtctacatcacctaacaagtatcgttgaaaaatctagaaaaactatatatatgatttcagtagtatttcacctatgtgtaaaaacgtcattttcgaagtcatcattcatagagaaaaatacaaaattctgagatttatacacataaaactgccggatattttttttatttttttgttaaagctaaaaaaaatatattattttaaaaagataggtgtaacactatactgaaagttgaaagtacatacacaattgttttagagtattcggtggcattattagcaagtactatttaattaccgataaatattccatagctcgaggaaatatataatacaaacctagaactaccatatgataaaaatagataattgagattcatccacgtcacctcaagtaaaattttactcggagtaatgttgacgagtttcaaatgtctattttcatttttcaatcaaacggtagttttttatttttcgatcatacggtagtttttaagttcgcactagatagataagtccccttttaaaacgcaagattattaaaaaaaaacgtcacggcgcttgctcttgaggcactcacatgtaaggccggtcacgtatgcatgcccatcttccatgttgactcttacatttaatccacgtcagcagacggatataagcacagtagaaggcaaattaattaacatttagtttggccataggttaatgaacattgtgcaaatggcaggcctgtctctttctcttaatcttgtggcgttcgtcgacgcatggtatagctagctactccctccgttttaccatgtaagttattttagcattttctatattcattaacattaatataaatatcggaaatgttagaatgatttacattgtaaaacggaggaagtaatagcgaacgtacaccaatcaaagacatttaaactaatttggatcatcactattttttaaagaatgctagttaatttaatttggagaattggagatgtcattgcgccaaaattaaaatatactatatatatatatatatatatatatgccgtatacatatattcaacgttcataactaagcccggtctttcttgtggtataatccaagcaaagtcgtcgtccctgcatgcgcatggacgcacaaacgtacgtatacgtgtttgaccgcttgattgatactacagttgtattgtgcacgagagttctcgcagactttttatgaacatgactttttctgtaattaattaatgttgtatgtactctcaggcacagtcaaactttacaagctattaaacacatgattttttttatatgctccctccgttctataaaaaactaacttctaactttaaatttagaagtaacctatgttcaggcggataattagaagttgattttttttctgggatagaggggtacatttttagaatcgagataggttaaatttagcaaaatctcaaacgggtttgaatagctagagatctagtagtgaaaaagctgaatacctctgaactattgcaaacggattcagaaatcagacattcgacgtcctccaatttaattttcatgccgcatccccctccaatttttccaattacctctaaagttgcatcctttaaaaaccatgacaacgtccacatcaacatcatccgtcttagaaataaataatttatagagatttgaatctggacatttctgggacggagagggagtatctgtgatgtctcgcagctacatttctagtctcgtgtacttacatcgttattactttgaagtaattggcatgcaatgacaagctagaaagctactctgatccatgcataagatgcgattagactccatatatacagtctggccatgtgcactaattaactaacttgatttggatcgacgaccctgaaatggagctctctactgacccaggaaatccattaaccaagacctgaaaaactgaaaccaaagctaaaccacacacacatatgcatatgcacccagctcttggttgtgttaattagtaattacgatatgattggtctatgtacctatactaaactattggaggtcgctgtaattaacacgtgtttagctaaaaataacccttggcatcttcctctgtttcttgttggattctgtcatggtctcatggccagtctggccattcaggatgcagattcagatttaggatgactttgatcagttcaagagagatagataaaatgatttaggacaactcaaatgacaaaggagaaacttatccgatcctcaaatgtccttccatatgcaacctggactattcgagggatgtcatagctagaagataatcaaattaaatcagaatcagcacacttagtttcttgtgaggttacctggaacacacatggtctttccagacttaatttgttatcaaattaatctttactagcatatagtagtcaccaaaataaaactttaacgactaataattttcattgctacacataccataaaatatagtcaatcctatattcctagtagtaaataaataaaacattgtaatatcaagtactatgtccatccgaaaaagatcacttctataaacaaccatttgtctagattcatgtaaaaaaaaaattagagagagaggtactagtagttttcgtgtaaaaaatatagtaaatttcacaaaactacaagtattttacataatttatcataaaactgtagatttagtgtctccgtttatcacaaaattataggtactttgtacaatctatcataaaactatagatttaataacttatttcataaaactatatatttagtgtattcgtttatcagaactacatatttagtgtcttcatttatcacaaaactataggtttagtgtcttcattatcacaaaactataaattttgtcttcctgtagttttgtgatacaaaacctgtagtttgtgataatgaagatactaaacatgtagttttgtgataaatgatgatattaaatatatagttttgtgatatattgagcaaagcatctgtagttttgtgatgaatgaagactctgaatctgtagttttgtgaaataagttcttaaatctatagatttgtgatagattgtgtaaagtatacgtagttttataaaatttactcgaaaaattaattttttttctaacggagtagattttcatagagaactataggtagagcatatgtgagggaaagtatggagtgcaagaaatatactatatagtattctttattagaggagtgcaagaaatgcaaaaaatattttcgagagggaagtgaaataaatgttatttatttactacttgatattacaatgcaagaaatatactatacaaaaatgtatgcacatttttgtgtcttctagccgggcacgtgaggcccatcgttcacaaaaccgcaaatacaactactcccgagtatgttttcgcaaaaatgatgcaacgcaccaataatagcattccacgtggcacatcaacctccttttccctaccatttttttcagtttccgtttcccttttgaggacacgtacttcgcttgctcgcttctctctcctccggaaactcccctcacctcaccctctctctcctagtctagagagagaaaaacacacacgaggcacgcacgcgagcgagcgagaggagagagagagagaacgagaggcgggtggagagcttggaggcggttcgtcccttgcgctcgcggagcatattccccgcccggatcccctcccccccgcgagcatatacgtgccacagagagagagagggagggagagatggcgtaggacagcatgtgttcttgacgagagttcttcttggctgggtccaatcccaaggtgagtggtggatggattgtttgttgattcttgtttgagagtgaggatgattggaattgtttctaggggggtgattgtaggattggggttagggtggtggcagatccgttttgtttggttggatttttgctgcgtttggtcggtggaatggcggtttggactgtttggttgatccgatttgtgcggtattttgaggattaatttatttatggttggaaatgtgtgtttttcccgtccttgtttgtgcctgcttcatgattgattggttgcccctgttgcagattgatactaggtgttattcttaatcatgaattactattgtttatcagagcttctaaaatttctatggggtgagtggtttgatgaaaaggatttgggggagacgtctgataattcacaatttttatgaacaatagttggattcatttgtagtcgcacatatgaacaagggtgggtgcaagagaaaaatgtcagtgtcaatggaacttctatttctctatcaaagtttggtacatatttcatagttttgtttgggtaggtcaatttttggatt

SEQ ID NO: 80277 - DNA, 10637 bp, Oryza sativa
ctgtcgccgctgctcaagctcaagcacaagctcaggttgccgaaccacctcccctcgccgttcgccagcctcagccggcgatccagggacagccgccaaggcaaggccaagcccccatgacctggaggaagttcagaaccgaccgtgcgagcaaagctgtgatggctgtcgaagaggtgcaagccctccgcaaggagttcgacgcccagcaagcaagcaaccatcagcagccagtccgcaagaaggtccgaaaagacctctactgcgccttccacggacgctctttgcacaccatggagcaatgccgaaacattaggcaacgtggcaacgtgcaagatccaaggccacagcagggagcaactgtcgaagcacctcgtgaagcatttcaggagcaaacgcccctagccgaacaacgccaagacgcacagcgaagggtaatccaagtgattacaagggctgacccgccaagccagttgtccaaacgacagaagaagatgcagatccgaatggtccacagcatcacttcggcgggtgaaggggcgccgcaatacctgaaccagctaatttattttgggccggaagacgcagaaggagttatgttcccacatcaagatcctctggtgatctcagccgagatagctggcttcgaagtccgacgaatcctggtcgacggagggagttcggccgacgttatcttcgccgaagcatatgccaagatggggttgaccagccaagcccttaccccagcaccagcatcgctccgcggtttcggcggagaagcagttcaagttcttggccaagcactcttgttgatagcttttggctcgggggagaacagacgcgaagagcaagtactgttcgacgtcgtcgacatcccgtacaactacaacaccatcttcggccgtgcaaccctgaacatgttcgaagtcatttcccaccacaattatctcgagctcaagatgcccggcccgacaggagtgatagtggtcaaggggcttcagccttcagccgcttcaaaaggcgatctagccataatcaacagagcagtgcacaatgttgaggtcaaactgcatgaccggccgaagcacgcgcccaaacccacccctcacggcaagataataaaggtgcagattgatgatgccgtccccacaaagctcgtatcgctggggggcgacatgggcaaagaggaagttgagagcatcctaaaggtgcccaagaagaacattgatatcttcgcctggagccccgacgaggtgggaggtgtttcgatagttctcatcatgcatcatctggcagtcaagccggaggccaagccaagaaaacagaagttgcgcaagatgtccgccgatcgccaagaagcggcgaaagccgaagtccaaaaactgctcagggctggggttattcaagagatagaccatccggagtggctggcgaatccagtgctagtgcagaagtcaaacggcaaatggcgcatgtgtgtcgatttcacggacctaaacaaagcgtgtccgaaagacgatttccctttgccgcggatcgaccagctcgtggattcaacagctggatgcgagctcatgagtttcctgaatgcatattccggctaccaccagatccacatgaacccgctcgatatccccaaaacatccttcatcactccattcgacacattttgtcacctcaggatgcctttcggcctaaggaatgcaggagcaaccttcgccaggctagtgtacaaggtcctttgcaagcagttggggcggaatgtggaagcttatgtcgacgacattgtcgtaaaaatccgcaaggctttcgaccatgcgatcgacctgcaggagacattcgacaacttgcgcgcagcaggcataaaactgaatccggagaagtgcgttttcggcgttcgcgcaggcaagttgttgggcttccttgtttccgaaagaggcatcgaggcgaatcccgagaaaatcgatgccatccagcaaatgaagcctccgtcaagcgtacatgaagtacaaaagcttgcgggccgaatcgtggcactcagtcgattcctctcaagggcagccgaaagaggtttgcccttcttcaagaccctccggggcgcgggaaagtttaattggacaccagagtgccaagtagcgttcgatgagctaaagcaatacctgcaaagcccgccagctctgttaagcccacccccaggaagcgaactgctactatacttagcagcttcgccggtggcagtcagtgctgccctcgtccaagaaacaaagttcggacagaaaccggtctacttcgtctccgaagcactgcaaggagcgaagacaagatacattgaaatggaaaaactcgcttatgccctggtgatggcttcgcgcaagcttaagcactacttccaggcccacaaagtcatagtgccatcgcagtaccctttgggcgagatactcctaggcaaggaagtctctggccggctcagcaagtgggcggcagagctatccccgttcgacttgcattttgttgcacgcactgctatcaagtctcaagtgttagctgacttcgtagctgaatggacaccggtattggcctccgagcccgagcccgccgaacaattctaggtgatgtgctccgacggttcgtggtcgcacaggggagcaggcattgcggtagtcctcttttcgccgaatggtgtgccgattcggtacgctgcaaggctgtagttcgacacaacaaacaacgcagcagaatacgaagccattctcctgggcctaagaaaggcgaaagcacttggattccggcgcttgctaattcgaaccgactccaagttggtggcaggccatgttgacaaatccttcgaggcaaaagaagaagggatgaagaggtatctggaggccgttcggtccatggaaaaatgcttcaccggcataacggtcgaacacttacctagaggccagaacgaagaagcagacaccttggcgaaatccgctgcttatggtggcccacattcgcctggcatctttttcgaagtcctgcatgctccaagtgtgcccacggacagctcggagatcatggcaatcgaccaggtgaaactgggcgaagacccatatgactggcgaaccccgtttgtgaaacaccttgaaactggctggcttccggaagacgaagcagaagcaaagcgtttgcaactcagagccacgaagtataagatggtctcaggccagctttatcgctccggggtacttcaacccttacttcgttacatctcttttgccgaaggcgaggaaatggcaaaggagatacaccaggggctatgtggcgcacaccaggccgcaagaacagtggcctccaaagtgtttagacaagaagtttattggcccactgtgttgaaagtctgtgttgagcaaatcaagaagtgcgaaagttgccagcatcatggccgaagccaaaccgcaccccagtatgatctgcagcccattgcgccaatatggcccttcgccagatggggactagacatcatcgggccgttcccggtggcgcgaaatgggtataagttcgtaattgtggctgtggaatatttctctcgatggattgaagccgaacccctcggggcaattacttcggcagcagtacagaagtttgtatggaaaaacattgtttgccgttttggagtgccaaaagagttcatcactgacaacggcaagcagtttgactctaataagttcagagaaatgtgcgaagggcttaacctggaaatcaagttcgtgtcagtcgcgcacccgcagtcaaatggggcggccgaacgtacaaatggcaagatcctagaagcactaaagaaaaggctcgaggggccagcgaaaggcaaatggccagaggaaatgctatcggttctttgggcccttcggacgaaccccacaagaccaaccaagtttagcccgttcatgcttctttatggcgatgaggcaatgaccccagcagagctagggactaactcaccaagggtgatgttctctgggggcgaagaggggcgcgaagtatcgctcgaactcttggaaggggtaagagtcgaagcacttgagcacatgcacaagtatgccacaagcacttcggcaacttacaacaaaaaagttcgaccgacggagctgatgcctggtcatcttgtcctaaggaagaaagcgaacccgattgctgttggcaagcttgaatcaaagtgggaaggaccatacctcatcaagcacaagtccaggacgggatcttttcgattggcgacactagaaggtgacgagttcgaccattcctggaacgccgcctctctcgagcgcttctatgtctagaatgggtggcacccaaatcgccaacttgtaaaaatgtacatatcagccctttggcattatgcaagcccttcggcactatgtaagcctttcggcaagaaaaaaaaggaaaaaaaagaaaaagagaaaagaaactggatgtagggctattatccaccacagaggcccgaaccagtataaaacctctgtgtcctccgccttctttttatttttgtgtgattgataatttgtggaaaaaccccaaggcaaacgcctgatcagcgaaaaaggccaggggggaaaaaccccaagggttcgcctacccaccagtaatacagcgccacgtgtcgcaagggtaggcgaaatggtaaattcccaccaaccgagcagcacagtaaaaaaaaaaggcccatgaagggaaagcccaatactgtttctttcaacccgagaaaagtaaaaatatatatatatgtatatgccaccggccgcaggaggcgaagagcggcaaaataataccagtcgcacaaataacaaaccttattcgcaggaacaatgtaggtttcggcaggagcatcggtcgaaagggggcgccgcataccataccacatggtttgcacggtctcggccgaagctccaatctcaccctttcccgtgaggggcttgttggcggatagcatgaggcccttcgaccaaatctgccgaaacccgtggcgaagactatagagcaagaacggtgagaggcgaggggtcgtgcgagtaccttgtcaagccagaggtgtcccaggcgaagggtgcaaggcgaagagtatctgccgaaggaagacggcttcgccatggcaagttcgcccctgcgagggctgaagaagcctttccggcccatcaagcctaggggctatagggtcggcgatcgcccgacggcccatcaggggcccatgagcctccgtaacattatgtacccctgtaaattttcctttcgtaagggcaactatgtaaattcccccgtataacctaaaccctagtagtaagaatctgtaatagggctataaatagtccccctagggccatgtaatggggggatccaagtgaaaaattctaaatttaatacacttcgtttctttccaaccactgttgagtaaccacgtctttcgacgtatgcggttgtcgtttcgacaatacttactttcttaataaccgtgtccaactttaaaaatgcttatattctaggacagaggaactagttagtatatagactcacatcgaattgtatagggtgagatataaccaactaaaaaccgacttaaatacgaatgacgtacgaaaattctaaccaaaatatctttattttttataatactagaaaaaatacccgtgcgttgcaacgggtaaaaacatttttggattgctatacattatactctttgattttgggtcaaaaactcattttcttccttccttttcagtctcggtccagcccgctacctccctcctgcttgactgtttctcttttgacctagcccacaagtagaactataggcctagctcacatagtcggctgccatctgcttctctttgacctagcccacaagtagaactataacctagctcgcatagtcgactgtcatcttcaacctccgaaagacagtcccgtgtagtacgatgccagaaccgatactcccatcaaattcagtcgaatctttcgattgagggcttttgattcactcaatctccttatgtcgtttttatcaaaattggagtgaatccacaaaactgtgggatataaacagtgacttctaaataaagatggaatctggtgaattaaagcggaactgaaaagaaaaaaaatggggaaaatgatgatgtagtagagggcatttttttacaatcaaatagaggaggaaaagcactaggagattgatcaatgtggcggtggtgctaaggttcggcccgacgaaaaaaaacgagtagataaaaaagaatcctcaccatatacgcacacccttccgcataaaaaaaatatgaataaaaaatagagacgaaaagaaaatggatgaataaaagggaaaaaggcgatggcaaaataaccggaaagaacagtggataaaaaatacggatggaaaaaaaaaagacgaaaaaaaagaaaagcgaaaaaaaggaaaaaaggcagataaagagacgaactgataccaatccgtttttccacatgattttctttacagtcggtgattttttttaacggtcagcctttttttttacccaaaattttttgctatttttttatccggtaccaatcggacttcttatttcctctgtttttctttcgcgttttttatggtgtgttttcttttccgcgtgcccttttttatgttacggattttgaggagtagagattaaaaccgaaaaaaaaaactaaaaccgactcaaacacggatgatttatgaaagtaccgacaaaaacatctttaatttttataattgtagagatcagaggtaattcctccgtttcacagtataagactttctagtattgctcgtattcatatagatgttaataatctaaacactatatatatctagattcattaatatcttatataaatctaggcaatgccagaaagtcttacattatggagtatattatatctcattagtagagtgatcgagatcaatggatcaactgttcgttttatgaagcactgtagccataatactcgaaattatatgtcatatgccaaaatttataactattaccacagcattcggatcatgtaaaatttcatcgagattttaatgactgtcggattatatatgggttaaaaattcaaatttgggactcagatctttggtcaggccggaaggccccacctccgactctccgagcagcaaagctgcaatgttccgcaacaaagtcctcgtgcgcgcccgcgccgtcccctccgcgccacctcctccgttcatcctccgacaactctccttccccgccgccgtccccgccctcgacctcgacatcctctgctgcaggctctcccgccgccaccgcctcgcgtgcctcccccagcccccgtccgacgtcctcgttgtctaccaggttcccaactcttcgcgctagctcgcacccacccgaaaaaagcgatgtgtgctcgtccgtactgttcttgacggcgagtttcgtgctgtggctggctggatgcagagatgccagtcttgcgctgccgcggaggccgtgtcggggatcgcggaggcgttcgagggtgccgcggtgagcgcttctatcctgcgcccgccacctgctcgacgttttgctgcaccgagtaatggttcgtgaggatgtgctggcttgttcggcgttggacgttgtaggttggcgaggaggaggaggtggtttgttcgggctcactggttgcgaaagctgtcgagtgcgacctgcgctccctgatgcttgagcatggatggaggtgtcttggggagagcgtgtatgtcctttcgacgtttgctgatactaaggagagaactgaccaatgcacggtgaacgtggtatcgtaaatttctccctatcagtgaagcaaccaatgtccaaaaacatggaaaaatatttacatttctataatgctgcatgttagtcctttcatttctctccaaaaagtgtcatgtgatttcttgatatgaccatgtgattggatatgtgaagcaatggaggaaaacagtaatgcaaaaatatatcacaaatcatgcaacagcaattctggtcactttctttctacacaagcccatttgcttgacttcagcacagtttagagtaatcttgatgcaaatcaattaaactgactttgtagctaattcagcctgtaaatgtgttggaataaatattaattatcattattttaggtattaattagagttgtttttgtaggatagttttgaatatgttttagtgcatcacataataaattgaaatgtacaccctatctccatgatatgctcatgaaaccatagttgccacctcattgcaattgatttatcaaaacactatatgctctgagtattaatccatcatacatatgtactgctgtgccacatcaggggtccaaaagcccaagtccttcttgtatagtttatttcagtgaaacaagccatgtaaacaatgtaccaagcaagctgtgccatatacccatatctgtgatccgaaagcccaagtccttcttgtatagtttatttcagtgaaacaagccatgtaaacactgtaccaagcaaaaaaaaaaatacagagattatactgtgttggattacaaaataaaaaatagctgccatgccttttgcaccctcttttttcttgcagttaagctatttaattattcggatccactattttctgtcctttatcatttaccttgatgacacaaacttgtacatttgttggtcgaatggttgcaggaagtcaagcttgggagaaatgatgatattgaatttgctgtctcaccagatgcacttcggtttacaacacctaaggtattcttcatcttttacttcttttgccacaacagcagaaaaaaaaaatacagtgaacttacacgttttgctgctagttctctgattttgttagctctgatgagatggaaacatttgaaaacggcaaggaagtaattttggattattgtaatttccgaacagcatgtactactcttccaacccttcaggaaggccatgtgataggtaagctaaacatttttgggactattattttttggtgctaagaaacatttataatttgtcactaattgagcatttcttctttatgccattcctctgtcaagccacattttatgtttaccactgaggttatatagtgtgatagatttactccccccgtgccttttttcctcaaaagacaagaatgcatctgttactccttcctccggccattgtcttcaccactctactgcacatgatcagtgatgtgagaagcaccccacagcgacgccaagcagagaagagcgatgccagaaagttaaaaggaaaatacagcatccatccctgcccagcatggtggcattcgtagctttcacatgtagtcacgcagatccaatcagcatacagctctgctcagctttcatagcttttagatccataaaagcaaaatgactaaaaacaaacaaatgcatatatacacatgatccttgcaagctcctgcttgtgacgagcacactgaaacacaaggctagataaggcaggcaaacagtaccaaagactttctttttgcttaggcagtcgagcgatgcagaagaacttactagccatcctctctctagtggtgttattagacatggattagccctggggtccaaccataaaaaactgaacccagcgcttgagctggtccatggaccgttatttcttctttttccaaaaatggaccgttcaagcagttgaccagaaaattttggcttggacagatggtttctcatccaactgaccaatgtctgtttcttcttttttccaaaaaatggatatgaggctgtggctcaaacccaattcttcattgctgttgcttgcagtcaatgcaatttaatatagcatcgcgtaatatatggcatctgcagtccaactggtgacccaacagttagactgttgaccaagtgaccaagtaccttatcctggtcgatacccaatcagtaagtaataacactgctctctggcgggggggtggtggagaccaggttgccaggaagtggttgtgcccatggcactgtcagaggccctgaaggcctgaacaatgagaatggagtgttgggatacgcgtaggctatgatagcataaattaaaaaattttctaccgcgtaaaccaggaaccatgcaagtattagatcatagatcgttaccactcgacgtgctgtgcagcggaagtaagcgctaagaagccgaagaaacgtcggggacgtagcgtgtgtcgatgtagaggaagtagtcgatcgcaacagcccaaccttctcgtgcgttctcctcgccgtgttcttacgccgatcagcaccgccagacagcggcgcctctgtcggtatccacacgtacaggggcagaacgccacgcgcagatgtgctagcacccgcgcgcggctagggttttgctcgggggaagtggcagctagggtttctcacgtgatccaatcaatccgccggtcacaccccctcataaatttataggatccatgaataggcctccaaggctcgtaggactcctgttaggattcctatccgaattaagcttatattggattcccatccaatccccttattccggcccgttaagcgtgcgaccttgtaggtttatgtacactcggctgtaactcgaa

SEQ ID NO: 80278 - DNA, 515 bp, Oryza sativa
ccccctccccctcggttccctcctgccttgcgcaacgagctagcaccgccccccaccaaccttggtgccagaacggttggtgtcgccccctcccccttagctcgcttcctgccttgcgcagtaggctggcgctgccgtcctctccccttggctcccaccttccttgtgcagcgacctccctccctcttcgactcccctgtcctgccttgcgcggtgggctagcgctgccccctccctccttggtacgtctcgtaggacataaatgggtatttgttcgaaagagaaatgagaataacgaggtagtgagatacaaagcaaggctagtagctcaaggtttcacccaacaacctggagtcgattacgaagaaacttattccccggtcatgagcggaattacctttagatacttaatctcaatggcagtaaatttgaatttggaaatataattgatagatgttgtaactgcctatctctatgggaacttggacatgaacatttgcatgaaggtaccagaa

SEQ ID NO: 80279 - DNA, 18280 bp, Oryza sativa
cgcttttttcattgaatgaacagatatagctgaagtcaagaaaagaattattgctaaaataatataatagtatggaataatatgaaatacatgtaccctataattagtactccctccgtcccaaaatgttagcatttttagcatagttgcaaattaaacatttttaattttgactattaatagcaaaaaaataaaaaagatcaataatgtaaaattgatgttactagatttatcattaaagaaactatcataatatgtaaattttttttatttgaaacatcttacttttatagatattattggtcaaaataatatctcggagaccgtgtcagagtccaaaaaatacttatcttttagaacggagggagtagttcttttgtgttccgataaaaattgcttgatgtgattgccagtgacatggcatgaaaatgatggtatattaccaaccgaagaaaggaaaagctaggcgcaacattcaaattttcagaaataaccctcacactagagaaataaaactaaactgaattctcatgaggaaataaaactaaactgaatttcatgagggaatatttctacttttataccttgcaagagggaaaaaaaagagatcataaaatgaatgacaagctgaccggtgtgctctgccaacattttaattaactgcaccaccacttttatggtttattgtgtgttgtacccatagtaagtacctttattacgtggtgctcctttccaccatgtaatggcccttggtgaatttttttgtcacatgtaataccatctctcgtactaattgattatatcaatgttgtcataagtgtcttactcttagtttcaataaccctttttacctgcgatgcatgtctatctttgtattatctttagagttacctcgtaaccattagtttgtgtcttgccgctgaaagaattgtttttaaagaccctaactattactccctccgttttcgttttagaccataagtcgttttgactttgataaaaggcaaactgtttcaaattcgaccaagtttatagaaaaaggtagtaattcaacccaagataaatatattaggaaaatattttttaatcattgatttttggtggtgtaaatattattatcgttttagtgtgtctagattaacaaaggcgttcaacatttcaaatgctaactgtccatcgtactgtttatagctctacctttttgtacgctcctttctccaaagtttgttgatggtacaaaaatctagggatatatagttttaaaaaagagaatataatgctttgtattggctagacacaaaatgttcacaggtattatcgtgagctaataagtcataaacacaacttctcatatacattactctgaaaccttttataatatatatatgtcaccatcctcaaaatgggcattttatttagttttaccgtacaagactaggtaccgagagatgccatattttagtgttaatttacgatacgttttggtactttacactggagaagtatcatgaggtatcaaaaatttacactaaaatgagtggtagcttgagatacatcctcgagtaacataaaaaatcccttttatttagtatacattaagacatgctactactattattcaattaaaataagaaatttggtcctgcagcagcaatctcatcagccagatctctaacaccacctttcttgtaatttgcaaataccttgaaatttctcttgaacagatctgccaactttagcagtatcaacttgttctcgccagaattttgctacgtcatccgtatttgaatcggttttaatctctactattatttgaagatgattctgtactcaattttcgtctgtgcctctctactgacgacacatataaaataaaccggactgtgacttggttcggactcgaaacatacaaggaaaagactaatcaagaaaacactaattacttttggtactctagccgctaatgactctactaataaaccgtgactaacctatcaacactggaattaaaccaacatatcttataactacttcaaaaattaatttcccgttcttcacatcatttttttgtctgatgagtccaatcgaacgatggcctccgttcccacacgcgcgagtaacacatcacgtatgatggataaaacacaaattcaaacgtagatacaaaatccaattggacaataaaaaaaaaaagaaaaacaagaataataataataaatgcacaaatcttatcttaatcttcattgtcgcctgatctgcccgcggaagccgccgacaccactgtgcccatcggatccgcccgcgggaagccaccgacgccgcctgatccacccatggaagctgcgggaggatgccgtcgccgccatcgccactgctcatgctgagggagggcaccgtggccgctgtcgctcgcagtgggggagggcaccaccgctactcgcggtggggaagggcgccaccgccgtcgctcgcggaggggttgtgcggcaccgctcgcagtgggagagaaggggaatgaatctatggttagggtttcaatagggcaatgttttagtaaatcacgagtgatcctaaccgttcgatcaaatctgacggctctcagcacacctacgccgacttgaaccgtggccttgcacatgggccctgtgcacttaacatgccacggtgtggaagagagataggcatccttctaattataggtctaattatgtttattttttcttagccgatttaaactatttctcaattaacaaacttagtttaagctccatttcgagccattaaaaattggtgagatttaatatagtttttcattcttcatactaaatatttctagctaaatggagtcaccaaaaaatgtaattatttatttgtcatgatattgaattagaattaggtatagatttgatacattgtttatgtctgggagtatcccatataattcccatgaaactataaaattaccataatcattatcataactttagttttttcctttgcaacgcacgagcactttattctaatataaaaagcagcagttgtacttttgctaggtgcacccagggaaatatacacaaaacatcatcatcccattcctcagcaatcccatctatttatctaacggctgaaaaaggatgagggtgtcttctgtcttacagtgctaacatgaaatcaccgatcgattacccatcccaacccatcgagccccaactcctcattgcgctatgtacgccgttgcacctccggcctcgcacctacggatccgaagctgccggcacactacaaatgaagctgcgcctcctacctccttgccatgggtcatgagccaccggtggtggcgccagcctgctggcactttgtgcctcgccggggtcactgccacaaaaggcctcactggtctgcaactgtcggcactccccgaggcccaagcgaatcacgccatctccgtgattggcacctcctcgccggacaccgcgtgaccccctcgattcacgcccaaactccggtcggcgatctcctcttgcaacctaagaacacgcattggcatcccctaatgattcgctcccgtgcaccggtaactccatctcgatcctcttctcctccgtgattccctcatcatcaggactgcctgagttgccattgttgcagaatgacagatcaacgccaccttctccaacggtacgcaccatcttctcatctaccgccgatgcaccctcaatctacatggccacggtcgacacctgctctccatcaagaaaccaccggccaactcatgtgagtcattaaatttatcttgctgttttcatctttgtagtcgactgctacgaaatttattctaagttggtattgctaaccatgggctatgtggaagaactagattgattaggaagcgttatcacctcccgtgggaggccgcacgaatatattgattgagccggcaaaacgcggcgagagttacagggagtttgttacataggataagcaacacaaaagataagaagataaccaatctaatcctgaaacttatctctactctaacagcccccctcaatcataactttgacaagttaagattgtgctgaaattcgcgaagtttctgaacactgagcggtttggtgaagccatcagctacttggtcattagtagaaacaaatctaacctcaagaagcttctgcgcaacccgttctctcacaaaatggaaataaacttcaatgtgctttgtccttgcatgaaatattgggttagcagacaaataagttgcacccaaattatcacaccacaatcttgccatggacggacattgtataccaagttcctttaacaaagtttgcacccagattacttctgctgttgcattggccaaagccttgtattctgcttctgtactagatctagatacagtagcttgtttgcgtacactccaggatataagattacttcctagaaatacagcaaacccactagtagatcttctatcatcaacacatcctgcccaatctgcatctgagaatgcatttacaagcatagactgagatttctgtatcttgagtcccataccaacagtacctctcaaatatctgataattcttttaacagcagaccaatgtgtcaaagtaggagagtgcaagaactggcataccttattaattgaaaaggcaatatcaggtcgagtcaatgtcagatactggagagctccaacaatactcctgtaattagttgcatctccaggacctaaaagactcccttcctgtacagataatttttctgatgttgacaaaggggttggcgcaggcttacaggtcgacatacctattctcttcaatatatcatgtgtatatttgtcttgagacagaactaaaccatcacttatcttctttacttctatcccaaggaagtagtaattaagatcacctagatctttcaaggcaaaatccatcttaagattatgaagcaaagagctaacagcatcttgtgacgaacttgcaacagttatatcatcaacatataccaagacaaagatagtcacactaccttttctatagaaaaataatgaggtatcagcctttgaaggactgaatcctaattgttgcagcttcatgcttagtctagaataccaggctctaggggcttgtttcaaaccatatagggccttgtcaagtttgcaaacatagtgtggcttagatatctcttcatactcaggtggttgtctcatataaacatcctcctcaagaatgccatgtaaaaacacattcttcacatctagttggtgcaaactccatcctctagacactgctattgataaaactgttctaatagtggttgcctttaccacaggactgaaagtgtcttcataatctatgccataacgttgtttaaaacccttagcaactagccttgctttatattgaagatgcacttaaacccctagtgggttttggtgattaatgacaaggtggttaaaggggactaacgtgtttatcaagtttattcacaggagtttagtcccaaagcaagttgtgatagctaagaatgcaaggagaccccccaagttggatgttcctaagtgcgaaaaacatcgaaggtgattagactaggtttttctctttcgaaattgagtttaagaaaaaccgtactattaagaggggtttcaagtgtggttctagggtatacaaagtgctctgagtcatatccatgagtctaaaggtttttggaatcttttttttcttggaaatgattttccccgggacagagaggcttacccggaggttctggccagacctccggacaccaaagtttattttctccccgggacagagagggctacccggaggttctggccggaactttcgggcaccgaagtttagctagatttttttttcctgcccggaagttcctggcacttttgcccggaacctcctggcaggtttccagttcaatcttgtgagtaacggctagatgacgtcacctagccgttatatatatggatttcgtccccaggtcaccctttggccattccacttcagttctttcatgttctaggttttctagccactcccaagcttcctttgcttcctccactcaaatctacagcctatcttgtgagattgagagattagatagagtgtaggagtgttttggagatggcttgaagattatgtttgtttgagcactttggataccttgtgggcagtcacttgggcttattactcttggagatcttctcctagacggttaggtgttgcccgtgagcttccaaagatcttgtggatgtcccgggaaagtttgtgaaggttttcctcatctccgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgagcacctcaacggagagtaggatccgtgtgatccgaacttcgggaaaaaatcgcctttgtctctcttgtgcatgatctgtgtttgaatctgctggtatcttgtgatttacatcttgtgcaaccttgtgcctaattgtctatagctaggacctgttttgcctccccaaattttgattttctctgttgcccggaagttcctggctcaagaactccggaagttccgggctgctcatttctgccaggaagttccggtgttcttcaccaggaggttccgggcactgttaatttaaccgctgcgattgttgagaaaatttcaggaaagcctattcaccccccccctctaggctacatctctgcgcgttcatatatctatctattgtgccatctgcttttcttttaaccttgtacacccacttgcaatcaatgagattactaccatcctcaggtggaactagatgccaggttttattttgtttaagagcatcaaactcactatccatggctaccttccaatccttatgttttaaagcctcttctagactttcaggttctccagtagatgtaaagcagccatacctgacacagccatcagtataaactttgggcttgtgcacaccactttgtagcctagtgtgtggtcgagggttgtttgccgctgtatcctctgccacagaggatcttgaaaccagctcttcctcatcagtgcgcgtaccagatggcgagctcacagtggtcgatgcggcatgcggtgagggaggtggcgacggaggattgggcgacgctggtgcagaggacggcgaggcgagagaatttccccctgcgctccacacgtcagctgctggatcatcggtcgtggcagacgatgattctgacgtcgattcagcacctgcaacggagttagtagcagccgaatcggtctggtgctccgcggcatctattgctgctgatatttcatgtgaaatctgcaccgaatcatcagcaaaactcgcagaattttctccattagacatattttcaggcacagtattttgattagcattattaggcacatggtcacccccagaaaaaggaagaaaaagactgggagtaagatcaatttctttgcgaagaagtgcaccagcattaggatgaagctttgcaaaggggaacacattctcatcaaaaataacatcccgagaaatgtagatgcgaccggtggatacatgtaaacatttaaatcctttgtggagagggctatagccaagaaacatgcattgcgtggatcagaaggcaagtttctttgaattgtagggtctcaaattaggccaacatgcacacccaaatgtgcgaagggaagcatattctggtttttgatgaaagagacgctctaggggcgtatcaaaattaatcgtcttggccggagtacgattaataagataggtcgcagtgcaaaaggcctcatcccaaaactttagtggcatagacgcatgagcaagcaaggctaaacctacttcaacaatgtgtctatgtttgcgctccgcagcaccattttgttgatgtgcgtgagggcaagagaccctgtgagagattcctattttagtaaaaaaagaatttagtttttcatattcaccaccccaatctgtttgcatagcaattatttttcgatccaaaagcctcccaacaagactctgaaattcttgaaatttttggagtacctcagacttgtacttaaggaaatatatccaagtaaatttgctaaaatcatcaataaaactcacataatagttctttctgccaactgaatcagtggcaggaccccagacatctgagtacacaagttctaaaggaacggaggaaatactgctagacttaggatagggtaattggtgacttttggcttgttgacaagcatcacacacagtttctttattggactcgctagaacacaaaatattatgcttcttaatgacttgttgaagaacaaaagaggacggatgccctagacgactatgccactttgacgttgagggtttgatggcaccatatgcttgcttccttgtatccacggatccgggaggaaagggataaaggccattcctacactttccttgaagaagaggtctcctcgttgttttgtccttaaccaaaaagaatttatcatgaagttcaacaaatgctctattgtcagatgtaagacgatgaatagaaactaagttccttttggcttgaggaacataaaggacatcattaagattaagtgcccgaatggaagtaggaatctgggtgtgaccaatgtgactaatatgcatacacctgagccacttgctgtatagatttgttcgccatcattgtacctctcacgcacggagagcttgtctagctcgccggtgatgtggtctgtcgccgccgtatctgcataccagttggtatcgatgttgtagccatggattgctgcagctgcactcttctccggaacaaagtcctcgttgtaacggtaccagcagtcggccaccatgtgaccaactttgccgcaaagctggcaagttggacgattgcctcgcccgccaccattgctaggtggtctgccgccacggccacggtttccgccaccgcgaccgcgaccgccgccgctgcgcccttgttggttgcctcctcatccccgcgaagccgtgttcatggagtgttgggccgcccgacgactcaggcgctcctcaaagctgaggagttgagtgtatgcgtcggcgatcgtcactgctttagtgcgcccagtgatcaccgagaccaccgggtcgtattcttcatcaaggcctgccaagatgtatgcgacaatctcctagtcgtccattcgctttccagccgctgccatctcatcactaaaagacttcatcttgttaatataatctgtaatttttagattacctttcctggttgtggtcatcgccatctcatcactaaaagaattcaataatctgtaatttttagattacctttcctggttgtggtcatcgccatctcatcactaaaagaattcatcttgtggtaattttcagtctgggagcacagcatgttctctagagtcctccagagctcggctgcagtttctattgacaccacctgtgtcaggatctccctcgcgagggaggaaaggaggtagctcaagacttgttgatctgcaaccacccacttggtgtactctggattggtggctttcaccaccttctcgccttctttgacgtcgatgagacgggccggcggcactgtggtgccgtccaagtagcccatcatctgtgcgccgcgaacggccggaagaacttgtgtcttccaaagcaggaagttgtttcttcctagcttttctgccaccggttggccgaacagagaaggggacgccgttgccatgacggaggagctcgccattatcaatctagatgagtttgaggagtaggctctgataccatgtggaagaactagattgattaggaagcgttatcacctcccgtgggaggccgcacgaatatattgattgagccggcaaaacgcggcgagagttacagggagtttgttacataggataagcaacacaaaagataagaagataaccaatctaatcttgaaacttatctctactctaacagactattgtaatgcaattctccaattgagaaagtgagatgctgatggcaatttttagctgaccggacatgctggaaatctcgtggaaacagcaagcatggtaacatatttctgtcttttacccatcccgagatgcttcaaagctattcttttttttggattaatgcgatctctctacatatatttctgatgttgatcttcgccttattcatttcgtgctcttccttctactgcttggaatcaggtattaaatattttctttatgcacacaagttggttgatgaaactacccaatgcggacatgcactggaatgcttccctcgcattctacaactaatactgttgtgacaagttgggtgttgattattacaccaaatgggttgagtaagtgtactaacaaatggagacacaatatatgaggagggactgagtattctcgttcacgttcttttcactacgtacaaaagcctctctcttccctttatatagccaattagtgtaaggcccattagtgtgttgggctggccttcatgggccaaaagcccatgtttctcaacactccctcttgggctttcaccagccaccacatattgcttatgcttcattaaaacggctcaaaaacccagtgggaaaaattggagaaagagtacataacatatgttttgtgtgttgcacggattgcctagttaaaaacattgataagaaaccgcgggaaaacttatctatgggaaaaagagtacgacccacccaattattctttattaggcactttctcattctggactaagtttgacgagtgagtgaaattctctccatgaattttgcacttctctaagtcccatcatcccgatccctcgaatgcatctttcaaaaggggttgccagtaatgatatagtgaataaatctttgagattttaacgagacttagtatgcaatacttcgattttgtttgtcttatgcagttcatgagcataaaaggacttggggttgatatgcttggtgagattgcttttcacttaacccatttgtacttgtgcgacacacgctgcattatcttcatagataattgtaggggtctgggtggtgttcaattcacatgattgctgaatgtggcgaatcatcctacgaagccatacacattcacgagagccttcgtatagtgcaatgttttccgagtggttcgtcgaagttgctacgagactttgctttgacgattttcaggaaattgtcgttcctccacataggaaaacataactggtctgtgacttggctatgtgtggatctgataggaactatctttgtagctccagaatgtttcagtttatgttcctacctattgtctggttataccaagagagatctacagtctaatgaggctactatgaaatatttactcatgggtggggtaagctcttctattctggttcatggtttctcttagctatatggttcatctgggggagatcacaccgaggaatcctaccttccccaaaggtagaacccctctctctttaaaacactatacatttagctacccgaaaaacgaatggtatcccatattcgggctggcctcttcaaggggcctccgctcggggacaaccgaactccggtcttacctaccttcaagtccaatcttgggtaggcactttaggcatgtcctattccctggaccagatccgaatccaaaaatgcataattgatgtcagcttcgataactgatatatacccagcatctgcatatcctacttaggtgaggtcttggttctttctgtagaacagtcccatgtccttgcttcctttaagataacgaagaatgtccttgatgcctttacaatgtctcttagtaggctctgtgctataccctgcaagtaagttgacgacaaatgctatgttcggtctttgcacaatttgcaaggcacatatgtgctcctattgcactcaagtatggatattctgatccaaggacttcctccccctcttcccttggtctatacggatcttggtctacttggagtgacctttcgaccatgggggttttcgaaggatatgccttttcaaagccaaattgttccaacactttctgtgtataggtcgactagtgcactgagacccattcgggggtatgctcaagctgcaagcctaagcaatacttggttttacctaagactttcatttcaaactcagattgcaaatatgagtttgcttcttcaatatccttgactgtcccgatgatgtttagatcatcgacatatacatatattatgtaaaatccatcatgggatctctatataaaaacacaagggcaatcttcataattatttcccttttttctgaggaaattgctaaggcgattataccacatttcccctgactgttttaattcgtatagtgacttcttgagttgtacactatacatatttattcttgccctgtcttagtttgggacaaggaaaccttctggtaccttcatgcaaatgttcatgtccaagttcccatagagataggcagttacaacatctatcaattatatttccaaattcaaatttactgccattgagattaagtatctaaaggtaattccgctcatgaccggggaataagtttcttcgtaatcgactccaggttgttgggtgaaaccttgagctactagccttgctttgtatctcactacctcgttattctcatttctctttcgaacaaatacccatttatgtcctacgagacgtaccaaggagggagggggcagcgctagcccaccgcgcaaggcaggacaggggagtcgaagagggagggaggtcgctgcacaaggaaggtgggagccaaggggagaggagggcagcgccagcctactgcgcaaggcaggaagcgagctaagggggaggggggcgacaccaaccgttctggcaccaaggttggtggggggcggtgctagctcgttgcgcaaggcaggagggaaccgaggggggagggggcgccagccaatcgccagtggcagaaggggagccgaggcaggaagggtaggccgctctggtttatcgacgcatgaggggatgccaacgctgtgtcagaggggccagccaggggggaggacgctgtgacatggagaaggccacgatatgggcttcaaatactcaggagacaaaaatcgaacctaaaaaaacatacaaagtcactctcatacatgcacgtcatacttccttgatgccgaacaaatacgataacttttgtggatcaaaacacgagaaaagttcaatggcatcatcatcaacttaaagtctcaaatttaagtgttttgcaccatgcatggcatactcgtgcacatttcaatgcacaacattcaatactgccattattacatgtcttagggaatttaaaaatgtcctcgacctccaactgaactactaggtgcaacgagtgcattgcgccttgctagtggcctctggaccagcctccttggcatgttgtgccctatccacctttcccgcccgttcctttgcacgctcgttcttctccgcaaactcccttgccatcttcctaagctccctctcctcattcctcttcctcttagtgttctctatagccgcaagtctgagacgatgattgagctgttcctcttcctattcgtgttccctatgaatcatttccgtattgtggggatcaatctccgtgtcaatccatttcacaaagtcacacagaggaggcaatgtcttcggtacctgcacatttcacgatttaaaggatcttcattacaaaatacaatgcttttaggatcgcaacctcagaaatataaaaaattacctccaccgtcttctccacatttcttttctttttctttgccttaggcttcggcttaggcttctctagattgtacgcagagttgcgatacatccaattcctttggtggtgtgtcttgtgatcattgcaaaacgacattcgtcaccacaccaacacatgggacggttagtatccagtggaggtagtttcctagggcaataacccgctgcatccttcctgaacattctacaaaaccaaaattgtctcccgctacgtaaattacattgaaattttatcaatcaccagccttaaaaactaattaacttgacaagcactcaatacccacatatattaataaagtaagtacattaaatttgtcatttttcatacaaatttataaagttatatttaatttcagtaaatttctatcatgcgaccaaatttgtctatccttcatatagtacatagcaacaaatttaacctaaatcaattttttcatacaaccatctattcatgtctcaactaaaaattatcattaccacatatatgtacttgaaaaaaaatcatagcacgaacaagcacattgcacatacctaacactacaatcatcaaatccttaatttcaatggtcaaaataaaaaaaaatgggcaaaaaataggttctagcgttaccctccgatctacaaatttcatcgattaaaacgaaaaaaagagggatgaatggagtattatacctcgctcttcgattttcctaagaaatcccgcgaaaaatggctccaaattgagtagatttgaggaggagaggtgaggggagggggaagagagaggagcagagccacttgggcttggatagggaggaggggcgaatgggtggggagggctgggaggtggggcctgcgtggttaagtacgcacacccccctcggggggtgcacgcttttgacggtcgttatagaccagtttcgaccgtcaatataaccaaaataaaaggagaattggctatgcttgtaatacatatttattttagaataatatattttcactcatacttggagtattatttgtttgcagagattagtacataaatgaagaataaatgaaggaaaactcactcctaagcaagctcaaggataaaggagtccacaggtcaggtataaccgtcctgaaacccgccataactgccagaactgccatgaggacccacctatcagcccctctaccaaatctggaggcttgctgggccggcccaggttcggccgaaccagggattcgcccaaatcctggcagggccggctcagctcggccctccacgtggatgcttcagatgcacccccaatgatgtttgtggggcatttccgacaattccaactgccataaccgtaattgggaggttgtataaaggggtcacttccttcacttcatcacacactcaagcaagaagctttgatccctctgtcaagcttagtttagtgctctagtactaagtggaatagaataggatagttctcggagtcctcgagtcttcggaagatctcggtatggctctagtagcttttctttcttcttttgtaagacttctggaattaatagaatattcttctttatataccttcgacactttagtttgcccgagtactagttttactttagatttgtgccgatatagttgtgtgactggcctaccagagaggtgcagtggtgtgggtttaatgttcatgcaaatgattactctatattattctagagggtatagagtagtatttgataatgtaagcatggtgcttagattattagatattattaattgggcatatatgctgcgggacagtagaggtgggccgctgatcgtgatagctcagtacgggtattcctccacattagtatatattcctaagacaattttctgggtgggtactcctccgtatttagcctcggttggacggccatgataggttgtcgtaagaaactcggcaacccgggtggtctctcgaagcaccaggagggcgttgttaagggggtattggtcaacacaactgtatactagcaaatgtgaactaaagttgagtgtatattagaagtataggaatgactacttttctatttctttttccacgttagtctagaattatttaaatgagagaatctaagtccttctgcttcgtgtcaccctacccatataattaaagtaacccttgcatagattttgatatatatgtaatgtatataagttattagcaaagttctctcttataaatcttcccttgggattaaacaaatacgatatcttgaaatacttccgggtgaaatgctataatggtatatccgtgcgcttgcagattacttctataaccataaatataccagtgctatttttgcaccgttgctggaaattcatattcctagtaatgtcgttaagaaataccaacacacgccagcggtgttagtgctgtggtggaggggcggcgctagcaatattggtgccgtcctcctgccacgtcagcacgtggctgctgtgttggtgttgtccagttggaccacgcgccagcgactctagcgtcccaaaaatgattattcctggaataagttttccaggaatgtatttctaaaataagttccaaggccctcgatccgtgtgcttgcgcatgattcgtcagaggtgtgtttctttgcatactggctcatttcactttcactttattgtatgttccctacatacatagtatttcttcaagacaaatggaactacattattcaatacatatatatgtgtaagaaatgctagttcttcttttatatattatgattttatatattatggtagttgaatgtaagccgaaatcggtaagtagcgaccgccaacactaggttagaacaacatgactacaagtggcatgtattattgtttttaaacaaataaattattatggaattttaagaagcatccattattgatagaaaaacaatgatgataaaacctgcgtatgaggggatcaaactcagtccaatcggcatgctctagcagctccccacaagatgagctacattttgttcttggcttgtattttttttcgcaaacgcgtaaaaggattgcacgctaatataatagacgaaaagagtttaattacaccacgcaatcagccagaccagcttatgctagtgaaagggagaaaaagcaaaataaaaagctaaagctagagaaactacgacagctaagcacaaactccaagtagcgggaatgggcctagccacgctacactcccaacaagtccccaaaagcggcaacgctagctaaagaccacagatggccctccaaacggatggactccaggaccattgagacgaaagagagcgcggagtcgaaaactctagagttccgtttcttccacacctgccaagagaccaggagcaccagggagtcgaagtcggcgcatagatgctcaggtaagcaggccctagaggatagccaacagtcctggaaccagctgccacagggagagagagggcagcccagccagaaggcgacaacacccagaaccagatctgctgagcgaacacgcagtcgaggaggatgtggttcgctatctcaagatcctgagagcaaaagggacaggccgagtgactatcgataccacgcttctagaggagatcagctgtccagtagtgccactggaatgcaaaccaaagaaagaatctgcatttagcattaaaaaaaatactacattcgtccgaaaatataagaatcaaataccgatgatacgttttcctaatgtaacgtatctggatagggagtgtatgaagcctgtctagatacgttgtctcagaaatatcccgtccgatcctagaatcttgtattttgagacggagggaacatgagacggagggaatgtatgttttagatcgatattttttgttatttatgtttatgggtggaattgttggctgtggcaggttttgggtggcataattcatgtaccatacatatattttaaaattttgtttatgtattttacatttctttgttaaaaatcctactaaatatttttaaagtgaaaatatatctctcaaaattagcggcgggcaaaccgcgaacgttacaaaatactaaatattatggcaaagtccctaaaatcctagttgccgaaaaagcggccacttttgcgagtggagcgttacgcaaccatccacaaccaaaagagaaacagaaaaagcaacagcatttccttcccgtttcttcccccaatctccgatcgaaatcccttctactccctactagtatctcgtcgatttcgttccctagccaagcgctccaggtcgtaaattccacccaaattcgttgcctcccccactacccaaccggggcgcagga

SEQ ID NO: 80280 - DNA, 12955 bp, Oryza sativa
gtcttgtgttcatttgattgtatattgtactagtgctactactacgtggagagcagagcactagcagagtgtgagaaagataaacaaggaaggcagatgtggacggagggagggagggagggagaggggcaagtgtgattgatgcacaaacaaacagctcaagttgaggccaggtggacgtgcagccacgcaagacaagacaagcaaagcaaagcacgagaggagcgagggcgaggaggacacgacgcaccgcacggatcattcattcattctctcctcctccgttcctgactccaccactcacattcattcccttctctctcctccctccctcccccgcccctctgctcccctcgccggcgagcccaatggcggcgtccgccctcgactccgcctgggaggtacgctaccccccaagtccccaacccaacccaaccctttcttctacttttcgatttgctcttctcatcatagattagattatatacgatatgatacatggatagatagatctctcatctcatcctgtcaacaatgcgcgcagggcctcaccggcagcttcaccgagttccagctcgccaccgtcgtcaccttcctcctccacgagaccgtcttcttcctctccggcctcccctccctcctcttcgagcgcttcggcctcttcgccaagtacaagatccaggtccccttcccttttttctcccatccattctttcctatctcgtctcctactacaccccaccccaacatagcatctccagtacctacggttttttttttctttttgcacaattattattattattattattatggaggacctaccaaccagatcaaacccactggaattgtctcttttttttttttttacaaaatcacccccaaccaacatggaaaggtggatcacggaaccaaaaataatttatgatttcttttccagttgtatgagtgtcttaattccacttcagggagccttctggtttctgctatgccaacgccacgctgatcaatatgcctcgcaacaagtcaaactcactgtgcgcagaaaacgaaattaagtatcacctttgtgtgtgtgtgtgtgtgtgtgtcttagcatctccaaaaaaaaagtcaaaaggccccttgaacgcttcagtgactatgggatgggatggttttaactgttgcttaatttcactctagttccaaactaccaaaaacctcgtatgtgaaatgcttcggcaataaatgttttgaggattaagctctacagctttgtcaggataaacagatgactttgtttgcactgatcagagtggaatactacttttctgaaatattttttttaataaacgaacatagtgaaatatttgaaatgcagtattgaatctatctggcaaaactagatctttgttgtgttccttatgcgtattcccccaaaaaaagatctatgttgtgtaggctaggtaccatattattacttgaactatcacccatcatttataggaaactcttcttgcacttttaagtaccatataaatgccctacctactaggctactacaaatcttgaaaattctcattcacagggaaagtaattaccgagaacattgtcgataaatatccttgctcgaagatatatgctgttgacttgtatactctgcaccttagttttatatattctctgaacaagaagtcaaaaattgtgaaaacaagttgcttccagataccaccaagtcatcaagaaatactcaacctccgcgtgcatgtttcaaggcagatctgttcgctgtcgctaaatgcttctaggttgtactttgtttcaccacaaatcagttttaaagtaaagcatgcttgtgattgctcttgttcccagtttacggtgctcgacttacaagtcatatcagtacgatttgagctgttggtgccatgccactttgttgatcccaaaatcaaattaagaacaatatgagaagtctctcctgtccatttatggttctcctgatgaaactaacatgcattgccttttttttaattaaaaaaaaagagagtatgctcttgttctgtccctactttctatttcactcattgctcccctctgtgccttttctttttgggggccttctgtgacaacagttaaactgttgaacactgtgaaactcagcagagatttatacttgcttgctgccatatctggtctcataaaaaaaaattgtgtggatctttgcagaagaagagcaataccccttcttaccagaatagatgtgtgctgcgtctcattctgtaccatgtctgtgtgaacttgcctgtaatggttttatcctaccctgccttcaaattcatgggcctgaggagctctcttcctctgccacactggtattcaagtttcaatctttaaaccagggtagcacttcatttattgcaatgtttaacattccacctatgttgatgcaggacggttattgtttctcaagttcttttttactttgtactcgaggattttatattttattggggacatagggcactgcacaccaaatggctatacaagcatgttcacagcgttcaccatgagtacgtaatgctacatcttggcctcatacttttacattttgttattgttccagttcttttaaataacaatttcctgggcagatatgctacaccctttggcttgacttcagaatatgcccaccctgctgaaattttgttccttgggttcgccacaattgttggtccggccctcactggtccgcacttgttcactctatggctgtggatggtgttgagggtattggagacagttgaagctcacagtggataccatttcccatggagcccatcaaatttcttgccactgtatggagggtaagtaatctagatattgtaagtgtgatataaaatggtatggggactctattggtgtcctgaatgccgtcttttcctatgaccagctccgactttcatgactatcatcaccgtgtgctctacaccaaatcaggaaactacgcctctacttttgtttacatggactggtgagaaatcattgactttgctatgtgtaatcatgcatgtttacctgactctttacatgaggagccttcctgtttgtgataggctgtttggcacggacaaggattaccgcaatgccaaggctatcgaggagaaagacgggaagcatttgtaaattgtgggggctactctctttctctttgtccaaatcatcgaaacaagggtttgacatctcgcagtggtgatagcattgtgttcatgggaggaaataggtgtcctagccacaggtatctatctcctgagatgatcctacagtttagattttctttccccaaattcactatactatcatcatgagacctttgtgtttctggaggccaccatgatgtaatttgtcataagcttaatttgatgcgtgctattttgtggtttgcttggacgggggtacatgccatgacagaagtgaactattcgaatcagaaagttgtcagattagtgagttaacgttgagatgaggtttactggttaaagtgctgcgtgttactttggtgcttttgttggttttatcatctttttctcgttcttatcgatctcgaagtcgaagtttgtttgtttgtttgtttgtttgtttatattttataactgctggctttatgtatactgcgtagcctgatgaagggttaattaatagcagtcaagtttacgtgtcaattggacacagtgttagcattaccctggcgcgtcgatcagaccaaggaattgggcgctgtgaccggcttacggccatgccatgcctctatccgaaccgaacaactcccgcctcggccagcaatgggtgtgtttggttgggctgtggcttttaaaaaagcagctgtcgactgtgatttttttgaaaagtagctttgaaaaagtagctgtgaggatttttttgaaaattagctttgaaaatgagcatgctggcggctgacgacgacgacttcgcacgcgcgacctgctagctcggctggaggaggagtggcggtggcggctcggcgaggaggtagaggcagacgcgggcggcggcggaggcagtcgcgggcggcggtggaggcagtcgcgggcggcaaggctgaggccactgcgcacgcgtgctcgccattgctggagctccaccatggccacctcccatgcccgccgatgacgaccgaacaacgacgacttcgcacgtgtgggcagctcggctggagaagcggcggcggcgggggacggtgtccgtgcagcacgtggcgaaggcgtcgtcagacaagctcatgcggaagttcaccgacccggacgcgcacgccaagcagatcacgccgccgcgccgtagccttgcgctgcggcggaagcagtcgtccagcagggtggcattggggctccgcgagggatttggagctgggagcggagctcgtggcgcctaagcggaggcggagcatcggcgggtccacctagtggaaggccgggctgctgctgccgatgaccacggcctctgcccgcaagggagatccgccgcgagcacctcccatgcccgccaacgacgaccgaacgacgacgactttgcacgcgcgggtagcttggctggagaagcagcggcggcggcgacggggcgaggaggagaggcggcggcggcgaggaggggcggcggcgacggcaacggggaggaggagcgccggcggtggcgtggtctgtttggtgacggcgaagtgaggaggacgaggagcgacgcgattggagaaaaagaacgaaccgttttttggtaatggcagagctgggtaattttttttttcccaaaagcaggtgaaagcgggggtagaggtgcttttgatttgtagtagaccaaaaactggctttgggcaaaagtagctgtagcatttgggctctttggttagcttttgcaaaagtaaaagctgattgaaaagcccaaccaaacacaccctcaattgctctgagccaagcccggctgccgccacccttcacgctcactctgagccttgccaccactaggaataggtaggggtgcaaacgggctagcgcctccctccatattaaaatatacttcttttgtcgtataatatagcaacttagtaccatattaaaatatacttctttcgtcgtataatatagcaacttagtaccagatggagtatttttaaagcacaataaatctgtccagattcattgtactatgaaatgcccctatgaaatgccccctttagttttaggttgctttattaagtagttacttctacttactagcagggtataaaaaatatgcggctatcacggttatcacgtatagtaaccttctccatttttttcgtgttaatcgcaaggttgttatggtaaccgtacggttactacgttaacagttgaaaccgtgggatgaaggtaatctcacccaaaacggtttgagaaccctgcatactagtagtggagtagtgcagtggtggtgcaagatgaaatgtccacccgtctgcccgatgcgtgagatgctgtatgtggaggcaggcagctgctttgatccagagcaaagcacatgagaacaatcttaattttagtgtgcagcagctttcagtcagagtactgagaacatgagacaagagcacaagaatctttgcctgcctgcctgtgcctgcccagccagcactaatacccaaccaacagtgacccctccttccctgtgctgtgcacattgcacagagaaaattaaagatcctactactatctcacagatcattgatcatatactgtagtatctatcaggagggccagttaacagttgcgctgccactgccagccaaccctttcatctcatctatctatatattcgaaatgcatgcatgtgtatctacagttgcagctagcctttggccctccctggacaaattaaccttttgtttttgtgaatttaacctgtccttttcgttttcttgatcagtgctgccatgctgcctgcaagcatggagcaaaacagatttacagtgcaatactgtgatgagtcgctattatacagtcagatcagatcgatgacagactatgccaatttatgaaataccaacttatattatctgtgacaatgaaagcaaataatgtgcactgccattaagtacaaccgaagaaatccaacaatgtgaatcaaccgatcactagagattatctagctatgctcagtaaattaaagaaataagatatcggaacgcggatgtggaaaagcggtgagaaaacaagacaaaatgaatcaggctaagcaagcaacaagacaaacgcatctcacaagcatcaactttttatggctctagcgactactcgctagtagtcgactaaatagtggagttaagtataatcaggtggaggccagagtgtaggacagtgagaagaaaacataccagctgctagctagatgtcatgctaattaacacactaccaaatcgatctacaattctgattccgtgtggttctgatcttgtccatctcaagaacgccacttcttgctttaatttaactatttaggtgccttgttcaaatgaagaactcatgtcgcgatgtgtaatcgatttggcgtcccttcctgcagccaacaatatatagtgctgctacctgctagctagcatctggggcatgacttgctagatatctagacggattaaatgtgtaaatgttcagattgatagataggagtagtagtgtagattgagaggtcaactgcaacatgaaaaataattagctaaattaatccacgcaggctagctagctactccctccatcccattttaagtgcaactataagtttccgtgcccaactttgatcgttcgtcttatttaattttttttataattagtatttttattgctatgagatgataaaacatgaatagtactttatatgtgacttatgtttttaaattttttaaaaaaattttcaaataagacggatagtcaaaaagtcgtgcatggaaaatcatatctgcacttaaaaatagaacagagggagtagcttgaaccatcactcaaattaattaaaggcagatttacccctcgagtaattaaactccaacaagactcatagaaacattcatacaaaaacatttatatgtattacatgaacttagggtttattaagtactaactttctcttattcatattataaaatgttttaagttttaaatagtttcatgtatggacccatgtatgtgttttatatttgtttaaattcatatggatattagtaaatctaaacgatggatgaaaaggccaaaacatcctgttgtcgtttgggtatttaactgagaaaaaaaatttcacgaataattttgaacttctctcaccgaatagctgacgtgcacctaaatccattggtattgtatagagaactcttttaagtcctcgagagatgtcccttcaatatttgttcaaaaataccatccaaaaaagttattaatttttcttaaaaaaatgacaacgttcatacaatatacatatataccactctgaaaaatttaactctaaactcaacttacattgagaaacacacacaaaaaagacgacaaatctaacgtataaacagtaccgacactgtgtgtagattgaatttgaactttggtggaaacagatgtcacactatactctacaattgtcaaattttatcaaaatttttcataaccatttatattagagaaaacgatacacacaaaacattctctcaagtgattaaaatcctctttttggcgacatgtacctctcattagctcatcgatgatgctgtataatcgggtgggagcacctcggatgcctttgcctattgaactgtcaacaacatctagctatcagtgtttattctctttcagtggactcttcttcgaactgaattattacctgaaaagattttagaagaaaaactattaccggcatttcaatgaaaacatgtacatatatgcatatgcaagagaatcaatttagaattccagattcgatggagacacactaccacctcgatagattaggatgactagctagctagctaggattgccttgaatgaattgcagagacacatcaatgaccagttagttaagatcgaccaacaaatatataatttaaaaacatgattttgccggacaacgcattctccaattatatatatgctcctggattttacattttgtccaataaaaaaacatcttaattacaccactggtgtgagagaaattaatttgcttccctctatacatatataatagcaaattaaataatgaattaagctacatattttttcctctgaaattaataaacccaagaaggaaacgaatgaataaattaaagaggagctagcaggccacatgtgcacagtgcagtaaccaatatatacctaaagaacaaaacctgatcgaggagaagacatgtcatccaatcatacactgtacgcgcacacacacatgagacatatatacaccgatctgatctgatccaatccttgcttaattcttctccggctggccggcctctcctatagcttagcttagcttgcgagacttcgttccactagtcttctcctaatttcttcctcctgcaaatatgcgtagtcttctgtcatcgtcgaccgtcaagtgtgtctctcgctgcacacggagatgcatgcacctcttgattgattgctcggtcgactgattgcttcttacacaccgcaactcgctctaattagttggtttagcctgtttagatttgtagtattagaatcgtcacattcaatatgtactagatttatttattttgagacgagctagagccgcttgattattgtcgatcggtactagctagtgctacttagtaagccggctagtggagtactcaatctctgctactactcggctagcagctggctgctgctgcagcagtagaacatcaagagaggaggttaattagctagtacgtagtaccttggctgctttaatgaactcgatcgatccacagctagctagcatagcagagcagcagtaatggaggagcaaagaggcgaggaggagtgggtgatgtggggatcggcagggagaagacgaatcatcaggcaatcggcgtcgtgggaggagcaggcgttcgcgcgcgatgcggcggccaacgccaacctcggcggctgcgtgtggccgccgcgcttctacacgtgcagcttctgccagcgcgagttccggtcggcgcaggcgctcggcggccacatgaacgtgcaccgccgcgaccgggctcgtctccgacagaggcagacctcctcctcctcctcccccagccaccaagaagaagaagctgaagcaccccaagatcagcaagctggcccttactatacctctttctctaaacctagcaccacctccaccgataatactacttgcagtaacgacatactactgctagcaagagatcaagaaaccatcaagaagagggtaccgagacagcaagtacaagtagttgcagatcaggacgaggacgaaccggccgggagaaggtacaagaggaggaggcttggtttggtggatcagctgccgtcgtcatgtgaaggaggagatcatcatcatcaggtactgatcatcacaccaacaacagccgccgcaagccctagctctataattgcttctgcttctgcccttgtggttggggatcagcagcatcaacaagcaggatcagtactagatctagagcttaggcttgggactagtactcctcctaaagctgttgtgcacgcttaattaatctgcatgaaattgattgacaagtaccccagtgtggatcactctagtctctccgtatatatatatataggtcttgttagctggcttcttcatttaatttctcagtttttcttccccttgtgacttctcttggatcaattcgtttcttaattagtttgcaaggcccagcatgcttacatctctctctccctccttccaaatgcgtgcagtgcatataaatatatgtatgccagtgttgtagaagaattaagcttgatattagtgtattgattacattctcttctgaagaattgtatccagtcgattcgatcatatcggtattaggattttgtattgtattgtatgtgtttgtatacaacttctatggtcaaatttgatcgatctctttttaccatgcattttaatttcttcctagtattatttatactgttcccgttccctccatatatacttaaaagctgatctgcagttctgaaccttagctcaatgtgtcgattactatcagttcaggctagactagaaattttacatgattaattaggagtatcaattacctagattcaagcaatatgattgatcatatccagccctattcctacaccgtgaaagttgaaattctaaattagatccttaaaataattatatatatatataaaggttataggacaatcagttatgtccaactgtgtgcatctttattaatcttacatattagtatagcttaacaaagactagctagaagctgatcgacagtacgtatagctagttagctagctagtgaggacgacgaactgacgaagtgatcatatctgttctttgtcttttgcgtgcacttccgatcctaattaaaagcgcgcatccatgcatcgttcaaagttggggcactgcatattgcagatgacattctgattcctcttgtatatagagtatattatacggattaagattttttttttgaaaagaaggcaaaagttttgcctcgtgtgtatactgatagagcaggggcaaaagataggtacatggcttctaaataggtaggaacccacaaaaagagagtcttaggtaatttttcccgaaacagcgaaccccctaaggtagacaacccccacttttgcctatgcagctgccactcttttattttggcgatgattgtgacatgtggggtggcgacatgttgaaagatactgacattgcactcgcaccaaatttcccgagcgatgaaggtcagaagaggcttgagcatcttcaccgggttatgaggtgtatgcgggaggtggtataccactcctccactgaggcatagtcatcccaagattgttagttcaaattcaagcctgtccaccactgaatcactacccagattcggcaggagagtctataacgtgcaaagaggtgcaatgccatttcctgtgtggtgtagtagaggggcatatttgctgatttgtccaactttttttagcctgtttgctgtccagactctgctttgtatgaccagccatgtgaagaacttgcacttcggcgatgcccatcatttccatattgtctcattgaaagttgaccttgccgcccccaggaataggagctggtaagctgattttgccttgtattccctatttgtggtgagtttccagacgatgttgtcgcgttgttgccctagctagcaggagagcattgcatatcaaggtccaaagctcgacgtatcagcaaagatgctctctcgtcgtgatatggtacaactggatgtctctctgacccacttgttggagaggagggcctcacagacagatctattcttgcttatggaggctgtgtagattgccggcgcaatcaatgcgagtgctctagaagcctgttgtcttcccatcgcctatggttatggtggtcgctacgctaccgcgaacagctctctgtccaaatgatcacctaacactagggtgccagcccaaggtcttattcgaaccacagatatcaatctgagggctcctagccctcctagctcattcggcttgcatactttttccaattaactttgcatttttctcccaagatatcatcccctcctgcccacaggaattaatttgcgtcttgttttgtctatagcgttcaggatccccttcaaaagcttcaggaccgtcatgtggtagatgggttatgcaaagaggactgactttataagagccgttcttccagccaccatcatcatctttccttgccataccacattaagattatacatatgtacatattttcatacgaaaaatatacacattttagttagaaattctgtaatcaacaaatgattttcttgtgtgtgtgtgtgtctttgcttgcctgcatggctgcagagagagagagagagagaactgaggagagggggcaactgtaaggtaggaacaacaacaaactggccttgcatgctggcattgctcttaatttgggcatttggctctagctacagaggatgatcgatgaattccaaaagttcagaggatgcatgcgtttgcatatggtgtttctctcgatttgcatagtaatatacggccagcagtacgtactagctaggatagatgtgtactacttatatatatatgatatatatatgtcccattagtaatccacacatggtttgcatttgctggatcgatgggtgctgtcctccattggaataattcaaatcaagacgccctgctagggcctcctgctgcctcaatgcatggattattcgatctcccatgaactggcactgcatgcatgccctacagctagctagctagctccaagactcctgactgctgctaatttattggcctgcacattgctactccggccgtatttagttgttttagcaaaaaataaaaacttttgacgtatacggacacgcatttgaagtattaaatgtagactaataacaaaataaattacatatttcgcctataaactgtgagacgaatatattaagcctagttaatccatcattagcaaatgtttactgtagcaccaccatgttcatggtgtaattaggctcaaaagattcgtctcgcaatttacatgtaaactgtgcaattggttttttatccacatttaaggctccatgcatgtgtccaaacatttgatgtgacggaaaaattggaggtttgaagaaaactaaacacagcctccctccataccattataagtgtagccataagttttcgtgtccaacgttaacgtt

SEQ ID NO: 80281 - DNA, 19428 bp, Oryza sativa
  unsure (1)..(19428): unsure at all n locations
ttagatgcacggttagagctacattagattttctttttttggtatatgtttgtgtggatgcactcaaaaagttgtgaaatctgttcttccaaaaagttcagtttcaattctgattgttgggatttcaaatcagataacagttagcagtgcatattaacaaaaataaatagtgcgtggggtattcaaagtatatgtctgctgtccgcaaaataaaacatgtcatacattcccccctgtttcccacaggattcacttccgcaggcagttcttgctggatatccttgtatttcagtcagacaagtacatcaaaagggaggagggggggttgttcaccagattcaacgagtgttatttttctgccatttttgtggagagttgatgacagctgggacttgatctgtgacatactccctccatacttataaaggaagtcgtttaggacaatgtttaagtcaaaccttaggaatataaatcataaaagttgttgagtttgaaaatataaaaaactatatgaatagatttatcttgaaaaataccttcataaatatacatatatcacttttcaatcaatatttttatagaaaaagaagtcaaagttgtgttttggagaccgtgtcgctgtcctaaacgacttcctttacgagtacggagggagtaggagtattatgtgaaattgacattgatgattccaaataaaaaaaatggctccttaccttgcaacaataaattatatggaaggtgaacttcgacgaagttcaggatgttatataaatcttgatcatacctgagaaaggtccactagttagaaatcttcaaatctgttgtatgatagatagtcaactgttggtccatggcttcatctgttaggagtgcttagtattttaagatgaacattgagttttcaacgcacaccggcacacggcacactgaacattaggcttcaaagtttaccagctttccttacaaattcttgtagtactacatatttctcggtagtgttcctttgtttactggaatagcaggtctgaaatactgctagtttggttcatcattccatgtgctgatatggtttgataattacagactgatggagtttgatctgtcctttttcgttaggtgactaggagtatgtcttttgctatgtccttgaagcatctgcttgtatattttagccatgacttctggaggtttaggtagtaggaccgtaggagtaattcagtaataactagatagtagcagttaatatactagtcctaaataggagcaggatataatttgttgagttgcttatggagaagaagttgttttcaataagagggaacaagttgattaagtttcccgattgcttgggacggtcaatagcagcaaacgatttggcatactagtaccagtagtataatatatagaagtatattgggttggtgcaacttcgtccattttgtcattggcttcaataaaactagttgtagtacagtggttgcataaataagtatttcagtaaattagtcctaggtgcaccatgatagtggtgaatttaaaataaagcttcagattcatactggtattgtagttgcttttaatttggtcttgaaaagaaaaccaaaccaaacctgcgacacaggcaggcagctagagggtagctgctctgctcgatccattccattccatgccgccgccctccttcccatcatccttaatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcgggggggtcgggggagcagctgcagctcatgctcatggtgcaatcaacagcaagaaagtcaactgcagggacgacgacttggaagctggcactggcagggccaccaaactgatggcgcccgagccggagctggaggaggaaggtgcacgccagatgttcgacgaaatgatgctccaggagcacgagatttgcatgaagggggtgaagcagctgagcctcaagtccaagagcagcagcagcaagaaggcgcgggggagacgcactgtgatccacaccgagccggtggacctgcacaacctgctgctccactgcgcgcaggcggtggccacggacgaccgccggagcgcgcacgagctgctgaggcagatcaagcagcactcgtcggcgtggggagacgccggacagaggctggcgcactgcttcgcgcaagggctggaggcccggctcgccggcacggggagccaggtgtaccagtcgctcatgtcgcagcgcacctccgtggtcgacttcctcaaggcgtaccggctgtacatggaagcctgctgctgcaagaaggtggccttcgtcttctccaacaagaccatctacgacgccgtcgccgggaggcgcaagctgcatatcgtcgactacggcctcagctacgggttccagtggcctgggttgctgcgcgagctcgcggcacggagaggcggcccaccggaggtgaggatcaccggcattgacctacctcagccgggattccgccctgaccaacacatcgaggagaccgggcggcggctgagcaggtacgccgacgagctcggcgtgccgttcaagttccacggcatcgcggcgacgaagaaggagagcgtgaggcgggaggagctgggcgaggcggaggaagacgaggtggtggtggtgatcagcctgtgccatttcaggaacgtgatggacgagagcctgcaggaggacagcagcaggagccccagggacgaggtgctggggaacatccgcaggatgcgccccgacgtgttcatccatggcatcatgaacggagcctacggcgcgacctacttcctgacacgcttccgggaggctctctactactacgcggcgcagttcgacctgctggacgcgacggtggggcgggagagccacgagcggatgctggtggagcgggacatcttcgggcgggcggctctgaacgtgatcgcctgcgagggcgcggagcgggtggagcggccggagatgtacaagcagtggcaggcgaggaaccagcgcgcggggctgaggcagctgccgctgaatccgcaggttgtgaggctggtgctggacaaggtgagggacaagtaccacaaggacttcgtggtggacgaggatcaacgctggttgctgcacaggtggaagggccgcgtgctctacgccttgtccacttgggttgcccaacactagctcttagcctcttaccaattatttataccaattttcagatatgcacatcataagtacaaccatgtctatgatcgatgtggaccatggttgagtaaaccctattgtatgtttcttgtatcacatttttgctcctccttggtcatggtgaccactgaccactacctgatttactactccagttaatcctataaataaataaaatggccatagaggaggaggacctcaacatggagacagccttccctgatgaggtactcacggtcaatgaccttttcaatttcaggatcttaatggacgagagtgtacgttgtcacagacagcaggagtgccctgggaaatcgtcctcgacacaatactaacataggccatgtttagatcacaccaaacttcccccaaagtcccaactttccatcacatccaaaactttcctactcacataaacttctaactttttttccaaactaccaactttccccaaacttctctccaatttcagaaactaaacacagccatatggaagatatgcagctggacgtgtttgtccaaggcattgtaaatggctcccaaggcatcacctttcttgtcacgcacccgagagccaactgcggttggtgctggagcaggacatctttggatgggatgcccatgaacgcaattgcctgtgaaggagggaaggaccgggtgggcatacaagcagtggcaagtcaggaaccaacaggcaggctttaggcgaattaattttgaaaaatatattgtctattcttttttctcagaaatactcaggatacaatttttttggcacaaatataaagtcgatatcgctgaaccgttgtgcgaaaatgataaaaatgtgacaacacggatggtcttgaacagcgacggcgcaagactgctcgggctcacatggcgcgggtgtgagaccgagcggtctcgcacggcaaaacagcaacaacgttttggaaatagattaattatccgattagcgattaattaacaataataagtgattaataattaattaatcgctaatcaactaattaatcaattagaatgtcggtctcgctgtttggccatccatccgcgtgatacagagcagtcttgctccgtcgccacatgacaccatgcgagactgtccacgtcatcatgccctcgtcatttttgcgcgacgattcagtgatatcgacggtatatttgtgccaaaaaattattgcatctcagatatttttggggaaaaattaaatggaacagtatattttcaaatttaatttggcttgaggcagctgccctagaacagggaggaaattatgatggttaagaaacactaccacaaggattttgtcattgaggaggatcaatagtggcttcttcagggctggaagagccgcatcctctttgcccactcaacatgggttgcacatgactagtccagttctcgctgtcagcattccctctacaatggcggatatatccccttcaaaaaaaatacatataataactttgtattcccatgcaaaaaaaaaacatatatatttaactgtgtgttgatacggggtaacaagtatttttttttcatgttctaaaattaatgtttccaaggatagtcatgttgaacaggtaaagaaaaataaaaacgaaggacgtatattattaccttgtctgcattctcaaagcaaccttggagtaatctccatttccatgtcctatttgtactaggttattggaatcatcacacattaggttggagttatggacagggtatttgctcctgcctcatgatatgacgagcaagagcaaaggctaccaccattgaatgattatcagcatggccaacccagaggatttcttttgggaggccctcctcaaggagaacgaagcaccatccccatcacctgtcttctttgaactccccccaacacccctcgccaacagtgatggcagtacagatccctcgtcattgttggacaaccaacttctctcctacgtcactagtatgctcatggaggatgagatgggttcttctgctgctgtcaccaacttgcagtgtgtcaacaggggcagcacagaggaggccaacaatatgttgccgggcagtgaagtggttagggcgttcttgaagggcatggaagaggccagcaagttgctgcctagaaacaacagcttcagaatgctggagacggtggatcaagtatcaagtcatggtcattgtaggggaggaaagaagaaaaaccatgacagggatgagcagcagctggaggaggaactggggaggagcagtaaattagctgccatgacgaatgcagggacggaggaggctggtgctcgcgagttgctggacgaactgatgctgcactcgcacgagacatgcatcaaagacatggagaagctgcgcatcgacatggacaatgaggcagataagaccatcaaaaagaagggcaagaaaggcagtagtagcaaggtggtggacttacggatgctgctgatccagtgtgcacaggccatggcgacagacaaccagcaatctgcaggcgagctgctgaagaagatcaagcagcacgctttggcaacaggcgacgccatgcagcgagtggctcactacttcgccaaggggcttgaggcacggctagctggcagagggaagcatctgtatcagaatcagatgcgcatgtcgttggtggagtacctcaaggtgtacaagctctacatggcagcctgctgcttcacgaaggtggcactcatgtttgccgccatgacaatcatgcaagctgtgcaagggaagaagaggctgcacatagttgattacggcccgcgctgtgggctgcactggccagacctgctccgccggctgggaagcagggaagacgggccgccggaggtgaggatcaccatcgttgacatcccccagccggcgtttcgtccatttcagcgtattgaggaggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgccaccaccccaagggagagtgggctgcggctggcgctggagcagaacgttctggggccttatgccctcaacgccatcgcctgtgagggtgcagacctggtggagcgccctgagaagtacagacagtggcaggccaggaaccaccgtgcaggcatgcagcagctgaaactgagaccagatatcgttgatacaatcagggaagaggtgaacaagtaccaccataaggactttctgctgggagaggacgggcagtggctgctgcagggatggatggggcgagtcctctttgctcactccgcatgggtgccacaacaacaagacaattcctccggatgactgtttggttttttttttcttttcttctttttctgcataaaaaatgcaagttagtagacttatctttggacatgaaaagtgcatcgtgtgcacagaatgttacagcgatttgcattttagcagcctggcaagtttctttaattatgaacgtgctagtattgtcaacatgtagagcaaggacacctagagtaatacttaccagtactagaagtactttgattgctccagttgcaacatgacctgtttattttccttgtaacagccatcagccgtataatatgccaacaaggaggagaaggtgggtaatgaatccaagccaagcatggaaaacatcaaaccctgttctcagcaaaactaaaacaccaccatgctatcaatcaccaggaaaattgttgggtatgaatgggttgaaggaattgatgcctccatccttttccgtcctcttcggccttaccaagagcatcacaagaaaatgcaaattagaaaaatgaataatactggaatagtgctgctgcatattatggttgtattctgcacttgcctggattttgcctctacagactgcagtctacagacattatgtgttgagtcctttcaacttgaagaattgactgagaacagtaacatagttcagggtgaagttgttaagtttccttgcacctgccctttttacaatgatttgacatctgcacatatttatctgtcaaacagcttggattgaatttgcaaattgcctttgcattatgagaatatacaatacccaggtcacaggctacatcattcactatgttacatggtcctcagctacatcattcaatcagataagactggtgtagttttggctgcttccttgtatcaatgcaatagagtcctctgttctccatcaaattatatttaatgatcattgcttctttagataggacaagggaagaagtggctccaaaaccaagatttgcagattgttaaggatcaaagaaacattgaggaatggaagggccaagccatcagtaccacaaggtaccagtgctcctagcctatcagattaaaattctatactattattgtgctaatacaacaggattccagggtatacaattcctcagcggtactgataaaccagcacaattgttagtaaagacatggtttccaagttcatagtagaaagtcaattaccagttatcacaacaatcctcctggtagaaattctgaacatctgatcaccttctcaacatggcatgagtcgatactattgtaaacaaattaatcaatttgaatgtcggtctcgctgtttggccatccgcgtgacacaaagcggtcttgctccatcacctcatgacaccgtgcgagaccgtccacgtcgtcnnnnnnnnnnnnnnnnnnnnnnnnnnntcagtgatatcgacggtatatttgggccaaaaaaatattgcatctcggatatttttggggaaaaaataaatgaaacaatatattttcaaatttaattcgggttgaggcagctgcccttgaacagggagaaagttatgatggttaagaaccactaccacaaagattttgtcattgaggaggatcaatagtggcttcttcagggctggaagggccgcatcctctttgcccactcaacatgggtagcacatgactagtccagttctccctgtcagcattccctctacaatggcggatatatccccttcaaaaaaatatacatataataactttgtattcccatgcaaaaaaaacatatatatttaacagtgtgttgatacggagtaacaagtattttttttcatgttctaaaattaatgttttccaaggatagtcatgttgaacaggtaaagaaaaataaaaacaaaggacgtatattattaccttgtctgcattctcaaagcaatcttggagtcatcttcatttccatgtcctgtttgtactaggttattggaatcatcacacactaggttggagttatagacagggtatttgctgctgtctcatgatatggcgagcaagagcaaaggctaccaccattgaatgattatcagcatggccaacccagaggatttcttttgggaggccctcctcaaggagaacgaagcaccatccccaccacctgtcttctttgacctccccgcaacacccctctccaacagtgatggcacagatccctcatcattggacaaccaacttctctcctacgtctctcgtatgctcatggaggatgagatgggttcttctgctgctatcaccaacttgcagtgtgtcaacaggggcagcacagaggaggccaacaatatgttgccgggcagtgaagtggttagggtgttctcgaagggcatgggagaggccagcaagttgttgcccagaaacaacagcttcagaacgctggagacggtggatcaagtatcaagtgatggtcattgtaggggacgaaagaagaaaaaccatgacagggacgagcagcagctggaggaggaactggggaggaccagtaaattagctgccttgacgattgcagggacacaggaggctggtgctcgcgagttgctggacgaactgatgctgcacgcacacgagacatgcatcaaagacatggagaagctgcgtatcgacatggacaatgaggcagagaagaagatcaacaagaaggacaagaaaggcagtagtagcaaggtggtggacttacggttgctgctgatccagtgtgcacaggccatggcgacagacaaccagcaatctgcaggcgagctgctgaagaagatcaagcagcacgctttggcaacaggcgacgccatgcagcgagtggctcactacttcgccaaggggcttgaggcacggctagctggcagcgggaagcatctgtatcagaatcatgtgcgcatgtcgttggtggagtacctcaaggtgtacaagctctacatggcagcctgctgcttcaagaaggtggcgctcatgtttgctgccatgacaatcatgcaagctgtgcaagggaagaagaggctgcacatagttgattatggcatacgctgtgggctgcactggccagacctgttccgccggctggggagcagggaagacgggccgccagaggtgaggatcaccatcgttgacatcccccagcctgggtttcgtccatttcagcgtattgaggcggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgcgaccaccccaagggatagtgggctgcggctggcgctggagcagaacgttctggggccttacgccctcaacgccatcgcctgtgagggtgcagacctggtggagcgccctgagaagtacaaacagtggcaggccaggaaccaccgtgcaggcatgcagcagctgaaactgagaccagatatcgttgatacaatcagggacgaggtgaacaagtaccatcacaaggactttctgctgggagaggacgggcagtggctgctgcagggatggatgggacgaatcctctttgctcactccgcatgggtgcgccaatcacaagacacttcctccggatgactgtttggtttctttcttttcttctttttctgcataaaaaatgcaagttagtagacttatctttggacatgaaaagtgcatcactcttcttgtgtgcacagaatgctacagtgatttgcattttaacagccaggcaagtttctttaattataaacgtgttagtattgtcaacatgtagagcatggacacctagagtaatacttacgcgtacttctagtactttgattgctccagttgcaacatggcctgtttatttttccttgtaagagccatcagctgtataatatgccaaaaaggaggagaaggtgggtgatgtatccaagccaagcatggaaaacatcaaaccctgtactcagcaaaattaaaacaccaccatgctatcaatcaccaggaaaattgttgggtatgaatgggttgaaggaattgatgcctccatccttttccgtcttcttcggccttaccaagagcaccacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcatggattgaatttgcaaattgcctttgcattatgagcatatacaatacccaggtcacaggctgcatcattcactatgttacatggtcctcagctacatcattcaatcagataagactggtgtagttttggctgctgccttgtatcaatgcaatagagtcctctgttctcccatcaaattatatctaatgatcattgcttcttttgataggacgagggaagaagtggctccaaaaccaagatttgcagattgttaaggatcaaagaaacattgaggaatggaagagccaaggcatcagtaccacaaggcatcactgctcctagcctatcagatgaaaattctatactattcttgtgctaatacaacaggattcctgggaatacaattcctcagcggtactgataaaccagcacaattgttactaaggacgtggtttccaagttcatagtagaaagtcatttaccagttatcataacaatcctcctcatagaaattctgaacatctgatcaccttctcaacatggcatgagtcgatactactgtaaacaaataagttccccttgtcaggtgcagtagaactcctgaacacccttgcttgcgacagttgcatcggtaaacaatatgcaatggaatccttgcgaatatataatctaacacctgaaaattaaagaagaaacaaagaggaaggggataaagaaaaggtcaacatgtgacatcaattagtgtatgactatttcactggcaggttgtttacagggtttagaaagcaacaggccagttgggtgttgagtctagtgagtgttgatgctaatgtgcagaaaataggtagaaagcaaacaaatataaagccgctgacacgcaagttgaatagggatggaatttgatgattataaaaaaattctcttagaaaacatagtgtagatataacactgtggcagcatttttgtcatcttttctatgtggcatttgcttaaaagatcctggaactacactgtctcatatcacacagaattgtatgcaaaatgaccatagggcatgcatgcacgttctctagtaattaccaggccatcattgctttggtaactcttcctcaccaaaccaccttgggggatcataaccatgaccacctgtttgttggaaaagaaatttaatagatatgatatgatgcaggtgcagactgcgactgtcaaagaaatcaaaagaactatgaaccaacgaaaaacctacataccaagaggattacaatggcatagacgccaagctgtcaagattgtaccctttgcaacgccgtattttttgtatgcttgcatagagtactggctgcaagttggcacataacggcagcttgagggtagtaagggcgatatttctcctgttcacataaaggagagcaagctatagagatatagttgatatcaaaaggcaagggcgcaaggccaatgattgctgcacataaatacaagatgaaaacagtaagaatgaacttacttttgtaaaattttagcatggatagtgccacattgactcccaagtcattgacttcctcttcttaaaatcaaataaagcacaaaatgcactcatatcgatcagttctatagttttactcagaaaaaaaaacacaagtttgtcttccattaaaataaagcccaatctgcaatctcctaatcccacaatgaattgcttagacttagtcctttacttaagtacgagatacatggattgggaaatttgcgccataatattccatgtagcctatgtacattttgctaaactgagttctgtgatgactcattatgaacttctgcagcacattttgcaggcattatgcacagccattcgcagtgtgtgaaagctcaaaacttagacacactattgtaccttgaaagtaaatgtggtgtgcaatgtacagcctagaaaggacataaatacttctacttattaaaaaaaagaattgaaatagtagtccctcatgtaagatacatcaaaagtttataaccacctcaagatctgagcctgggtataagaaatttcactcaagaataaaaaaactgtaaaataaaacatttgaccgctcctacaatttgccaatctccagttaccattagactaaccttcatcagcagcgcagtagacccgcatcgttgggatccttctcttgttttggtagggaacaccgaaggaaactataaatgaaaaaccaagaaaaataaagaggtgggagaactccagtctgttgatgcaaggaatgcaggattacacaaacagagagggtagcggaggagaacaaaaaagatgaggcataatgatgaaagaacacacaaagttgtttaaacacagtgaaattatatggcactagatagatcatcaactacaatttcctacatatatataagcaggtcagcaacgtcccaattaatgtttacaggcatctattgcaactgacggattgtcagtgttgcttcacaaagtaataaaccaaattaatcagcaacgtgcatgtgtgtgcatactgctagacacaattggccaataaggtagcaaagacgagtatataggggtagtccggtagatataacaattagctcgctcactgaattcttctgttcttcccatgcatcatcttgtactacaagctaattccattgtcagttggttaaatatggagtagtggatagctaattagacaacatggatattactagatcaaagaccaagttatcatacatatgcatgcgttggctggctcgccggatggatggatctagtttgatctctagctacttgttcagaaatcagaagaaggcagctgctcccgcctatgccgcccgccaactccagtacccccgcgcctccctacagacccgccgcctccccgtgctgccccatatctccccggaccctacgcaacctcgactaccacaagccccagcccacgccggcgccacacccagtgatcgatgcattcctccccgagtcggctaggagcgagagggggagggagactcacgtgtggttccggcgagaggccgcacaggcgagagaagggcggaggcggccatgcccccgatgtccggtggtcggagatttttcacagatttcttcttctctctgatttttttttttcaaaagaggagtgactgaactggataagatcgaacgtccctagctatttgctactccctccgtttctaaatattcgacatatatttaaccgttcgtcttatttaaaaacttgtgaaatatataaaaccatatgtatagataaaagtatatttaacaataaattaaataatagaaaaagaattaataattacttaaattttttaataagacaaatggtcaaacatatttaaaaaagtgaacggcgtcgaatatttaaaaatagaaggagtaatatactatataatatattttccaactacccatatatttctatcaattttttgaagatctatatatttgcagtgattttaagcagatgtttgttcgatttaagtgtagctacccatatattcctctgcatagaaagaatcacatgagacatactccctccatttcaggttataagacgttttaacttcttttaagtttgactaagtttatagaaaaatatagtaatatttataatactaaattagtttcatcaaatcaataattgaatatattttcataataaatttgtcttgagttgaaaatgttagtacttttttctacaaatttggtcaaacttaaagcagtaccaaagtcaaaacgtcttataacctaaaacggatagagtatatagctaaaagaaagccaattgaccttatcttctcaccaaatagaaaaggaaagaaagatagaacccgccacactcgttgtttcaggtgtcgcggcagtggcggaggtgtggctgatgggcggcgcagggcaaaggagcgatgtggcgtgggtggatgggcgatgcggctcgggtggcctggcctgacgcgggcgaccatagctgcatacacaacgactacgacaatggtcgacaacttccggatgggcgttttggcgttcctctctcctggatggctattttcaccaggattgtttaggctcagtgtagcatttgttcgaaaaagtctcttaatataggccagatctgattcgtctccctcaatcgtaaaaccagctttattgactcctctaactattgatatcgtttaaaatgactcccttggctatttctagagcggttttcactgatgtgacatccacgtggcagccaggtcatcacatcaagtaaaaatatagagtggggcccacatgtcatcccctctctcttcccttcttcctctacccctctctccccgtatcaatcttctttggtcttcgcaacagcgggcggcatcaggggatgggggtgggggaggaactcgagggagctggatgacatcgaacgagccaaggtgtccctctctccggtagcatcgatattatattctcatattccccacactcacgagcggtcggccacttccctacacctagagacaagttctccattggattctccactactacggaaacgattttctatacgaggaccctaataggttgcagtcggattgtaattggtcgcgtctgcaataattgaccttcattttagcgtgcggttccttaagacgcccgcatgtaaaaatctatttttgcatgtgagcctcttaaggaaccgattgcaatgagcctattttcgtatgcgggcctcttaagtggtccgcatgcgaaaatatcccctctcctccaaagatttttttctcccctcctctttcttttccttcttagcaacttgaaatttttttccacctcctatcctctctctcttcctctcctctcctctcttgatactattttcacctcctccttccttctttctttctcttctctcctctcctctcctctcctctcctccgagcggccgggagcaggcggtggccagctcgacgacctcgggtggttgtcgacgacaacaaggaggcagccgggagcgctacggccaggagttgctgcagtgggcaaggggctcctcctccaccaccgggcaggaggcgtggcactgacgtatctggcaccccctctccctcccgcgtggatccggctgctgctccgcccctacacacgtggatccggcggtggcggggcggatctggcgcaggcgataacgagagtggcggcggtggcggtggctgacggcgggagtagcggcagtggctgcggcgacctcggcggcggcaggcaagggcaatggctacgaggattttggtggtggcggctgcgatgacctcggtggtggtggcctcagccttagacggttggcaagcgtggggccgccgctggcgaaggagtggggagtggcggggctaggttttttctttttgaaatatttttcacgattttttgttgtcgcatgaggtcggcttaagcacctgcatgtgcaaaatcgtatttttgcatgtggttgtgctggccgtatgcaaaagtccgattttcgcaaaatctttgggtgtaggtgggctgcccgtcaacatgcaaagttcgattttggctgcaaaccgaattctgtagtagtgcgcgattcagcggttcggtgatgccgccagtatggcggatgctctctgctcggctagaactagtgagcgtacgtactcctctcttcatgcgtcttcgaggattatgggtccgtgtccagtggcatctgcagcaagcagtccttgcctgtcatgtcggtcttcctcgtgctcataagcatcagtgatcatctctagcttgatgcatgcggatattggatcgcgtagatatatatgtacaggacggatggagtatgtcaatgtcaggagctcgatcgttcggcatagccaaagctcgccggagtatggccggtgatccatcgatcctggccttgtacaagcaagggtcaagggggctgatgctgaaccttgtcttcgccggcatgcattcgaactcgagcggccggcggcgatggaacatgcaagcagctagtcgcaggtcatggaccccgaggcatcttcctgatgctggtggccaacgtaaatactgaaaaagatcgatacgggagctagggagatggcagagaaagaatgagagaagaaaggggaaggaagaagaaaaatgtggcactgatatgtgggtctcacatgatgagtcagctagttagactgaatcaaagcgccgtcaacaaaacagctttctaaaactgcatagagagtcacgttatactgtttcaatagttgagagtttaagatatccggtactacgatttagggatatgaattagattgaaggtgagagtcaaagtggacttattccaaaaagatattcgaatttacaatgtgcttgataactatcttttttgtcgagtttctaagtgttaaggttttttccttgttattatttggtctgtcactaccatcaaaagtacctcaagtttgttaacattaataccgtattgttcatatcaaaaggttgttcattttattgctaaaattaacccaaccaagttttaactttaccgacgtttgggaacgtaacaatctaacattaccaattaccaaaacttgtttccactaccaaagtttggtaattttagaatctctctctcccaaaaacttaacaaaagtaacaaactaaacacaacttacacttctcaaccttatcaaatatgggaaatgccaaaatttggtaggctaggttaatttatttatgcatcaaagtcaataacccccaattttggtaagacagatttattgatgttacgaaattttgataattcagagaaccgctgagcagcgccatgctgaactattgataatatctttgcatttttataaacataaagtattcaattgttttcaccgagtctacatgagtagggtttcggaattttaaaatataaaatatgttaatactccttccgtccttaaatatttgacgccgttgactttttttaaacatgtatgaccgttcgtcttattaaaaaattaagtaattattaattcttttcctatcatttgattcattgttaaatatacttttatatatacatatagctttatatattttacaaaagtttttgaataagacaaacaatctaacatgtttaaaaaagtcaacggcgtcaaatatttagggacggaggaagtaatattctatatgtgtaatggtggttatgcatatgatgcaagcgttttggtgttgggaagtggacaagaaaacggttgatcacttttgtcacctcccttgcatgatcaaataaaatcacttctctgccagaacgtactgtcactactagagaaaccatctttcatcggttgccaaaaacaacaatagtcccggttgcttaaaaaaccggaactaaaaagcatttttagtcccggtttaaaagtgcaatgatctttagtcccggttagtgttaccaaccgggactaaagatcatcttttgtcccggtttttttattggcacgacgtggcaggtctcctaatatttttaatcccggttggtataaacaaccgggactaaagatcagatttttagtcccggttgtttatacc

SEQ ID NO: 80282 - DNA, 16092 bp, Oryza sativa
gatgccagggccgctcctggcgccgtacgaccaccaccaccgtgggggtgggccagcacagcggctgccaccacggcggccaccccagccgatccatgccgcaggggagttcccgcctgctatgctgcaacagcatccccactaccatggctggggtggaaacttctcgtatggtccacctacccagccgccggcgccggcgccgccgtatgttgagcaccagaaggctgtcaccatccgtaacgatgtgaatctcaagaaggagactctccgggttgagcctgatgacgagtgccctggacgattcctcatcaccttcacctttgatgccaccgtcgctggaaggtgagatttgtgatgcttgtttatttatatacgtacatgtgatgtactactccatacctatacatacatgttgtaatagtgtagcatataacatgatgagctgatgaccgtagctgtgatatctacagtttcttgttaccattgaaatgttaatgtttgttttttctctcatgttgaccttgacctacaatttcatgttggctccttctatgtgttttgtcaagaattttgatgttccctatcttgatgctgatgttttgtgagattcatctttctctatattatgtcacactcaccaagaaataatcgaactaaaaagggaactaaagaatcgttgtagaactgaagtacatttctagcagattcttgtagctgaacagcttaatttctaggggtgataaaggtcattgtggaaatttatgtttttatgggtccatgggcaccctagaattttagttggtacagtatttgtgtttgtgaaccaaggagagcccaacaaatatggaagtagagctgacattatactctgggatgctaaggaattgaggaatttgagcagtatgttcagatcgacaccatgtaggtggagtttcgtttggcttaattggcgaagtttattacaatggtgcctgattaagtgattattttagtagttccatgatgtgagttcgttaatattaagagtcagtttgagttttaatttgagtcggtggtctatatactagcagagtgttttagcaaatgggattaaccaaaggccatattattgtagcattattggacaagattcgcctggcctgctcggttatgttggttttctgcgtgtggttgggcctgtgcacgttggagtccatgctggcttggtctccaggcccaataagtctgctcatagtctttgtgcagagattagattagtttttgctctcgtgtgtttgcctatgtttttgcccatcgtgttgatgtgaaaagaaaggccgtacctgtgcattgctccatgacatgacccttagttcctgctggttccatatattggttaaagttttgcacttttgccatactactaattatgttggttctgcctactggagtgctagccacggttttggtttacttcgagtgctttgttgttctaaccttaatttgtgtcatatatatttatgctttttggactcttcacattgcatccattcagagtaaaaaattgctgctctttgttggtaccgtgaaagatagaggggaatagggtacttgctaccgggtgctcaccatattttgatgttataacttactgacaaacaaaaggatggtaacaataagtgacaagcggcaaagagaattacaacttccattatctttgaaccatcaaaagtgaatgttcacttgcatattgaattctgtttacagaaaattaagcccaattttttgtgggctgggcccttcatggaccacagttggccatagttattaattctttattatgaattttcatgtcatattataggataaatatctgtgaccaacatgccatattgtagaaatgcctaaatggtttcccagcataatttttttttatcaattcttgtagtttgtacgttcttaatatttttgtgggaacttaagatgacattcagttagaagaagtgaatttgtaatgtaggcgccattgctctatatcatgtgtgaaagcttgaactttggagtcaaccgtttacctaattttctggatgatctaggttttgctactgaaatcaaggaattagctgccccagttagtggtgaatgtaaacaatgtagctgttgtttagccaagggcagtgctaggatgtacagaatcatttaaagccatcttttgttaggctttgttcggcagcagttgattgggagaaaacccccttgttatccgtgccttcctgaactgctaagtggtgcattttttacaaaagatttctacaggaaaattgctttaaaaaatcatattaatccatttttcaaatttgaaataattaatacttaattaattatgagctaatggctcaccttgttttgcgttatcttttcaatcttttccttttcatctcctctcaaacacacacttagtcctcactttgttttagaaaaaaatagatcatgcttttaagctatcatattgtgtcttgttgagttattagtgtgcatcttttatggagtagtagaaaaatatcccatgcttgtagttagcaatggataatcagtatcatctccatttcttgctttgtagttcgttacctttagaaacttgttttctttcctgtttctgtcttcggcatcttttttactgttcgtttttctcctagtacctttgtagactggtgtctacattagattgtattttgaagatcaatgtgtagggacaggaggctttattttaattggtaatcactagtttattagtggtgctaattgtttgttcaatcggtataatatttttatggtgatcaaagttttctttgtctgtacattgtccattacatgagttgttctcctctgatgtctaaatatatatttttgcaggaggtgtgtaatcctttactctatctctatagctgtgcatactgtcgactgatttgaagttacttttagttgattttaacttgtgtttcttcctttttttaatgaattgtgtttctttgttgaacagcatgactgtttacttctttgcaaaggaggagctgaactgtaaccttacagcaacgaaagaagatttactcaagccagtcactgtaacatttaaagagggtcttggtcaaaaatttaggcaaccttcagggacaggaattgacttctcgttgtttgaagatgctgaattatttaaggagggagagatggatgtatatccacttgcagtgaaggctgaaacaacattctcaattggtcaattctcagaaggggaagaacaaaagtcacaaactccaaattcacagatcacccaggctgtatttgagaggaaggagaatggggattaccatgttcgtgttgttaagcagatcctttgggtcaatggcacgagatatgagttgcaggagatttatggaattggaaactctgttgaaggtgacaccgaagggaatgatcctggcaaagagtgtgttatctgcctatcggagccaagggatacaactgtcctcccatgtagacatatggtaagtcttgaaacaggctcttgagtttatgtttgtcctttattttactttatgctgaaattatgtcctacaactcttctgttcatgttttacatagtagatgcctagatcgtcatcgtcgtgaaattttcggaatgacaaacccttttgacattttccttatggtgcagtgtatgtgcagcgagtgcgcaaaggttctgaggtaccagaccaaccgatgtcccatctgcaggcaacctgtggagcgtttgctcgagatcaaagtcaacaacaaaggtgaagagcaacagcagcagcagataccacaaccaccaccacctccttcaaccgcgcctccgcaccaacagcaagagtcgcaagcgtgatcgcatttgaacttcatacatattacatacactacttgatgtctggtttgctgcctccatatatacaggagctccccttgaataagtggaaaacagggagaagacatgtgcgtttttagtatatgtgagcacaaaagcttgctgcgcgcggtggcttgcaaacttgcacttcagtgctgggtgtgctgaggatgggttagttaataccctgcatccatgaaaacaaggtttgtacataaattctctctacttgtactactgcgacagaaattctcacgatttgtattactgcggctgatggaagtggagtgcgtgtgcggtattggctatagttctgtcgttaacttgccctttgaggcaacagtatgcgtgtaattatctggcaattactcccatcaaacaagagctaaatggatattatttccccgtcaatggctatctcatgtatcagcgatcaaatatatctcactctggtcctgtgacatttcaagtgtcgatggaaactgatcaagagaaatatttgttgcgggactttacgaagactaaagcaaatcaaatcaaacatacaaagaatattgaattatagttaaaaaaaaggacagcaaaattatttgtggacctgctctattacagcccgtaacgaatataatgctaaaagaacgtatgatatgcaataaacactttggaaaggatcgccaaatttgatactatattaaattacacagtaattaatgtttgtaatgtacttcctaagctgtacgacaggaatactattactgtacgaaagaaataatatttgtattgcacagtaattaatgtttgtaatgtacttcctaagctgttcgacaggaatactattactgtgctcccttttctttttctgaaacatgcctagcttaattatattattcacgttgccacgtacaacgacttttcgtcaggccggcgaatacagctggccgaagtatattaagagaaaaggagaagctatacaacataccccaacaacgggcacacgctcgtagtgtgtcaaagcaccgcctttataaacttatttacaagggctaaagtctccctaatgagtacacttgggcctcggtcgtcggactaataaggccggccgacctccttgtctcctattcttctgccatggtcgcacgaagttgaggcaccatggaggcttttccgttgaacacccttgcgttactctatttccaaatcaaccaaattacaaggatgaccctgacattgcacgtcttgcaatcaattttagcaatagactttcaggtggagaaccaccagcttggaaaatctaaggacggcgcacataatgcaagtcccaagcaatcccatacccactcccacatttgctgcgttaaagagcagccctaaaggataagttggcaagtctcgccgtcgttcgagtagaggtggtatactagcgcgaggtgccacccacggcgctgcaggttgtctgcagttaggcaagcgctgcgtgcttcaaggaacataaagaacttgcgtctcaccggcacaagagacttccagatgatcctgccaagcgggcacgccgtccttccgatcgacagtagcgagtaggctagctgttcgcacagagaactcgccatttgacgccgccttccatacaaccacgtccctgctcgtagaatcgagggagattcttgcgaccatatctgaaagcaccagatactccccaagggcttgtatggataggccatctctaatgtctgcgaccgaggaatgtcatggagggcagaggcaaccgtaattacacagtacttgatgaaggagaagagaattggtactatgttttgcgctgaccgacccaccatcatgcagctatttatcctttcaacttgatgcctgatgcgaaactgtgcaacaccttttaatcggccagcggcgcaaaccttgtccacaagcactccggctgtgttcggcacaacgaaatccacatacaatgacttgatcagtgaagcaacagcgcaagctgcagcatgacaaatggcctgaaagtagataaataatgttgctaacccacggcataccgttggaacgacataattattagtcggacccctcagccctagtgcgcatggtggacgcacttcagcttgcgtgcatactgtacatcttttttgaggggaagcaattcacgcacactagctaactactactccagtagctagttctcctcaccaacttaatgtacgtgcatgcatgcatttgccatgggtgacatgacaagtgctcctcactcacacacccctagattatgaatgcctgtccttttgattgcacataactataaacttctctataacggcgtgcttagtcatttaagatgctgttgttatagctagactcagtggcatgggctgatgcctcactatcttatagtatgaaattttttccatcccaaaatatgactatatgtaatagtacctcgaaaatatcataaagtatctagcatgatacatgtgggtagtagatcaagtacatatccactttgatacctatgtgtactactaagtatcgtaaactatctagcatgatacatgtgggtagcagatcaagtacatatccactttgatacctatgtgtactaagtatggtatatgtgggtctgaattttaacatgtatgagtacgcagtctgatacctaggtatcacgtataatacctattagctctggtatttgttgtactaagcatgaaacatatatgtattaggctgatatatgtgggtacctacatatacttatagatatttttcccaaggttcttgtcatatttgattccttttttttactgaagaaagccggatgtagaatttggacaacttgtttattcaatactcctttctaataagttccagcaccctaacaccttttggtgattgagatcaaacacatccaccaacaaaaaaaaggaggggcgatacctttgtcgtagtcggcagccatggtgtcgtcaggggacggaggtatgcagcggtggagaggagctgacgcggaggaggcagcatgcgcaggtgtggggagtagaacgggaggtgcttgggaggcgcatgggtggaacaacgcggtagagcatcgctagagggataagcgatgcggccgcgttggaggtggttccggggagaaagtggagtggagatgtggagggaacgaccgagagatgggggttggggggtgggggaggggggacgcgtgcgtggcatggatcggggctgcggcagcatgcgaaggaagagaaacgcgatctaagccgttggatttggcgatccgacattccgtatttcatgtgtctatcaagtttcgagtcaccatcatcactacgttttttttaagtagtatagatattgtgacactgtgtgatcaagtgctttagtaggctcagtgtatgaagtacttcgctaaatggcatcattctgcattcaggcatcaacttctagagtttcagacatgacgccactgaagttgaacttgaaatgagtgaaatgggctacaagctacttcacaatttcttcattgtcttgatttgtttttcagtatgatgattttaactagaagatttgagctagcataatgtcaatagaagcacgcatgctatccagcttgcagcttgctgatggacgtatgaactagttcaaaagaaaaacaacttctaccagttactaacattgcgttgaaatattcttatttacagcaactccctcatcagtcttcagaacaaccagaataataaatgaatcccataaactaattaagactcgatctcgtcaaagttccatcgacggaataatacatgatactacgtactatcttagagtagttaagcaaaggtatttttttcgataatggaagctttattaaggctcagccaaatacaccaagatgatacattccaactgagcccaccccggcctctgcataaaatgcacatagccaaacaaaatagcaaaaaagaacatatctagaactccatcacgagaccgagatattaatgactatctattagatcaccacagatactcctgggttaaaaactcccgtgccacctggcccaaatgtcgcgattaccactgtaatagtatccgaagacccggtttgtgaaggatagcccaggtgcgaatccaccgggtgactaaagtaataacctataaaggagaagcaccaacttgttataaaaaattaccctaattctgcttatcaaaatggaccaataaatagctgttgcacccagtaaaagtagatttctcatgtctttaggaaacatgtaagccaacgcccaatcatatgaatcacatttcgtggaggttgtaagttataagccatatgaataaccgaccagaccaagcgagcaacatgacattggaaaaacaaatgttgaacggtttcgtccttataacaaaatcaacatttcgtaccacctttccatttgcgcttagctagattatccttggttagagttacaccctgacgtagaaaccaaaggaaaatcttcactctaagtggtaccttaatcttccaaatacgtctattgatattcgggatacccatatgaacaagagctatgtaaagagaattgactgaaaagaccccataggcagtgagaatctagcgaaattcatcttgctcttgtgacaacaccaaatcagctatgcgaggtcataagttatgccaagcgactaattttgctccgattaattctcatccccatgaaaagcttggaggattttttttgaaagatttgtgagatagttgactgtttatgcctagctatgttatagagacaaggataatgatctctcaagaaggcattacccaaccatttatcctcctaaaaccttatttgagagccgtctccaatacaaaaggacccaaacctaagaaaatcttagttggctttcataagactagcccaaaaaagagtatcccgctttccaaaaagcctgagataaaggttgtgatcccaaatatttattgcgtagcatttgttgccactttccgcctatggtgagcaatttgtatagccacttgctaagtaaagctatattctttattttgaggtcgtgaattcctagcccacctggatctttgggatgacatataatgacccacttagcaagccagtatttattcttatatccatgcccatgccaatagaatctagatcgaaggtagtcaagtttcttatgtacccctgtagatattgtaaggaaaggcatcatatacattgggagactactaagtactaaattaatcagagtaagtcatccttccaacgagagaagttttcttttcacccgagtaagtcaccctcccaaatctttcaaccacttctctccattcctcatttattaacttcctgcaatggatcgggatgccaaaatatcggaaagggaagtagacaagttggcaacccaagagttggttatattgatctttatattcaagtgcttcaccaaagcaatacagttcgctttaatgaaagttaatcttcaagcacgacatttgctcaaaggctagaagcaccgacttttgtaacgccctgaaattaccctaatatttaaatcgtgtcttaatgcattttctagaaattgtaaaagctaaaaagagcctataacaattaaaaatcaccaagattgaattcaaaatggcttgtgggaatttttcttaaattctcatgcctaaatattcttaaacaaattttacatgaattttcagagcactctaaacaattttaatgcaacaataacctttctcagagtgtttataaaagaaaaattaaaataaaatcctctcctcctcttgggctgcttccggcccatctctccctctctccctctctcggcccagcccagccgccctctctctccctctcccggcccatccagcccagctgccggcagtcgtcttcctcctccagccgaccggccgctcttccctgtctcccgcacagaagcgccgccactgcctcttgatctccttccccggccgattcccctcccgattgagtgcaaaaatcggttcctctcctcctcttcaattcccccataatttcccactccatcccgcattattcgcagtggattttgatggcgttcatcaatggtgagctccactgtggccggtgtcgatctccctccctggcgcccttctccctcccctccggccgataaaagggagccccaacccccttctctctccccacacactgcccgttctcctctccctctccacggccgccgcgctgttctcttcctacgccgccgccgtcgcgcaactccggccgcccctcgccggtggacggaacctcctcggagcccggcgtcgccgccatctgcttcgccgcttcctcctccttcccgtccactcctccgtcgagcacaaggaccacgggaacgacgacaacaccgacgacccgaagctcctcgtcgtttctccctcatcgccggcatctccgtcgagctctcgccgccgcgttcgctcggtgaggaccgtcacctcctcccctttccgtttttcccctttccgcactctgtcgcagcgccgccgcgccgttggccgtcgccggcgagccgccagtttctggtgccactcctgcccggctgtgcctgtgcgccggtgcgccgtgagctgcccttgtgcgctcggctcacgatggaccgagcggctggcaagtgggacccgctcgtggacccggtccatgtgcgctctctctttctgttgcaatagatcaatttttctttagaaaaataattcacaaaattgtaaattttcatttaaacaacacctaaacttcaaacggtcatatcttgaccgttcgaacttcgaatcgacccgttcaagtctctaatttttccctataatgttaagaacctacttttgtgccttgttgtactattttgatggtttctcttagcctagtttcttttcccttgtcgcgtagattccgttgtcgtgccggaagatctgttgttcgtcgcagtggaccgcgaagactttgtgagcaatcaaggcaagtcatatcataccttgaacatgttgaatcctaatgttgtgaaaattatattgttttactattattgcattgcttttataacctatatcgtttactattgtttttattagttattattcctattatccttgttatagccatattgatttgatatccatgtccttgagaaccctaggtaaaataaaatgactagtcaagtaccctatatgttggacttactagttactttaggtttatgcttagccatacctagattcaactttagaatttttggataatttgggatatagtaatctcaacttaaaatcttgattaagtgctagatcatcaactaggtagttgatgggtgggagaaatggtgttttctttgcgaaaactaaaactcgttttggggctctctcgggcatctgttgcgaagccttatcgtacaaccacaagtttgataggtaaggcctgaccggaagtttaatctgtctcaagatagtgaaactcaggagctatgggttgtgggtcggtctctgaccaagtggtgcccagtcgcgacggccaatcccatcctaaggaccaggggatcggtaatcaggaggcgagtgctttagtgggttccactgaagggtaaccttcaggagtttcattgtttcgaggcgaattatatgaaaggtcttggcatggtctccgtccgggtaccttcgagtatcgcggcgtatggtggacatgacgaggaggacgtgccttgtggctaaagttgtacacctctgatcagagttaaaatctattcgaatagccacaccctcggttatgggcaagcctagcaatgttactccaagttggtcccgactttctaaaacttgggaggatggattcatgatggttttcagcaggtggtttaacctaggctggttgcatgggctcgcaactttgtgaactgtataattatgacttagatcaggatcgtgttttaaactttgctttaaacttgtgaactattggaactatggctttatgcaaaatgaacaatattatgccattcctttgttacccttatgcattattgtgcacctccggtatggcttactgagtaccgcgtggtactcattcttgctcacctctacttcagaagttggatgctttggaggagaaggcttggactgctagctcgtaccgccatcaagtgcctgtgtggatgctgctttcgtagacttccactatcttttttgtttatctttgaatgtaaaggcctatgctcactgtttaataaagtactctatttatgcttttgcaagtgtggcttgtaatacaacaactttgttattgtaccccgccttcctgggacggggattaatacaatgagcgtttgggaaaatgggtgcatttttccgggcgtgacaacttcagattttgagctttctgtaggtcatggttcataaaaagcaccatgtcatcggcatattgtagtacggacaaccctccatcaatcatatgcggtatgagtcatgctttgagcatgtttatcaaggtggctaacatgtcagcaaaaaagttgaataggattggagagacagagtctccttgctgaatgccttttttaatccggaaaaaaggctcgaagtcataattgactttggccgcaacaattcccctgggtatgaaagattcgatccaagaaatccacttgggcaaaaaacctttcattcgtagagtttgtagcaaaaagggtcatttgaccatgtcataggccttttcaatatcaatatttaaaatcaccccattcaaccttttcttgtgtagttcatgtactgtttcatgtgtgatggctccatataggatgtttcacccacgcatgaaggcagtttgagttggattcagtacatggtttacttccgagataattcggtttgtggcgaccttagtgaataatttataactgacattcaacaaatatatcagtctgtactattggattcgatttgcttcttcaacttttggaattaaagtaatcaccccaaaatatagataaaaaatgggaagactgccagaatgaaattaattaaataaattcaacaaattatgcttgatgacatcccaaaatttttgtaaaattaatctgggaaaccatctggacagatagcttcctttgtttcttcctcttagaaaagggcagtaagaaagtcattttcagcttatgtaacctaaccatatcatcagatatgctctcatcaagtgaaaacaaattttcctcaggtggtccaaagagtttcttgtaaaaattcgtaatgtacgttttcaacgcatgaaccccctgaatttttccttcatcctggtctagaaagaagatcctcttcttcctatgtttgccattggcatcaagttaaaatattttatattattgtcccataggagtgcatccgagacttttgagcgtaggtaccatttaacctcctcttcacgaagtaggcttgcaagattatccctcgattaatcaagaagattgttttcttgatccaaaaggagtcgaacctctgtaactatgtcaagtgactcaatggcctgttgtagatgagcttttttctgttctaaaatgccattggtatgagcggaccaacctataagatgtctgcgtaaagcactcatcttattattccttcttcgggctacatcccgaccattgactagcctattccatacttcgataacacattcatggaaatcatcccgcagaaaccaactgagttccaacttgatctgcttaaggttaccattgaaggtcgcttcccctgtatcaaggaatagaggtgtgtgatttgacacccctctatatagtgcatgaaccgaaaccagagggtatttagattcccaatctgtggaagtgagaaccctacctagcttctcatatgttagtgtaggaagcaagtttgcccaggtgaattgcctgcccattagagtgatttctcataagtcaaagctatcaatcacctcaatgaagagaaaggccatcgagcgttgtatcgatcattgttgttttttgcactactttctcaaaatgttgaagtccacccccccccccccaaaaaaaaaagggtcggtggatgattttgttggcatgtacttctccaagaaattggatttaaatccaacttggactggaccataaacaaccatcaaaatccatttaaagttatcctcctattgttaagatgaaaattaacaaaaagaaatcccctttaataattaaagatagatccaagacaaacgcgttaattccaataagtataccccttgatctttctttaggtggaagacaatgccagacaaaatcagcacctccagaaaggctatctaaatttatctttgacattttaccctttcttgtctcaagcaatgcaatgtagtctaacttttttttctctaactatctctactgcaaacctatatttagccaagtttgaaagacctttgctagtccaaaaaatacccatcatgaggaaatcattgtagagttttttggatttttggaacgagacttccacaatttcctttttgaagatgatttggtttttccagtgaaaaccaataagtcacaaattatatcaatctccgaaatatcttttactaagcgagcgagtagggcgctgccaatattgtctccctcgtcatcacttgacataaaaggatccacctccgacaaaagaatattggtttgggtaatatcactagacttgtttgctactttagttctatctacctcaatatgtttcaaagcatttatcgagaaagaaacaggaacaatagaagcacccaaagtaactcctaaagatctaagattggcaacgacattatcaagaggtgacggtacagaaagtgaagggctagtaccaataccctgatgaagggatgcattatgggaggccgagtgcagctgagtagtctgtgccgatacctcctgtgcaacaaagctatcatccatattgtgccctcttcattgccttgaccagtgaatcctcatcccctctggccatgccatccaagttttcaaaattggatcgcgcactatagcagcggcgtgtggaatttgcaaccttgctaccccttgcatccatcaagcggggtacaggagatggagaaaagactttcttctgagaaaccagagaaaggacagcagtattccttgctgctacagctgcccctggtgtaagcgaatggaggtgtttcgaccctgttatcggcatgccaagttgctagggtggagaagggcagccgaccggtttaggtgtgcaagtttcaaccataattcttggagtaggcctagctgcaatgtatgctttcccatcaataacacacaggtcgaggtgtggtgaaggccagcactttccaaaaggagttaaaaccagctgcatggctgtgaccttagacgtttgctcctttcgagaggttgaatttttttagttctttgccttcttatgtgcctgatctggacgaccatcctttgacgagtcatcttgatcctcctgtgcatcccatcattatccatatgatcaaactctaagatctgagctaggcagaaattctctttcaccaaagtataagtaatagggtaacccaatttccaaagacgacatctgttgtgatcggcaaaaccacaccgctatgaatgagaaccttcatgcgaatcaccccatacgtctataggtgagcatgtcaacctcctatgccggaatcacattgtgacatcccggaccagggattaataggattaatagaatactcatatcaataagttgcaactttttccggaagctgatctcgaaagaactctaaggttaagcgtgcttggcctgaagcaattttgggatggctgactgaccgggaaattcttcctgggtgcacacgagtgaggacaaagtgtacaaaaaagacttgtgttggacttgtgttgggccttggagaggcggggccttacaaaatggtatcagagcagcctctcacggtttcacggccgcgtgtgtcgcacaaaatagtatcagagccgctgccagatgtaaatgggcctggcctgagagaggcggggcgttacaataagtgggcctggcctgggagaggcggggcgttacaaaatggtatcagagccgccttcacggtttcacgggcgcgtgtcac

SEQ ID NO: 80283 - DNA, 5744 bp, Oryza sativa
atggtataagagccgctgccagatgtaagtgggcccggcctggaagaggcagggcgttacaaaatggtatcagagccacctctcacggtttcatgggcgcgtgtcacagaggggacattcctgacctggggttgatcgacggggacgtcgatctctctgggacgttcctggcctggggttgatcgacggggacgtcgatctctcttaagggggtgaggatgtgacattccggcccaaggtttaataggattaatagaatactcctcgaaagaactctgaggttaagcgtgcttggcctggagcaacttcgggatgggtgaccgaccggaaaattcttcctgggtgcacacgagtgaggacaaagtgtgcctaaaatacttgtgttggtttgtgagggcaatgtgttggtttgtgagggcaatttatgaacctatgaaagctgccagatgtaagtacacacatcatcagtagctttccactctattattgtcattgaaaccccatgattcttaagacggatttcaacgtcatccatcctctttaattcctcaaaagaaggggaggcaacaagaaaagagttctcaccatgagggacagcttcccacatccaatccttccttattcaaagaggtagctcagcctgaactattttccttgacagcaaaccaccgtgaatggagaccaaagccgtgggagctgttgggctgactgcacattcattggcaagtccctaatttggagaaatcaaaattcaattttcccaaacccaaaaaatagccagtaggttatggtagcttgagtaccgggcacttcttagctagatgtgattccctcttgctgcaaaactaatggccagcttgagtaccgggcacttttcagctagatgtggttcctttttgttgcaaacctgtgccctgtggccacttagttttgccccagtgacaacgaggcaccccttttattttttttattttttaatttttgctttagctatcgcttgagcaccctctgcctgctgcgtctattcctgctttgctgccactggcgcggtgggttgcagcagtgcagcttgttgtgctgtccgtggctgctctccctgatcccggaaacaaagtgcccctgaattgcttccatggggaaccttccagaaggactgatgtccgtgagcagctcctccttgccagcgaccaccaaaccccgatctgccggcgttgctgccccagctctcggaaaattgtgcggtcgctgaaattgacgtgggtggtgccgatttgggccgtgctggtttcgcggatgaaactgctaatgccttaccgcaccatcctctcgccgctgccctctagtcgtcgtttcttcacacgttctagccgccatttccgtgtatgagatcttcccctatgctgtgtttttcagtagagagatagcgcatctgtttagacgaaaacaggctaaagactttccatagtacccatcaccaatcgggcccaactgaagagaaggagtgccagattttgtggatggtttgttggaaagaattgtcaccgaattggatcgtgctgaacttgtttcaccgatgcctggcacgccctcacgcgaacgccaagccggtgaaaccacctactctatctcatgtctacgcgcgtgagcactttgtatatgttttgcaaaaggcaatattctccaagcactgccgattgcaccggttgtggatgaggtagtggcttccatggatgcatcacccatccacggcggcggcgatcggagttttgcaactttggtgaagacccccgagaaatatctttcgtacacagctcatccgtatttgaagtagttggcgcaccgggacatgtagtcccaaccactgaacccgaacttttatgttcccaccaccgagaagcagatatcaggaagccgatctcttcccaaaagttttgaattactccctctatttcacaatgtaagtcattctagcattttctacattcatattgatgctaatgaatcttagacatatatacctatctagattcattagcatcaatataaatgtgggaaatgctagaatgacttacattgtgaaacggaggaagtagcaaagatttggcgtcatggaaaggagataccgaattcatctcctcaaccttcatactagctgataacgaattactgaccagatgtacagaatcaggttgatgagacgaactggacatggtcgagagatgatcaagtacttcgtcatgttcttgatcgcaaccatccagagaagcaacatctccttcctcaaaaacaacggacaaactagagaaacaagaaacatccggtgaaggattcagagctaaagacgatggcgacgaaaagtgcaccgcgcataaaccttaaaacctgactcatctcctccatcgatctgcacatcaccatctgcaacaacagaaataccttgtcccgatgcagagggtacgcttgacggagcactccttaccggctgtacatcatcgcagagttccaacgtcgaggtcagccacgcccaaacgagtccctccatgggttgtgtctgaccccctgtgatggctagaggcctagagcaccattttcagccagtcctggacaagaaggaaccgccgccggagaagactcattcatcgcgggcagtgaggaggaatctcagaggtggctccacaggatcattgatccgtttttgtggttaggacacagcgccgacgaggacagggtgcatctgcacgaaacgcacgacgacctgctagccggatcgacaaatatcagacgagaaacagtggccggatctggacacaaaaacgcgccagaaaaccggaaggaattggagcctccgaaggcgaagccccgatgaccctcccctgagatcgtacaaacagtcgcccctccacgaaacccggatttaaaaattcaaaattcaagatttttttagttcttaagcaaagccatagcctctgattaatttgttgggtaaaatgaagggtggagtgaaggagcagcgaatatatacagcgcccaacaagtatagtgataaaataattactatctgtatcatttccaccgcccagcatgctgttatactccggcctcccctcctgtactgggttggtacatgggttgaacctattacgctggagtggactgaatccattcaccagaatggtttggggtggattggacaggaattcaaagtgggttggattggtttggctgttcgaggaagagaaatggattagtgtgttgctttcgtgaggagatgggctggggtggattcgaactggattcctgccccactagcaggccttactggcaagccaaatggactatctcgaactccaaggccagcaagcgacagacggtgaacctctgaaccgactgaacagatgcagagttgattaaagcacgttggatgctattaaaggtgtgtagtctttattcttaatctccttaatctgtagtagtaatcagcagccgtcggaagggaagtggaaggctagcaagggtcgaagactcaaagggtgccgcttgcaccggtcgcttcccatgcccgtgcgggaggagcgctagcggcggagacctggcatggtgctccattccaggcgacgaaagcgtcacgcttccgtaggggagagcgaactggctagggaaggggagggaaaacgcttctatccggttgtcccatctcgaaaaaaaaattggacctctcgctattactttgatgtatgtggcctttttgtcagatcctacatatgcttccttactaagcagcatatatgaaggagagaggacacgagatatttgcatgtacataatatccttttagtaaacttgaaaatgatttttcttctagattacttatccaatttatgatccgattacaccatggtatttgttacaattaaatctttacaacaagaactcacatgactatattataataaaaacacacatatgtttcaaccaattcaatttaatgtttcacatgtgagaataagatgtttcagctgacattttattatgttgcacatattaaattagtgtcgcatgtatatatctttctatattgtatcacatggtgctatttgtatgtttcagtaagtagtttattatgtttcactggtttatttgtaaatgttgcatatgtgttggttgagtgtttcaataagtattcactagttaattaaaaatatttcacacggtatcattcatatgttttagcaaatatttaaaatgttgtaaatattatacgattggattatactatcatatttgttgcaattaaatctttataacaaggtctcacatgattacattccgataaattttaattttagcttatttttgtgttgcggttgattttttccgaacgttgcacactaatttatttggatgctccaataaatatttcccgatgtttctttagttcattttgcaaatgttgcatgtcatattatgtataagtttcagcaagtgttactttatgtttcaatagttacaactcgatgtttcatatacatgtgctatgaaaatatttcaagaaaatcaagtctttgtaaatatatagtatttatcatactatcttcttttgtgtttcatttgttaagattcaatgtttcatgtagtaattattagtgtttcaatgatattaaatattatatctctttgaaacattattagaagcgagttgaaacatttgacctcgagtgcggaaacattttttataaccgatgaaacaacacatttttaattattttttatcaaaatataatcatgttggatcttactgtaaagatttaattgtgatgaatacaacggtgtaatcgaattatagattggataaataattgagaagaaaaaatcatttgaaattttctagcaaagttggtttatgctagcatttgatgggagagagaggagagagagtagttaagtcaccatacacaaaaataataaagtaaggaagcaacagtgcatagctacatacatggagcagaaccatgtgagtagcacactaatccagagtagcgtccaatttttcgtaatccatcggacgtccgatctctagttctctccgaaggggaggagatggatgggctcttggtctgaattgtgtgtgaattgcgtgggctatgtacaccaatgggattttaagcgtgcagagcaggatctagaccatcaagatttgatccagcagctatcatttatttggatgatatgaatgaaccacaatatagaaaattgggtaaaagtaaagtacacggtccttaaaattgtaaaggtgtgtcatctaggtcctcaaactctcaaaatacacaagttctaggccccaaatcaccacagtctctctagaatcctacatgacgttgatatggcatgtcacacggacatgacgtggtataatcttgactgacaaaatgggactcacttgaaaatttcccttttcctttttttttctttcctttcctttttattttactttttcttctcattctatttttcccccttctccttcctctcactgcaactgtagtccatcactgcacggggtggtagggtcacagagaaaacgaacaaaaggaagaaaaaagagaaagagaattaaaggagaagaaaggaacaaaaaagaaaaaaaggaaaatttttaatggatcccatttttcagtcaagatgatgccacatcacatccgtgtagcatgctacatcagcaccacgtctagagggacctagacgac

SEQ ID NO: 80284 - DNA, 5509 bp, Oryza sativa
caaagacgcactgtataattcattgtaaatatgcatagatgtcaatccatatgaaaatgatagccacatgtatttgttttacagaactaataaccacgtattggaattgattgaagtatcgaaattaatactttaagtataacagctgtatgcatgcttacatatgtatcgatattttcctcgtataaatgtgattcttaaaatggagaaaaattatcacaaatttcataagttcgttaagtcgcaatgaccacatgagagtcacaaacaggtactttctaggaacttaatgtgtgttactttagatataaaaactataacccttaaagaactgtgtaataaaagatataatggtataaataaattttgtgaaaaatcatcttatatcatttccaaataggaaaaatctaaacatgtgtacaataaatatcgtgccatagtttcaaagatattgcacatagttagcatatagttgacgaaatttaacaccatcttagaacatatgtaccaacccgtctacgcaatcaaccatttatgctatactatcccttttaaaaaaaataaggaagaagatgcaggatatagttctaaaatgtatgttgctctctagttagtactaaatggtatgttggggtttgctacttcattggttttcataagcacactttacagactataaatggtatgtgtttttacaaaatcatttctatataaaagttacttttttaaaaaataaatttatttttcaaatttacaatagcgtgtactccctctgtcccataaaaaatcaatctgaacatatctctgtccagattcgttgtattacatccgatcctatattcttttttttagaacggagggagtacttcattaattatatactaataatctcattttccgtatcagagaaaacagccccaacctcttttaaactcagccttagtcggacccaaatgatcatgcaaaacttccacgactacacaaccaattctgtacaattccgaccattttaaaccccagctcactgatcaccagacatacacccaaaaaaaattaattaacacatgtactgatgtacaattccattgatatttctaacaaaattaaatgaacggcatgatgtgcatgcagcaaacgggagcatcaaaatacatgacctgatggactgaagctgcagcctgtggcgatcctccactacctgaggcttcctctgcagcgagtgtagctcgtcgacagtgttcgccctcaccggtgtcgcgctgtcgtcgtggcacacgccgtcttcctccctcctgctgccgtatccgttcgtccccagccatgcttgcccgtctttcgcctccatcatttcgatcccttctgcaagagccaaaacaaacagaaacgaagcaactcaagaacagagtaatcgcttggtacaatcttatgatcgatcatatagtaatgggatgcttacagaaatggagcgagagtagagatgctgaagagagaaagactgaagttttcagaatgtggagaaagccatggttatgttggccttttaaacttgggaattaatggtaacaagtgaccaagaagctgcctgcggattctgacgaccagcagttgggttcttcaggcggcgcgcaccatggtttctccacgatgcttatcccctgtaccggtccttccgttggtacggatgccctgtcgttctgtgtgatgaaagcacagatgtcctctcgcctgagaaggggccaggtaattccggaaggaaaaggatatacgtgtaaaattataaaacttttacgaacaagctgtaagccttaactcccatatatagttaactcccacgtgtaattttttatgtacgtgttgtatgcatgcatattatgaaatgagcaccactacatgtaaacatgcttgaaaaaaatgtaggagaaattaaacgtcccccgaaggggcgggtacgcacatcctaactgaacactaaagccaagtctaccggttgaactaggtgagctaagtatatatctgtatatataccacctaaccattccgcgcaaccacataaaagcttatatgtgctggttgaaaatgggtcataggtgttaaatttcttagtcgacacccctcaagtggcactaataactttgtcattggtgcgtgctgattatagaatcggcacctacaatactagataggtgttgtttttaacaaagaactagttctataacccgactgttacgtggcagccatcataactgttgaatctatacaacaatcggcacttataatagcatataggtgccggtcgatggacggccttgaacatggcagcaactatagatgctagtaccaaaaaccgacacctatatgtcggcttgaaaaataaaaatgacagggcctactaaaaaaagataaaaaaaatttacccctagaagaaaaatacaatattttttaatttcattccatatatcagaatctaattaatatggcaagaagttaaacacaataatatatttattaacccagttggtacataatttatcatttatttaaaaccgtgcagaataaataaaatgaggattttatggtttacatgtaaattggaataacaaaaatgatatatatttaataatttaattactataacattatattacaccactctatactactctgtgagtattatttgaagcatctaataataaatattatgtacaaagccaattaatatcatgtcaatacttaatttcaaaattatcatgtggtcatcgaggatgaatctatggagtaattaaatgaacacaaaaaagataaaataaatttaactctacaagaaaaatacaataattgttttggttatgcactttatatgtatagcaaatggttgaattcaactgcaagagagaaatggagtgagaaataatgcaaactaaccttctagctgatcaatcaagaatgagaggcgtggtgtgaggtcatgtgtgtcaattcttaattagaatggctactttagatggcatctatgactgacggtcatcgtaggtgccggttttaaagtgggcccccaaacggctacttcgatgggacaggcctcaaaggtgccagttgctattaggaaccaacacctaggcgtcggatctccaaaatggcaccctgcggacgtgcactcgggtgtgaaaagtactatagatgtcggttctagtatttcgtatttctgacacctatccgacacctatagtactgtatttttttatgttatatagttgtgtgtggttacaagccgattaatggtctttcgttgctctaaaaccacataagctcatgggttagtgatttttttttgttaagtgcatgttttggataagtggattcatctataactttttatagaaaccaatccaaatgagatttgagagttttctatttgccgtataaatttcatcagaggccagtgacgtttcactggtatagaacaccctataggtgctggttgggaatctcacataggtgccagtttcccaactggcaaccgatgccactaaggcaaaactaatgaaatcataggtgtcggtttagaaattagcacctatgacgtccacaaatctaaaaggaaatctgagcagctctccattatccaaagcatcccgcatccaagaaaacattctttgacataactaggggtgaaaacggggcggatattaatttcccgcccgcccgactgacccgaggcttgcgggaggaatatgggagagaatgggatacccgatattatccgagttcgaaccggaatccgtaaaaaaatatgggttaggatacgggaagagttatatccgcccgtatctcccatattaggaaacaaatgtgaatatctattataaattcacctataaatatgataaaagattagttaatcactatttttataagctcacatgtaatattatataatttgttccttgatgcatcttttttagcactttaattgtcttcttacattaaatatccatgaattggacataaaaaaatatctgttcccgaatccgattcgaagaaagtaatatgggacaggatacgggatgagtgatgtgttatccgacactgcctgtacccgattctgaatttaaagtaagatgtgggttaggatatgggaatgttgtgatccaatcaccgtacccgccccgttttcacccctagacataaccatactaccatccatccaacaacaacacaaagaccccgagattgaaaggtttccaagaacatcgaagaacaaattaagttacataatcaaacatcataggtcaccttccaagaattcatatctagaaggacgagaacgacaccgccaccactgctcaccctagtgaagtccgcccccgaccgccgcttcttgctagtgtgacgaccactgccccccacccttggctagatctggccgccctcaagcttgtagctaccggatctagcagttgtcgagcttgtggtggccgtatctagaaggtcattgtcacgccccattttttgggattaaaaatcattaaataatgtatttctagaaattatattaaaagtaatgcaatttatcaagtgaagttaatgtgggaaataaaattttctttcaaaatcatggctggaaatatttttgtaatattctccatgccctgatatactctatgaaatttcccgtaaatttttggagctcaagaagtaatttcaataatacaaagttcattgaatcaattaaataaattgaaaacaaattagaatccttctttcattgtttccggccaaagtctactgttggtatttggtcacagataaatccgcaagtgtacggataccgctgtagcacattacctcagagtattccaaagatatcgaataagtgggaacgtgtgtatatctaagaacaggattcaatccaaggacaacaactgatgataggataggctagacaacaaacttaagtttaatgtaaaactctatcgaatgcttcaagcatcggccctcccttggtctgccaggctgagttcgtccttgagctctatgatatactcgaagagggagggatacaaaatactgacatggctatcaatacctgccgcctacctcactttctgtgaagcacgcaacaaacgaaggtaaccattaacctagacatcacacctaagttattgacttactactctagtcttgcgtagaaactttcttttttatctagagtcctagcactagactagttaattataaactaagcgatgaacccgtatcgatgagaatatatctcacttaagtaaactaactaaatggcactaaaaaatctcaaatacttcctttataaaagaaccatcgaccgaggtacaagcaagagcctgacaactccagtgactctgatgtaagaataccgacaaacctaaaacttctccgaaaattctcgaagagaacaacgataattttgggcactccttccaaagattctttttgaggagcgaaaccggtaatcactacgatcgtgcccacg

SEQ ID NO: 80285 - DNA, 27394 bp, Oryza sativa
ctcctcgtgcttcacatcgtcaaacggtcaagcgaataatgaggtatttgaatcatacacttgagtttggaatttggtattctacttcatcttttatatgcttgagtgattattccgatgctgattttgctggttgtagagttgataggaaaagtactagtggaacatgtcattttcttggtacatcatagattgcatggtcttctaaaaaacaatctagattgcatggtcttctaaaaaacaatcttctaaaaaactgtagaatcagaatatgttgctgctgctagttgttgttctcagatttttttggctaatatcaactttgaaagattattgtcttatttttgagaaagtacctctcttttgtgataatactagtgctataaacattgctaagaatcctgtacagcactcacggacaaagcacattgatattcgcatttactttttgagggatcatgttgagaagggaggagagaatccattatatgccactgactttgtcacacgtctacgatttgccgctgattttatcacgttctacaatatgccatcgacttttgcttaacttctacgatttaccatcgccgtccagttagcctccgttagtactgtacaaatttgtcgaaatgaccaaaatacccctaggacaaaaatttccaaaatttggataaaataatcgaaatatcatatggagggtgagctcggcgtcgccatgtcgaggccatgcgtcgaacacagccgacgccgatcactctctgtctctcccgcattcttgagcggtatgggtgagagggtatggtacgataataatggcaaaactgtcattttgtgtggtttctctcctatcaattgggtggcttctagtgtcctgtagcaaattatcgattttttttgagaattaatattatttttatggaaaatcgcaaaattagtggccatatgtggaaaatcgcaaaaataggtccctatcgaacgggggaggaacgacaggggccttatcgaactgccagccttcgattggtacctgtcgaactgcaaccattcgacaggccggcctatcgaaccggggttgttcgactgggcccaccacccggtgccgcacggcctgtcgaacatggggagttcgactggtcccgccgcctcccctgtcgaacaataggcgttcgataggtccctttatatcggcagcccgaacccaactttctctaaaccgattgaggaggaccacatcgccatcgtcgccattcagtcgccactgctgtcgctgtgcgcgccggagggagtgaggggagggtgtgggcagctagtgacaagtccggggcggcgccggcctggagggcagtgaaggcgacggcttgaagtggcgacattgaggtataaatttgtaatccctaagtatgaggcttacgattttttaatcttatagaagaagacttgtgatttgttaattgtttatcattctccaatgtgactacatatcatatgatatgttaacatttgtcagtgttaaatgtgagtagagatattaaattagtcgtatgctaaaattagttaagttagtaaatggtagtacatatatttaatgtttgatgtgtttaaataggtagaggttaatacaactgggtatgatgattaaattagttattctttaatattagttgtaacttattagaaggtagtgtactgttagttataatatcgtaattatcgacggcttaaattattaaacgtaagggtaagatatgtgtcggtcagtaccgtataataagacaatttataatgttttatcaggatgtcaggtgatatgcctattcgtctgtattatggagatgctcctatacaaatatgtcatagcgaagtggatttgactgtatatgccttccatgatactagtctgaatgcaccggagcatatgggtttgaacgacgtgttagggtggttgtataatatgtttggggtagaaccagtgctcgataaatttgtcataaatgtcgtgtggccagtaaggggtcaacatggatggcagtggagagtagtggaggttgcgtcaactgggagttggaggaagtttgttagtaaagtaagagagaaagggtatagcctggcaatagtggtgcacaagacaacatgtgttgatcgatcggggggagtcaagtcatgccgtggtggaagaaactccattagaaggtgcacaagctgaaaatgtttggcggattgagtaaggtcgaggggaagaagtagtagagggtaatacacaagcataggtcattgttcgtgataataatcgtgaggccgacgactcggacaatgaagagccggattcacctatgcgtgttgacgcagcagaggagaatgaggcggtagtggatcagatggaagtggaaaacgaggaatacattgcgcttgtagtggaaggagaagatacaacactgtgggacgacgaaaccaacatacctgatgattggatgaccatatcgatgagttgtatgaaggttaacgatggtttaaatgcccactggcgttatgatagtaagcaggtgcaagttgggcagatgtttcatgacaaatgtcacttaaaagttgcggtgaagaggtgggcatttgaccagaagcgtgagttcagggtgaaggtttcaaataggacgacgtacaaagtgaagtgcacacaggctggatgtccttggagagtgcatggttacaagccacaacatgacactttatgggtagattcgagggttgagcaacatacgtgtttgttggagaatactcgtctggtacataggaacaagacagcggcctttgtggcacaaatggtatattcaaaggtggttagaaaaacatctttgtcccttttcacaataatgcatgacgtagagaaagagtacggatatgagatatcgtacgacaaggcttggtgggcaaaacagaaagcactggagatgaggtttggaacttatgaggcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggataaggatggtttgtggctatttgcataaaggcggttgtaaaacattttattgagcaaaacagtaaaacggttgagtaattaaagtaatattgaatctccactgatcaacgctacacgagtgaaattcttcccgggtccgccccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcctctacctaagttcatactagtggaaccataaatagagtacccactagttggggttttgtttaacctagggtgaacaaggtaataataacaatagcaataataataaggtcataacaaaggtaaataggcatggctaaataaaacagtgataacgcgggaatttaaataaagcgataatgcaataatttaaatcagcataattttataaactgggattcaatatgttcaaggatgatgtgacttgccttgctcagagagaacggcctttcgaaccttcggcgacgaccacgaaccacgcttcgggaacctccggaacgacgaaagctacgcgaagcacacaagcaaagctacaagcctataaagaagcaataaccatacataaaaacaaagcacagggttctttaggttttaacaaacattaggagacttgaacgggtcgattcagagttcgtatgaccaagatatgatcatccgaagtttaatgctgttacatggagatttgcggattattgtaattaggttttgcaactataaaacatgtgtaagcgctagcctggaaaagacaggaaggctgcgctgttgacatgcggaccccacatgtcaacaaaaaggaccgcggtagaccgagtacacagagacggtccacgggtcgacggaagcagatcccgtgtgtcaaccgaggcgagtggccgacaaacggactccactagacaccacacgggctgcacacgtggaaaccacgtggctaccgagcgggcacactaacacggacactacacggtcaccacccgcacacgtgaacgactatcgacaccggtacacgggtaccggggtcgacgaccgcacaacgggtacggggcgacaccgaaaggacgaggacggggcagcgagaggagagatccttaccaccacgcgacgaggcgtgggaacaacaacgacgaccgggcgcggcggaggcggccgggaactatggagacgaacggggaggggacgacttcggcggcgatccttggacgaaggcgagacgcggccggcacgagacttgacgacgcggaggcgaggacgaagacgatgacgggggctgcagcgcgaggagacgacgagccggcgagacaacgacgaccggggccggcgaggagacgacgagggcagccggcagtggctgcacggaggcgaggatgccgtggaacgtgccgctgcgatgccgacgacggaggcagcgccgcgagacgacgagccggcgagaaggaacgatgacgacgaacaccggcggggttcgatcgaaggggaggcgaggccgagggcgaccttgccgctgcgatgccggaggggaagatggcgacgtcggccggcgcacgggcacggcggaggaggctgccgaaggcgacgtcgacgaggagaaaggagaggccggcgcgggcgacggcgttccggcgaaacagaggagcagctggcggtgaggacaacgctgcgacgtcgacggaggagatggcgacgtcgatcggcgtaccggcgatgtacaggagccgaccggagaccgggaggtactggacgcagacgaggaggccaccccggcgagcttcgggcgaggaggaggtgatgccggggaaggaggcgatgccgcggtgtcgacgaagcagacggcgacgtcggccgacgctccgacgagggacagcagccggctggagggagtacagtggcaccaatgccactggttgccggcggggacgcgtctccggcgatttccccacgaatcggaggcagcgccggcgaagaggaggcggctgcgacgccggggaaggtgacggcacggccgggcggcgctcgggcgaggagggagaggcggctggaggcggccggcgcggaggaaagagaagggcgacggcgggaacgcgcctccggcggtcaccgcgcgaaacggagggtaggccgtgggagaggaggcggctacgatgctggaggaggcgacggcgcgaccggacggcgctccggcgaggagggagaggcggctggagacggccggcggcacgggagagagaggaggacggcggggagatggctagggaccacggggaggctcgggatggggttaaaacgatagaacggaggatgaggatcccattttatagcggagggaaacaagccgggcatgggagagggcggaacggcgacgggaatggcggccggcggccatggaagttggccggagttggcgcgggcgttcccggcgattgggggcacgattcaagggggaaattggggggaactgaagaggattcaatggggattaattccccccactcaatttggaaagaagggcattgattcgcgtggatttaggggaggaacggcgctaggtttccggggagagagagagagaggaggccggctgggggaggaagacgaccgcacgtgctgcgcgcgtgcggggagcagctcggcgtgggccaggtggctgggtggcgcagcttgggccgggcgggaaggagggaggggaggggcggcccagaaggaggaggagaggagggacttcgggctgggcttcgcccaaaggaggaagaggatttatttttaggtttttctttttaataaactttgataattgtttttgttgcttaataattatttccggtgttctgaaaattcaagtaaaatttgagggctcctttttagaccaaggagaatttaacaaaaattctccgagccacattcgaatttttcttgtacgtattttagtgtttgccaatttcttttcgaattttaattaattttattattccttttggaaaatgatttttatttcgggatgaatttatcaggacgtgacaactccctggatgcccgttgctactcatgttgtgggcgcacgagcacttcgacattgggaggcctcagctggactcgtatgcaaactacggattgcgagagatgtacaagtccagggttggtgacctcgacgatcgtcccactatggaatccttgcggacacaccgtgagataatttttgtttaattcgtttgtcttctcattatgaccggttcaatactagttgaataatttcctgatataactaatcataagtactatcttcttgttgcagctgaagtgggttagcgggacgacgcgtcgtgtgtacacacagttcgtagctgactttgatcagcttatgcctgaccgtgtgcggtggacttcgtacacacagcacgatgtcaatgatcatgcaccgcactgtctcgcggacctttgcacgcgggatcaagaactctggaggacgacttgtcacctcgtgctggacgtgcacatcgagccacacaatgtccacagggttcttaaacagttgggcatgtatcaagagttccctcccagagttggtcgtgctttggctgatagtcttcataggttggtacacattacatttgcttaatccaattttaacaaaaaatatgtgtatgtacgatttttgctaatgtgtccatttcttgctgtgcaggtattcccgaaaggggctcgggctttcctacgagcttgttattgtgaccacggttcatccgactgtacaagagtgggagcacgcagctgataacttggcactttagacacctccagacgatgggagttactatggggcttaccttcgttggtaccgcagtgtcacacgatggaggtgttttccgccacaaggagatagcaccgttcctcaccaggcggcgattactgacacgtttgcccctcagccttgatcagcttacaactcaatgatatgtgtttattcgtggaacatgcggaatgtgagcaactagttcagtatttctaataaatgtgcaactagttcaatatttttaataaatgtgcaactagttaagtatttcttataaatgtgcaacttggtcaatattcgtaataaatgtgcaacttgttcaatactttgaataaatatgcaactatatcataattttaaatgtcttgcttatttgtggaacatgcagaatgtgagcaactagttcattatttctaataaatgtgcaactagttcagtatttctaataaatgtgcaactagttaagtatttttaataaatgtgcaactagttaagtatttcttataaatgtgcaacttggtcaatattcataataaatgtgcaactagttcaatactttgaataaatgtgcaactatatcataattttaattgtcttgcttatttgtggaacaggcagaatttgttgagcacgttcaggtcgagtcagacaccctgctgcaaagactagagacgagacctccagtcgtcagtcctgacgacgtggcgagcgtccttcgcaacttccgtgcccgtgctgccgcactacttcgtcgtgtctcctgtcggagcgcggcagatgtggtgcagccgtctgcccgtagggcatcaccaccactaccccgacgttccagcgtggatcacagtgctccctcctcgtcacgccgcgggtacgaagcggcccggagatctcacagtcgtccttcctttcaacacaccccagcaccggagtacaccagggggtcagctggatcaggggtacccccgacgagcacggcacagccacgtccccaggcattccaaactctgccttatgttcaccccacccagggagcatctgggtcgggacacttcccttacatgccaacaggggacaacgtgttgaacacacctgcatggagacttcacgtcactccgcgtgcgccagatcaaggccacacatagcacacatgtaagtcattttaaataataacacgctttagtttcaaattatatgtatcattactaactatgtgattttttgttttctccctcttatgcaaacagacgatgaatacggttcagcgtcgacgcatcatggaatgcctgcttactcccctcgcacagcattcgttgaggacttcttttccactgagcctcctcaaggggaatcagggatggattactggcacgcagcacctcaggtgacacagtcgacgtaggagacggggccattcaggctcccgatgtgacaccacagtaggcagcaagagagaggcacccccctgataatttgacttatcccactgagcagataagacgtaggaagaagggaggacctagcaagcgtgcgaagggcaccgatcgtccttgagttatctatttctgttaaaaaaatgagacatttatgttgtgtccgtactatttgtgaacaatttattattaacttagtaactatcagtactatttcataatcttgttcggatgattgttttttcataccctttccaacgacggagtacaaaagattcgcgaactttgcagcgcactatacgacacacgcgtaaatgcatgcacgtggtgtgcaatctactttcggcgcaaatgtcactctgtggtccaccccattttcaactttatcgactacagagttatgaaaacgaccatgcgagatctcgctcgtgatcacctttcagtacagacccctcactcgtgcccgtgaggtctatccacacatcaagcctatcttcaccactatgcttcctgcagtcgttacggcactataaatacataccttcaccaaacaatagctcaccaatacctttcctctttacatttcccattgtcttcagcatagagttcaacacaatggaagctccattctgcgagcatttagattggcggagagatccactcgtaggtccatttccaccatggtgcgaccgcccaatctgcgcatgcggtgatcgatgtatactcatgacatcacttactactgaaatccgcggtaggagatttttccaatgcacaaacatttaccaggtatctgttcaatgtattgaaatctcaacatttgcacatgtttaacacgtacatcgctaaccacgtgtctacaatatctcaaaattttcagacttaccgtagtttgtaagactttgttgagtgggttcatacgatgaatccacaacgtgacagggcacgcccatatccatgcagcgaaccattatcggactacctaaggaggaatgatgagtacgaacaacgaaaaactgccaaatccttaccatggcaagtaaatccacttggacttcccacttggcgagatcgtccagagtgtaggtgtggagaccgttgccaggtgataaggtctgttcgacaacaaactttaggacagagatgcttcgtgtgtcctaacattgtcgatgaagatttcgtcgtaagttccactaatttttcactcattcccattacttctgccatgtacctactgtttacacccaaatttggcacctatggatgaaatagaggaaaattgccaaagtttggaaagtttcgggtttccttcacagggccggtcagaccgcaggtatatgggcggtctgaccggctagtagggccggtctgaccgcaggtatgtgggcggtcagaccgtcagggtccgagtccgagcctattttcgtcgggtctcgggtttccttactcgggaaggcatgtttcgtgtttccattggtttctatcccgagttgaatgtggaggagggtctgtagaaggcaagaccaacccctatataagggacaaggccggttcattgtaaaacccctgaatacaatctacttgaatcgttcttttaccatgttttctattttaccctagtttagtccatttttgtcggtttgcaccgtaaaccgtccgccgccgctgcgagagtgcgacacctctttgtaggtttgtcctgaaaacctttcgttttgcccacgagacgggtagttatcctcatatcaatctaaatcggcctagaggctgattttgatctctaaatcggctccgctagccaatttagcttttctttttgcaaaacccatcttgatttggccctttggctagatcgaggtggttggcgactctgtatcatcgcaaggcgtttaggtgttgcgatcgtgcttgtcgacttgtcaaaaaagttgccaacacgatttttggcaactccgctggggaacgatctaatcggctatatcacggccgaatttcgtttaatcaagtagctaccgtttcgtcaaatccaagttttggctaaacggccgaaattaatctagtatcgccggattaatctaatcggctccgaggttatttggtcgtcaccgaatccatgtgaacgtttgccgtgtgtactgaagatcatcatcagggagcagcggccgactcggcaacctcctttccttttgtttcacacggcaacagaggaaaagatcaggctactagagccgatctgccgagagacaagcagcaggagcattgtttccttttattactgtatacgtgcatagataaaaaaaaagatcaggctataccagagccgatctacagagagacaaatcaaagtttatttgttgattttggtgaaattgattagtgcacgtattactcatatcgagagaaaaattaaagaccgtatattaatttactcggtcaacaatttcagctatgagctatatggccggatttaatcaaggattttcttcatcaactatgacgagcgggaacaggttcaataatattgctacacaatacattagaaccgatcaaggcgtcgcgagaggaaacgtgtcacgcccggaaattcactggtaatttccgaacttatttgtgcataaaatcctcgtccaggaatcagccaaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctgaatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccagatataacacctataattattgtgagaggtgtgagactaatcacgaaaaacattgctcaacccgcccataaccgcgggcacggctattcgaatagttttactctggccagaggtgtaccactgtacccacaagacacagctccacaacatgtcaccatgtgcctcagtactaccacggtacctcggaaaggagctgtgacattaccccttgcataacacaacccaccacagtgcaccgttcccggatcatagtcacccccttataaacaaggcatggactccccagcgacccccatgggcttatctccgccacttcttagtttggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgatgaaaacgacaagctaacacgcaaaataaagaaaaagactaataaaaaccaattaaacaatacatataaagtaaacaaacatgtagatcacaattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagaggattattgcgtcagcggctagggtttgcggtggaccgggtgcacggcagcggttcacgggaacggacggccgagatcaaccctatccaaaacggacggccgagatcgatcggatccaccgcggctcacggacggacgacgacgatgacatcagcgactacgtcagcgatgacgtcatcaccggcgacggctcggcggctcgggagcacttgctcgccggcgaacgacggcgcgaagacgcgagcggagggcaccaacgggtagagggcgacgcggcgaactcaccggtgaccaaaaccacggcggaagagcaacggacggcgccggcgacgaggaagaagcggcggcggtcttcgggtcgacggtgacggcggtgctccggcggtcttcggcggcggcgaagcggtggacggggacggcgacgacctcgcgatcccgatggtggcgacggcgaccaacgacgacggctgcaacggcggcgcggcgcggctgaaccgacagcaacgacggcggcgactagggctacgcggaggcggcgctagacgcgacggcgggctaaggcaaaggtggcggcggatagaggagagctcgggggtgctttcaaaggggctagcgagcggcgacggaggcccacggcgaccggcggcgagatggaaaggtagagcttggagagagagagaccgatccgaatcgacctcgaatcaaacactttccaagcgattttagccggtgattccaaaagagaaaaggtagaggagatctcggagattatttcccctcaatcgatttcaccggatcgggaaaggagcggccggatttggaaagagacggcggcggcttgcgctagggtttcggccggcggcggcctgtcagcgacagcgagagagagaggagagcggcggctcggcggactgggccgactgggccggggagagagagagagggtttttgggccgactttcggcccaaagccaaaagaagacttttaaaaacctttttcaatttaaattattcatgaaatgcaattccatttattaaaaatactttcttggctcaaataaatcccagaaaaatctaggaactatagaatcaagtaaagtatttaacaaaattttatctagcccaattttatattgagatttaacaaattaaaattagatcttctcttttatgcttttaagatcatttctaataattccttttaaacaacaatttataatttaaggatttttaaacaagaaaagctcttaacaattataattagatcattaatgatcaaataattactgaactgttctttgtatcatttaggaatttagctctgaaaaatccgagaaaatttcagagagtgaaattaatcatggagaatttaataaaaattaaatccatccatgctttatatttaggaaattttatttcccacatgtaacttcacttgaaaattaaagatcatttaatataaattctattattaatttattaaataatttataaatcctgaaacaaaaatcaagatgtgtaatttcaccaaatgtaaccctcgattcgcccaatccgtcctttgctattcaaaatgttaataatcattgtgtagatgcatatgctacgtctaattttgctcctatacaatatgcttataatgctagggggggtcaatgggtgattatacagccgattacacaggaatcggctatatgcaaaaccgagctgacagtatgaccggtcgtgacaccagtctaacagcatcctttgccggtcagaccacgcccaccatggccggtcaaaccgtgcctaccatagccggtcagatcgtgccctatcctggccagatcgcgcctcctgtggccggtctgaccgcaccactgaccaccggtcagaccgggccatgggccgatcagaccggttccgtgggagtttctccaggttttcataccacgactagtagtactgattttaattattatccatcacctgttaatactgttagtcatgctagtccacatatccgtaatgcctacaatgatattaatagggggtatcctcccgatactagacaaggccaatataatcatattgcttcacaaacataacctattaggctaccaaatctaccaccaaatcaacatgggcctaataatatggaggagttgattagtgccattatcagggctacatttggggttgaagcgaagaatcgtgctagggagaaccaaaagccgtattctgatttttatgacgttgtcccatatcctcctaattataaaattcctgaatttactaaatttagtggtgaggatagtaggactacatacgagcatgtatatcaattcttagctcaatgtggtagggctagtagtatgaatgcgtgtaagttgcgcttgttttctttatctttgtctggtactgctttgatatggtttacttctttaccggcaaattctattgatacttgggctcaattagaacaaaaatttcatgattattttcacactaatgaaactgagcttaagttatatgatttaacatcggttaggcatgaatacaacgaatctgttgctgattatattgaaaggtttagagatgttaaaaaccgatgtttcaatttgaaaataactgacaaagatttggccaacattgcataggatggatttcttgattctattaaagagaaattgaatggccagatatttcttgatgttgatcatgtgttgcatgaagctctggctcaggaaagccgagtggatgacaatagtttaaatgctagtttagatgaaagtgcaatatcatgtatagccgaaccaagcgatggttcggattgtgttaataatttgtgcaatgatgccataacaattatagccgaaccaaatgttggttcggattatcttgctagcttggataatgatgcaacaaccattatggccgaaccaagcgacggttcggattgtgttattagtttagacaatgatggaatatccgaaccaagtgacggttcggattgtgttactagtttagataatgatggaatagccgaaccaagtggtggttcagattgtgttgatagcttagagaatagcatcattgaagatatagccgaattagatgacggttcggattgcattacaagtaaaagtgaaatagcattataacctaagaccgaatcacaaatcgatcatgtgaatgttggaaaagataatgacaatgtcttgcgggatagtggtgaaatagaatccaaagtagctatgcatacatatcaaaggccgtatcctgaacatgtagattcggtcccatatccgcaaggattcgaggtgcccaacttcacaaaattcacaggtgaggatgctagaacaacaatggagcatatcggctgctttattgatcaatgcggtaagcccggtagcaatgatttgcttaagttaaagttgtttcctctttctttgtcaaactttgcatctacatggtatagtttgctttctcctagttcaatttctacatggtcacaaatggaacatgagtttcatgattattttaaagatgcaagcttgatgaagcaaagaccgattgataattcatcggtcatttgtgatactatttcggttacacctatgcctaagaccggaattgttagtaatcctctccctgttagtcctattgatgttgacaaaaaaaagggaaaagtgttattattggggatcctcggcccaaaaataggatcaaaaatgcgaaggccgaagatcataaagttgcaaaggatgagtcatctagtatccaaaggaccaaaaagccgaagctcacttttgagatgcttatggctaaatacaagaaaggattagccggtcaacgatttgataatcaaactagtgattcaaaaggaccaagatcatctcgtaggaagagatttggtcaaacatcaaagcaatcggagccatcaactataccaactccacacaaacctccggttgtgatgccatggtatccatatccaatgtcactatatggttatccttttatgtattgcatgccttggatgcatcaaccacctatgccgtattaccaagagtggaaggaatcacctaggtcagtgccaaatcattcatctaactcaagacaagaccgtttcccacaaaagaattggtccggtagatcaaaggtgaaaaatgtgaagaaggtgtgggtgaggaaagaagccaaagctccggaggtcgttgttatcaatgaggagtctcaagatgttcatgtacctactggagatgcgttggaaaccatacaagcgaagaagactgaagccgacgccgttgctgtcgacatcggcggtctgaccaagacagctggccggtctgatcgccagactatgtccggtctgaccgaccctcctggccggtttaaccgacggcttacagccggtctgaccggggagcattggagaagagtgagaaaattaaagcagcacaggggcttccacttcgaccaaaaatatgaagaatcattgcttagctcctggaaaacaaccacagccgaagtagataccttctggcttatctcgccctcaaaagaggaggctacaacgtcttcgggccataggtcaaaaagaaaagaaggccgaagatgtggagaacaagacatgcaataatttagagcctcgaacagcacctaggcaagtgtggagaaccaaagaggtaaaagttaagtgatcggtgatttcccatagtagagataaatccaatttgatgagagaagaatcatcggtcattagagataagtctccttcacatgatgctatggatgttggtgcggtgttcgtcttgccttcgaaatcgcgcaatctagaaagccgattttgctcggggggcaagacattaatatgctcatgaagaaatcaagagagatgaatggcgatggatacaacatcacatcttttgagccgccgtttgttggatgttaaggcaaggtatgagtttattgtgtttaccgttatatgcctatgccatgttagaacattgcttgctatctagcacatgtgtgtttttacttatcaaattgatattatacatacatgttgcaaatgccagttctaggtagtagaattggtaggttggcatataatttgtttgaattatgatttggctcatgactctttgatatttatttaaagccaaatcatatgtgtttttatagatcaccatataagatatagatttcatatttattgcaccatgaaagtttgcttactagtaattcagctaatgtcaatggtcaatgtgatgatttgctctagagtggttttctttaggaacattggcattgttaatattttacatacatgttcaagttgattacttacatttgtagtttattggaatctatgcatgtgacacatatgactttggtgattcattattgatcatacttcaattggctaagtgttttgatgccatgatgattattgtttcaaaagccatttgaattagtattcatctagacatattagttggatattataatttttttcatatgtctagagagaaggaattttggtccaataatttgatacaccaagcatctggctattatctgaagaaaaattatatattaaaggccgatgcttgatttcaaaagtttggacgaaattggcaaagtcatagaccaggggctgtctgaccggcattgcacggccggtctaaccgatggtaccggcggtctgaccggctttgcatagccggtctgaccgatcccaaacaggaggctggggagcatgttacaattgattaaaaggccaaattaattgtgaattcggacatttgtgcccatgagttagaaatggcttggagatttccttcgattagatatttgaaagatcctacacttaaggttgatcggaagattcggcggcaagcgcttaaatattatatcgccgaaaaatagatggagtattacttagataatgatcaatctaaagttgctaggagagtagtacatgaaggattcatgaaactcatcaatcggcccgtaagataaattggttgcttaggagagtggggtttcattggccgaaaataattgatgattgtttcaaacgttatagagggagtgaagcttgttaacggatcggcaatgttcaattagcgcctaccgctgtgttgaatcctatcattagactatggctgttccgaggttgggctttggatttcattggtcaaatttatccttcgtcatcaaaagggcattggttcgtgctagttgcaatggattacttcactaagtgggccaaagccgtgccgctcaagaatattacttgtacggaggtaattgattttattttgaagcatattgttcataggttcgatattcctcaaatgttaaaggagtttcttttatgtccaaggatgtgagaagtattgccgaatcttatgatattaagttgttgagttcttctctttactacgctcaggctaatggataagccgagtcgagtaataaaacattgttgaaattgccgttttgccagttgaggtaaatcttggctttcttcggtatttcaagcaagacgacttgtcggttgaagattacaagatcttgatgggaagcaattttgaagacgtcatcgacaagcgtttgaagactttgaaggagatgaagacacttcaagacggtgttttcagagagcaattaatgggaaatacttgaagaaatatttcccgagcatttggcaagatgcttaggaagtcctatggccagtaattggactatcgccctaagacaacatgttccatgcttttagattcacggtgttcatcaaaaaggtagggggcatgtgtttacaaccaaatttgacacctatggacgaaatagaggaaaattgccaaagtgtcgggtttccttcacagggccggtcagaccgcaggtatatgggcgggtctgaccggctagtagggccggtctgaccgcaggtatgtgggcggtcagaccgtcaaggtccgagtccgagtctgttttcgtcgggtctcaggtttccttgctcgggaaggcatgtttcgtgtttccattggtttctatcccgagttggacgtggaggagggcctgtagaaggcaagaccaacccctatataagggacaaggccggttcattgtaaaacccccgaatacaatctacttgaattgttcttttaccatgttttctattttaccatagtttagtccatctttgtcggtttgcgccgtaaaccgtccgccgccgctgcgagagtgcgacacctctttgtaggtttgtcctgaaccgttttgcccacgagacgggtagttatcctcatatcaatccaaatcggcctagaggctgattttgatctctaaatcggctccgctagccaatttagcttttctttttgcaaaacccatcttgatttggccctttggctagatcgaggtggttggcgactccatatcaccgcaaggtgtttaggtgttgcgatcgtgcttgtcgacttgtcaaaaaagttgccaacacctacatatgccaatggtcattaatttctgcacacaggaagaagaccgcaaatgtagctacgtaaagtggatcgatatggtccgaagaacttccatagcttcaacgataactcaacctgagacgaccacacaattcattcaggcgtggatggagtacgagcgctaggctcagtccgctagcttacactggagatcaaatccattaggtatacctgaatggtctgatcgtcccaaatgcggttgtagagatcgctgccaggttgcaacgtccttctcacaacatacatgggaggcggtacttcgtatgtcccaacatagatgacaacttcgttgtatgtcacatgcttaattattactttacatttcgcttcacgttcccataacatttatttcccgtcatctaatttgattgattcttcaggggaatccaaggatgtgtgcttttacttcatggatcgacatggtcagcccgacgtacgaaggcggaagagtaactgaagctgaaacgcaaacagagtataagagattgaaggatcacgaagttgctttacgcacacaatgacgtagaaggggtcagtagagaagcttaacgccgaatcgctcttgttcggatttctgttatgttatgttgtcctatgcgtcaatggattatgctcattcctgcttccgctgcaatgtcttcaatcccgtcctattctttatctgtcgttactaaataaattgcgaccaagccatgagaccaaaaatatatacagataatgaaactacaatttcccaataatgaaactacaagaatgaaaatataaactcattcatcctaatattttaaccaaaaaataaatattacaatttcccacaaaatattatttaaaaaataatattaattataaaaaaaatcctgaaaaaaattcacaaataatcacaaataaaaaatcgacctgaggacaagtcaaagaacaggtgttcgacaggaagcctgttgaaccgacggtgttcgacaggaagcctgtctaaccgacggtgttcgactggctcctgtcgaactgcccttgttcgatagggcggcagtcgaacgacctgttcgacaggtcccagtcgaacggcagccgttcgatcgtctcttctatcacggtttcgataagtcgcctatcgaactgcacttgttcgataggaccccatttttgcgattttccacaggtagccactagtttcgcgattttccataaaaataatattaattctcaaaaaaattcgcaaattaccacacttttaaactgtcctcgggtaaattcacatctttgaggtgtcccatagctaattacacatttttgagtgtcctgtagcaaattttgcctttcatcaaaccattggattctgatcactttgcttttcttcgtggagaattgggaataattcatccttttggcatgatttgagggtgagattttgtacctcatggttttatcaagcaaaattttgacaataagaaaaattgaaaaagagagctttgtttgattcatatggtattttcttgtgcatgctagcaatactatgaagatttatttgtctctagcatagcttgtatgtattctagtctttttgtgaagcttagatattgcttttatgggagatgatgcatgacacttaaattctatacttgaattaagcaagtatgcaatattgatactagcatatggtttgatttatcaatgcttatgtatgtgctttattaagttgttattcctcaaatagtttttaattgctcattgtgcaagagaataaaatctatgagagaaaaaaaatgaataccgaatccttggaaacagtcttgacaacaaggacgtattcatgtgagcaaaaataatgggtcccgaacccttgtaaacagtcttgatgacaaggacgtacctggaataactgagagaaaaatatgaacaaaaagggcccaaataaaatgttaaaaagtctcttgattgtttttcttctaaagttaaatttgagaaagagtgataaatgcaataggtatatatattgtttattcttcaacctatgtgcttgcaaagatgttgcattataaatcacatgaaatcatgaattcttattgtcgatttgatcttaattgttatatctttgatttatgtttaaactttagtgcatgcttgctatgatatgatgggttcatcttctttttattgcaacacataacttgatgtgctatatatatgctaagctctagaacattaatgaacttaattcctatgcttgatcaaatcattgtcaaaagggggagaagagaagagattgtgcatgttttcggtcaagggggaatttctttgtttttaaaagtgagagaagttttcttttgaattttgagcacgatgtgtgcgtttgcactaagtgtttttttgggtcaagggggaatttctttatttttaaaagtgagagaagttttcttttggattttgagcacgatgtgtgcgtttgcacgaagtatgctttttaccacttttgtttttatttttccaaacaacaaaacatttttgatgggtttgtcaatgtgttaatcaagggggagattgtaaaatcaaagtattttttattcttattctgtgatgaataattagcatatgtgattattggttttaatatttggagatcattggcgaagtggttttggagatgattggattttataggtgttaacaggtgctgctgcttgtcgggtccggtctgaccgggcagtggttgccggtcagaccggcgtgtgttgcacagtcagaccggccagcccgcggtctgataggccgactctgtgtcggtttcggtttcgagttgttttattggatatccatgattaatatgtgtttatggcttctaaatggatactatgcgtatgtaatattgttgtttgctaacaatgagtcaagttggagatagcttggtcttggaatatggtttctttggttgattcatgtgtaggtgacataatgcctcgggagagtattgccggtgatggatcgggagtcgacttggagataaggcgacatccaggacaactagttatgcttgcaatgcatatccttgttagaataataatattccactagtatttggttctctaaccttttgcagagaataagtataaagtgaaggagaatcgacatcaaatcagacaataaatcaatcggacgatgtcgagaatcagacttatgtatgaatgggccaagaactctgatttgacacgatgaattgggccaaaattcacaagtccgcgaaagagagcaatggaggaggccacctattgaatttgggctaggttgggctggcccctagttcggctgaaccaggaggtggttcggccgaacccccctggcaccgttggatgcatggttttttttggacggcatgaatcactccccaacgacggttggagggcaattccgaccattccaactgccacaaccgtcattggcagcctatttaaagagctcctcttctcacttcactcacacacctcaagcaaaggtctctcatattctctcatgtttagtttattatctagctagtggaataagaatagagtagaaatcggtgtccagaagcatttggaagagttcgggtatggctatagtagctcttctcttcacttttttaagctttctactatattagggtactcttctttatacatttatggtattgaaatactttccgagtatatgaatgccaactttacattatgttcatgctatactgaatatactgctagcttatctgggagatgctttggtgcgggtataatttttgcatatgcaattactctatgtcatgacgatgatattagaatagtatctggtagtttaggcgtggtgtctagattacgagatatcattatttggggttatatgctgcggatgagaggtgggccgctgatggtgacagctcagtacgggtattcctccgtgcgtgtatatagtcctaagttaatttccttgggagggtactcctctgtatttagccccggctgtatggtcatgacgggctatcataagaaactcgacagttaggggtggtttctcgaagtaccaggagggcatcggatagagggtattagctagtatgtcagataactaggatgtatgtatactatgtatactagaagtataggaatagattctctttctcttttctttccacttagcttagatattttatatgagaatgagtagcttcctgcttgtgtgtcactctacccttggattatattaacccctgctaagggtacgattattataaataatatataaattattagtcaggttctcactaccatgatctttccacgggattaaataaatacgacacccttggaatacactcggtgaaatgctacaatggtatatccgtgcgcttgcggatgaactctgtaaccataatataccaggagtatttttgcgccattgcttggaattatatttcaagtaatgtcgttaagaaatatcaacaagcattttctggcgccgttggcggggaagattcataatagagattactagaactaacactttatatttacctctatataatcactgccctttgcaggctaaccttggttgttttcacttttgttgtggaaacagggtagtgtttcaatttgccagaaaactttaaggaaaatccagaagctttcttccggagcatcaagccacgagtcgtcgctccacagaaaactctcccgacaaagaaaccagccataccagcactaccaaccttcaagactatggctgacaagactctccgtgaattcgctactccctctgctgacaatgtggccattgggccacagatcaacatgggagacgtggatttcgatctgaaatccagcctcatcaagatggcgcaggctagcccattctgcgacaagcctaatgaggatgccaatgctcctctacagcagttcctggagatttgcaacacgtacgccataaagggtgtcagtccagacgccatcaagttgcggctgttcccgttttccctcatcgggaaagcgaagcggtggttttatgccaaccgtgctatgatcaacacctgggacaaatgctccacggcattcccctcaaagttcttcccgatgggcaaaactaacgctcttcggggaagaatttcgagtttccagcagacaagggacgagtccattcctgaagcatgggaacgacttcaggaatacgtggccgtctgtcctcatcatgggatggacgactggctgatcctgcagaacttttataatgggctcactctcatgtcccgtgaccacctaaacgcggcagctggaggagctttcttctctaagacggttcgaggagccattgatttaatagagaagatggtctccaatatgggttggagcgaggaacgactccaaacccatcagcaaggtatgcacactgtcaaggagacggaaatgctcgctgccaagctagacctcctcatgaagcgattggacgaccacgacaaacggccacaaggcaccgtcaaggccttggactcacacgtcacgtgtgaagtctgcggcagcacgggtcattctgggaatgacttcctggagacccgtgaggaggcgatgtacatgggcagcaacaataatgggtaccgtccacaaggaggtcaggggtggaaccagccacgcccatattattaaggaggcaacaacaacggtaacttctctaaccaatgctttaagcaaaaagctagctgccaatgacaaagtcttagagaatattaatgtcaagctagatggctttgcttctgcttttcaaaaccagctgagcttcaaaaaaatgatagaaaattagtttgctcaattggccgccttagtccctgcaaatgaatctgggaggattccggggtagcccgattcctccattgaaaatgtcaaggcgatcacaacgagtagaggtaagtccactcgtgatccgccatatcctaacccagcagaaactaacgggattgccaaggaagcgccatctagtgaatcggctgacaaagaggtttagccagaaaggctgtgccacaggagtactacgacacacgattgcttccgtttcctcaacggagtaggaaactgtcagtggacgagtagttcgctctttttgttgaagtaatccagaagattcacatcaacgtgccattgttggatgctatgcaagtgccaacatatgcccgctatctcaaggatatcctcaacaacaagagaccactcccaacaatggaggtggacaaactgactgagcaatgcagcaatgtaatactccacaagctcccggaaaagaagaaggatcccgggtgtcccatgatcacctgctcgatcggggcacagcaattcgatcacctgctcgatcggcggaagatgtgccggtcaagatacgggatttcttcatcccggttgactttgtggtactggacatggacacaggaaaagagacgccactcatcttgggcgtccgttcattagcaccccaggagccaacattgatgtggggacgggaagtatccgtttgggctgcagga

SEQ ID NO: 80286 - DNA, 16056 bp, Oryza sativa
catcgaacccgagggaggcaaaatagacttttgcggaggaattgatttgggaaggatttggattcgggattgaactcggcgatagatcggggatttgagatctgagatggcacggacactagacaacaagcaaagaaacaaatttcgcaattagggtttttaagagataattttcccgctaggcgccacgacagaacgggcgctacacatagtagttacacgcttgttatatattagttatatagtacttataccctagttatatagtagttacatgatagttaaagggtagttacatttgtataaaattagtatttgtaatttttttcaagagcatgtgttttacttttgaattatttttccattatacatgttgaccaatttcttaccgttcaatcaacttggatgctaagattagtggtttgtacttgtgtgtacccatttcaaaactgttgatgacaaatcatatggttaaaaatttgaaagttttgagcctcaaaaactatcgacagattactagctagttccattttttaacaactccaagcattttaatttcctcgtttttcattatcatatttctcaaacaactaaggttgtgttctttcccatgggttcccaacccatctcctttgttttctgcgtgcacgctttttaaactgttaaaacagtacacattttacaaaaaagtttataataggagagttgctttaaaaaatcatattaatctattttttaagttttttatagctaatacttaattaatcacgtgttaatctatcgctccgttttccatgtggaggggaggggttcccaatccctccaaaacaaaagaacacagcctaaatatgtttcgtataaaaactttatatataaatatttcttcaaaaaaatcaaataattccatttttaaaatttatattggttaatacttaataattataagttgtaaaaatataataaatttatctgtaaatatacgtataccaattaaagtttgattttttttgttataacttgtagaactcgaatttgaagatacatgtttgttgagttacatattacacatgaatctatcttgttgctttttaaaaaaactttttataaccattcagttgatatgaaataaatggtttggtgtacatcaaagtgattaaaattgtttcccaaaacatatttgtagtctagtttcttccatgattccatgattgcgggtgtatgtgttgacatgtactactactctacttgcgatatactataaggttgagttatacccaaaccgattttaccgtatggtgagttctatgaacgataatttcacgcttttcattagcatatttttcgaactgctaaacgatgtatttctatatacaaattttacatattctttaaaaattaataatttttttaagcttgtaataattaatgctccacttattatatactaattgttggtctcgtgtcacgtgcctccaaaatccacactcaattgctgaatcgaacacacccctagtccgggagggttgttgggctatgatttttaagtgccatgcgaaactaacaaactatttatacatgattaattgagtattaattattacatacataaaaattatttattttatttattttaaaaaacttatatattgatttttatggaaaatattgtgtgccttgtatgatttctttgtgatgtttcactcattgggacttaatgttctatacagtggttgttggtactgcagttagtattttctgaatgttgtatttctctacaacattttataaaatgaaatgaaacgttttagtatgtaatgaaacattgtttttactcggaggtcgaccaggaggccgccacgcatgctaccatttcagggtacatcgcctactacacggccaaccccgagtccttgacaccttcatgcagaggtcctcagaggtgaaagactgatagtcaagctactagagagagatggaaaagagaggagagaggaagagagagaaggggaagagaggagagagggggttgggcatgtgtgtcccacctactaacttagcgagtcaagcgtgcttaacctgctacgttaatagaaaccgcttcccaaatcatggaaggagtcggttaacaccggcttttgaagaccagggagagttttgcagccaagagagacaatgtaatcatgagcaagagataaaggaagtaaaatagacttactccaaacaaaggcgggcttcatatccgggcctctccaccccatctaggattggaataagttcacttggtgaccctcaaaagtgatcgaaatctaatccgtgaccctaaaccacgaaatcagatatcttgaccctccaactcttaaaaccagtgcaatttaactccctcggtgattttggagagcggtttcgctgacgtggtgcctacgtagcagtattgactcggtcttctttccacgtggcgttgacgtggcgcttaggtgccattagaaataaaaaatatgtgtagaacccatttgtcattcaccaaaagtatgggtgggacccgctgacatgtggggcccacataaatcatcctcccctctctctcttcctcttcccttcggcgagccgcgagcatggggacgggggccggtggcggcggcagcggcaggatgtgctttcacagacccaaatctgccatggaagcccaaaatccctgcttccacgcaaccgctcgcgacactcgacggcagcgcagcagctggaggacaaggaggttgcgctagcgaacgatgtgctccaggcggcggtgactacgattatgttcccagcgcggcgacgcatctagagctcgggcaagctagctggcacccaatccaccgcggaacagatccaggggcgacaaggccggttacccggatgagcggatcgagcaggaggcggcggcggcggcggcggagtgtgatggggccgaggccgacgttgtcggatggaaggtgaagaggcacgccgccggtgccagcgacgacgacgacgggggcggtcacggtcgcggccgcgatcccgatggcgctgccgatgatgacgcgggatggctccccggtgctgtccggcgaggagcaggtcatatcctccagctcgtcccctgagcccccgctcatgctgccgcaggcgccatccggctccggctccggcggcgtcgcgtccggtggcatgcgggagaacgcgcagctcgcacgggagctcagccagatgaggaagctctgcaacaacatactcctcctcatgcccaacagtgcaagtacggctccacgcagcagctcgacaccgccaacgcctcctccgcgccatcctcaacctcatgccttcctgccccggcacgaagctcttcggcgtctccgtcggccggaagcgaatgcggcacgacggcggcgacggtgacaatgaccacacggcggcggtgaaggtggagccgatggacgggcgggccgcccgccgccactccggccctcgccgcccgccgcgggagagagagaggggggagcggcgaggagggagaaggaactggagggggagagagagaagggacacgtgggtcctacaatttctttcacgtgtcaatgacaaatgggtctcacacatattttttaattctaaatgccacctacatgccatgtttaaaagagtcctggtcaataccgccacgtaggcgccacgtcagtaaaaccgctctccaaaaccgtcaaggaagtcaaattgcaccggttttaaaagtttgagggttaagatatcggtttcgtggtttagagtcacggattagatttcgatcacttttgagggtcaccaagtgaacttattcctctaggattcccggaagttctggtctattaagaaagttcatgaaggcccaataacgccataccatatcacatgcagtttggagacccggcccaactcaatcccaacatggtggcaaagaaagtagtaaagaaagaaaaggcagccttctaagcactgaccgcccggacgtactggtggaccgtagctagtgactgcattttaatattttgccataaaggctgtgattagatctaaacttcagttcttttctatcacatcaacctatcgtacacacataacttttcagttacatcatctccaattttaaccaaaattcaaactttgatccaactaaacacagccaaagttagttactgcatgatcgaatacgaaggtttagcgtagtaacttaattagtcatcgttaacataacggacaagctgcctaggtagcttactctacttagaaaaagcatttttcagacgtgagggtttttattttcgtaggtggatatggctctcggacccaaatgaccgtctacaaaaatgtaaactgaggtgaaactcgctgtccgaccacttaagcggtccgcctgtaaaaataccatttatttttgaaggcggacctcttacgtccgcctacgaaaataggcgtggaatataaatggaccactcatcacttagattttttctaagtcctcacctatcctctccctcaaccggcctctcttctccctcacctctctccatcaaccagccctcacctctcctctcactcagtgacgggcgttcggcggcggggccagtaggatccgcgacggcgaggcgcggggtcggtggcagcaacggcgaggcgacgctcgggggcagcgcaccctcggcgcggctcgcctcccctccctcccagatccagccaaaggggggagggggaggccagtggccggtgacgcgaggcggaaaacagaggagggaggtcggcggcagcgctcctacctcccagatccggctgtcggccctcctatcccggatccagaagcgtcatgggggagggtggcgacggcggctgcatgcagtggccaaggtcagaggtcgtcggcgacgctcccccctccccccctcccctccacggcggcagcgggctggcgcggtgagctcgtggcggcgcaactcccctcccctccctctcccctcccaaaaccctcatgatggcatagctcgtggtggcggtggccggaggggagggcggccaaatattttttacgctgaaaatattttcacaggtgggtggattcagccgcccgcaaaaattattgattttcgtaggcgtttggttgcggacagaagttatggacgcctgaaaaatacgttttagccgcctataaaactgttttttttccagtagtgttacttacgtattcatcaattaatcaattcattccaatgcttgaataataatactactgcatgtccgtccaccacttatagctacttaaaaagtggtgacaacagtttacggatgaaactaattttacgggtgtcacctgcatagtaaaagaccatctagcaaggcaactactcccaccgttaaaaaaaaacctaatactaaataaatatgacataataaatatgatattacagtacaacaaattcggatatatctaaaatatgtcacatttagtaataggttagttttttatgggacggaaggagtactctctaaattatcaaattatctttataagctgtgtttagattcaggggtgaaaagttttagcgtgtcacatcgaatatacggacacacatttaaagtattaaacgtaggctaacaacgaaacaaattacagattccacttgtaaactacgaggcgaatttattaagcctgattaatccattattaacaaatgtttactgtagcaccacattgtcagatcatggagcaattaggcttaaaagattcgtttcacaatttacacgcaatctatgtaattattttctttttcatatatttaatactacatacatatgtctaaacattcgatataccaagattaaaaaattttgccagaggattaaacaggccatagattgtgaagcttagtaggggtataatagccttgagatgctaaaaagtcaaagtcaaacgcacgtgcgtgtgcttgccgatacaaaagtctactggtagcacatcatctgtatatgactgtcttgcgattcaaggaaaagaaaataaactttgtgtctcatttcaatgaacctgaattcgatgcgtgtacacctggcgatattcttctcaaaaaaacaagaccagtgtccaaacgatatgattccaaatctcacgatatataggaaaaagaccaaaatgaaaaaaaaaaataacaaagagagtgggtgtgggtcagtgataagtcatcatacaaaacatggtgtgaggagtccaattgaagtcattattttattttatcaaaaaagaatactacaaagcacctatagtagattttggcaaatcttataattacaacacagtattattttattgcatactagctcttgtgccattagtaactgataagaagacggataaaaaatatttctaaaatctattatattattaagacagctcaaaaagaaggcaccacgttcgctgtagaggctaaaaattcccacattaatcgaagaaaaagaaaaaaaatctacaccgctagatcatgacagacttatagtttaaccgttgagattgatcggaatagtataagtaagaaagagtacatgacaaatcctactcaaactatgtaaaaaaaaaaactatacagcaaaataaaaattttgttcggactgtgatggcccaaccggacagagggttgacaacgtttcttttgtccatggagaaacttaccaaaaaaaaaaaaggaaaatcaatctgtttccatggcacttaccgcatacaaccaaaaaagagacctgtcagctaacaatcaaactcactcagccaaccaatgcctcctttccttgcacagcagcgcgtgatttaatcagccacgcgcccacacgatgtcattgaaaggcaagtttaatatgatcaaaattttgttaagtaagaagttaaattgttttgttggttgtagattgaaagataaaaatatattcctaatttttcttgcatttggagataattttatggttaaataatactataaatatcaaatattacatatgaggtatagaaattatcaagacatcaagatcaaggtcagtatttggcagcctgtaatgttcgatcatcaattctcgaccatattctatctaagaattaattcacatttgcagggctaaaaaaataccacatttaatcaaaagaaaacaaacatattaccaagggacggcaaataaggcggcattcaacgacggcttgcaggaattttaaaaaaattataaaaaaatcctatcaatgatatggatattaccggtgtagtgagatgacaaagaagagaagcaatgggcaagtgagtgtgtgcaaacaaatgagataggaggcagttgccacaggaggacatgccaagggtggtaaagtaaataaaaaataattataagagttcaagtaggattacaatttataaatgaaagaaatatcacaatgagaaatatttatttttgaaaaaaatagtccatacagaacacaacaataacaaattataataaagatgagagaaacaatagacccataaaaaattagagtggtgtaggtagatgggacatgtaaaaactataaataaaaccttaaatagaatctgaatgataattaagaggagggacgacgagcaggtcgttaagcagcatgatctcgacgattggagggatttctagaaagtaaaaaaaacccctcaattattatcatgttcgattttcaaatctcaacgataataaaaatgggaggcagcaggcgggccatagagaagtatagtagcggcgtttggtgagacttctaaaaattataaaaatgaaacccaacaatacaatgaactctaaaaccacaaggtcaaatttgtagaggtttcagggaggatgaatgaaagcattggtagatcgagcaagtaaataaagcgatgacaaagaaataaggcgtagtgattagcatgactattaaaagcaccggggtgataaagtcggtttttcaatgttctaacataacgagatagttatttaacaaattttaagtaaaatcatatgtaaaacatagataattttatatgggtgttagccgcgcaattgcgcgggccacccagctagttattcttcatttaatatataatcgatcactctgtatttttaaattaaaaaatcactttgtttgggaaataatcagtatatatttatttatttgtatattccatcgtaatcaaaggcattggcgcgcaaacgactttgggtgggggcgacgaccaataaacaagacgaggtcgagttgagttgcgtcgcgtcttcctccccgccgccgccttccttgaacctgtctccattaactcctccatgtctccattgtctccctccacactaacatccactattatcggatcgcaagaatccacagcccggccatggccgccgccgcgccgcagctggaggaactcgtcgacctcgagcccttctctccgtcgctcttcctcgacctgcccccgacgccgcacagcgacgaccccaacgatgacgatctcatcctccccttcatctctcgcatgctcatggaggacgacatcgacgacaagttcttctaccagtttcccgaccaccctgctctcctccacgcccagcagccctacgcccaaatcctcgacgccccatccgacgacaccaccaccaactcctccgacgactccgcctccgccaccaccaacaacacaaccaactccgccgccgccgccaacgcctcctggccctacgaccccatcgagctctctcagctgctccaatccccgccccaccccgtctccgacaaccacgacgccgacgtcggcgacaccaggagcgcgccggaagacgacaaagacctgaaacttctgttctccgccgccgacaacatggagatgctcaacatggcgttcctcaagggcagggaggaggccaacaagttggtgcccaccaacaacaccctcttcgccggcttcgacggcgcctcgctgctcaagacggagccggcggtggatgagcccacgttaatgttcggacgaagcggcggcagcggcaggggccggaagaacaggcacggcgaggaggacgacctggaggcggagaccggcaggagcagcaagctgatggtgccaccgcaagaggccaccgcggccgccagcgagatgttcgacgaaataatgttcaactggtacgaggtgatcatgaaagggatggaggagctgcgcgtcgccatggacagcgaggccgagaagaaggcccggaacggcggcggggccggccggagggcggcgcgcgcaaaggcggcggtggtcgacctacacaccctgctcatccactgcgcgcaggcggtggcgacgagcgaccggcggagcgccaccgagctgctgaagcagatcaagcagaactcgtcggcgagaggggacgcgacgcagaggctggcgtgctgcttcgccgaggggctggaggcgcggctcgccggcacggggagccaggtgtacaagtcgctcgttgcgaagtgcacgtcgacggtggacttcctcaaggcgtacaagctgttcgcggcggcctgctgcatcaagaaggtgagcttcatcttctccaacaagaccatcctggacgccgtggcggggaagcgcaagctgcacatcgtggactacggcctcagctacggattccagtggccaggtctgttcaagtgtctgtcggagagggaaggcgggccgccggaggtgaggattacgggcatcgacttcccgcagccggggttccggccagccgaccagatcgaggagacaggccggcggctgagcaactgcgcgcgccaattcggcgtgccattcaggttccaagccattgctgcaaagtgggagacggtccgccgcgaggacctccacctcgaccgagaagaagaagaagaagaagaagaagaggtgctcgtggtgaactgcctccacttcttgaacgccctgcaggacgagagcgtggttgtggacagcccgagccccagagacatggtgctcaacaacatccgcgacatgaggcctcacgtgttcgtccagtgcgtcgtcaatggcgcgtacggcgcgcccttcttcctgacgcgcttcagggagacgctcttcttctactcgtcgcagttcgacatgctggacgccaccatcccgcgcgacaacgacgagcggctgctcatcgagcgggacatattggggcgctgggccctcaacgtcatcgcctgcgagggcgcagacagggtggatcgcccggagacgtacaagcagtggctggtgcgcaaccaccgggccggcctcacgcagctgccattgcagcctcaggtggttgagcttgtgagagacaaggtcaaaaaactctatcacaaagacttcgtcatcgacgtcgatcacaattggctgctgcagggatggaaggggcggatactgtacgccatgtccacatgggtagctgatcgtgatcacaaatccctcttttagttcaagatttaattatctgcttcaattacttacaaattgagaactagatatatactcctacatgatataatatcttcatttgcaatgtagagctagctacataagattttgatatatatatatatatatatatatatatatatatatatatatatatatatttccagcataaataaattgagaacttcatttttttttttgctactatagtttaggcctgtgtgctcttctgtttgctgacaatctactatagtgttttcactattgtcgtgtttgatgatatgttctctttgtcatgtttaattcacttccttttgtgtacgcaaattcttgatacttcccttctttcaaaaaaaatcttgatacttccatttccctggcaaaagtataacagttgcatgattgagcagtgcagtttgttcaccaattattcaaagtgtttgaggtgtgtatcgctgtcttactttctaatattaatggtttgtgggccagtacaactcttgtgtttgtatggattcactcataaagttgtgatatatgttccaaaaaaatcagtttcaaatctgacaacagttaaacagcgatactgattaacaaaaaaagggtgggcggtggggtattcaatgtatatatctgcatgctgtccgcaaaataaaagatgtcatacatttcccgatgtttcccacagtttcattttgacaggcagttcttgctggatatccttgtatttgagtcagacaagtacatcaaaaagaggttaccagattgaagacatgttaattttctgtaaatattgttgagagttgatcactgggacctgctctgtgatatactcctatttatgtgaaattgacattgatgattccaaaataaaaatggctgcttagtttgcaatataatagatagatcttttcttttgacaggatgttattaaatcttgatggttttttttttttgaactaggagagcatattaaatcttgatggtacctgagaaaaagtccactaaactagttacaaatattcaaatttgttgtatgatagtcaattgttggtcaatagcttcatctgttaggctgcgttcgttccttgggcacggttaattaagtattttaacataacctttgaggaacattgggccaaaggttccctgcaaatttctatacgtgtttccttacaaattctagtactttacatattcctgggttgtgttttctttgattactggcaggtttgaaatactgctagtttggtttatcatgcattccatgtgctgagatagtttgataattacagactgatgtagtaggtgcagttttatctgtcttttgcatttcagaagcatagaactgttttttttcttatatatactggggctaattttactaaacaggtatttggtctagtaatttcacgctgcaacactaaacaagcttgtatagctgtgtttcagatagaagtttgtgaaaagattagcaatttgttggagaagttaggtacaatatcaattttaagctagtagagttagggggtgtttagatcccacccaaaaattttacaccctgtcacatcgaatgtttgaacacctgcatgaagtattaaatatatataggctaaaaaaataactaattgcacagattgcgactaatttgcgagacgaatcttttaagcctaattactccatgatttgacaatgttgtgctacagtaaatatttgctaatgacggattaattgggcttaataaattcgtctcgcagtttactgacggattctgtaattagtttttttattagtgcccaaacaccccatgcgacatcctatataatatccgatgtgacacgccaaaactttacaccctggatctaaacaccccccctatattctgtaaaaagggatgtgcatttcattcatctttctgacatgttaggtaggagtaattcagtaacaagatagcagttagagaatctccaacaacctttctaaaatagactctccgaacatccatatagccagctagctatcctgtcgggtcccaaaactaacaacttggatccgactgagattaatgtatcaatccctggatcagtaaaaatcgatacatacaatataactggttcttcattgcatacgttaaagtcttacaatactaagggttttacaataataggtattcacccatctaattagtacacagcggaagtttctatacattctgactagtgaggtataacctttagggattttctaagttatcagggtctttgtagtaatagtcataagggtcctcctcttgacccagatatgaaaaaggaggttataagagcaaggatgagtattcacaatactcagcaagttatcacggaaatatgttatgcattgacatataatagggttctttgcaaaaagcagtattggacaatctggaaaagcagaatttataaaacatataacctttagatttccaaccagggtaccatatgagtcccggtactcaactccatgagtacgtgtcatgccccgaaccagtcccgaccggaactagcccgtgacgctccaaattaacctgttaatcgataccagtcccaggaaacagtgctggtatcacagggagacagaatatcacagcaacagaggtctctttattatagagtagaggtatagtcatgttgggctgtggacagatcccgagctcacaactgcattacataagggaaacggaagccaggacttggaccaaccaacacaggcgcgacttgggaactaggccgaaaccctaaaactcatcgtagccggcttgctcctggaagaactcctcatcagcaggatccgcttcatcttcttcagcaactgagggggggggatatttatatagagcaagggtgagtacgggaatactcagcaagccatgagaaataagtgtttaatgcaggcttcaaggaaaggctgttgtttttgcaattgtttttatttgaactcctttttgtaaacaactaagtgagtgcttctcaaacgacacggatgagacagtgcgtctcgtccagtcggagtatgtgcaatgtatcagtctttagaaatgacataagatcggcacccggccaatagcttttcaaacagccacccgggccaacaactttcaaacggccacccgggcctagctgatcccatcagctgcaaattttccaaacatcgatcccctttccacaacagcaatttcacaagcagtagtcaaacaaaactacgctaggaatcacctcacatctgcccatgaccgtgggcacgactgttcgaacagtttgttaacctctgcagagggggtacactttacccacacgacattacaaacccgggtcacccagcccgtggggatcaaccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactccgccaggggtgtcccattccacccatgtggtcgtacttgacttatgtttggatgaaattccaaggaatcggtccttaagtgcgagagcgggaaaccgtactcccggtacgttccccggtccgcggttttggaaattcatttagttcgcaagcaccgacccaggtgtcgggttttccaagccttttgtaaacccaagttttacccaagttgtttttcagattttaagtttgaaggcgtccgtcgatactcgcacagggtgcacgaatatcgagacgcaactagatggttacaaggggacatgatataacaattaacaaagggaggatcaatgcaacaaattaggtaggtccgctgatctgcctagcagacgggacgacagattaagtgcgatcctatcaatgcataatatttttcaagcaacataattaaatttcaaatataggctcgagatgttcagaggtggcttgccttcctcgagatctggagcttgatcctcgaaatcctcgcactacgggtcttcgggctccgaaactacacgcgaaatgggacaactcaacaaacggcgaaaataaagctctattaatgacctctaagcgtgccattagatagatctcgagatttgaggaattttggaagttgaacgtagtcaaacggacttacggttgggaagatattgaatttctaagattattggatttttggtctaaaggaaaaggatttaattaaatcctttttggaaaagaaaaagaaaagaaaagaaaagagggagggattatagacttttcctcgggcggctagggcgtggcccaagggaaaaggagcggaccggccgagctaaatgggccggccggcccaaggcggcccaagtgcgcgcgcgcaggggggaggagaaagagggccggtggaccgggctcaccgtgcgcggtcccgggtgggacccgcttgtcagcggctcggctcaccgtgcggagggagcacgtggcgcacgcgcgcgggcgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggccggcgggaggtagacgacgacgccggccggaacggacgggcggacaacagcggcgagcggcggagcgaaccacggcgatacaggcgaaagcgagcacaccgggtggttgcacgagacgaggggagacgagccaacggctcggattcgcctgaggaagcttgacggcggcaaatcgcggcggcggcaactggcggggagggaagagggaaacggcgacgaggtcacgaggggccgattcccggcggtgagagcatctacgcggctacgggaatccgatgctagcgtcggattgggcggagctacgccgagcgaggctggcgacgagcgggtgctacggagctcgagcggcgacggcggcgagcacacggcgagcgacggcaacggtcggggcggcgccggctagctacggggaggctactcgtgctaccaccgaaaactaaggggggggagatggagcggggaggaagaacggagagaggcactaccgtgcgggtcggggcgcagtgacgagaggccgacggcgcgggagtaaactctccggcctcgggccggggaagaggaaggagacgagcgcccggagtccccttccgcgtcctcgctcgtgccggctcctccgacgcgcgcaacgacgaacggcgacggcgaaacagaggggcgacaacaatggagtggaggcgatgggacaacgagaggagaagagagggagggcactcggggctttaagggcggcaatgtcggtttggaaaccgactttgggcggtcaaggcgcgagctggcgctcggcgctcgcgtccaaatcggcgacagggcggagggggg

SEQ ID NO: 80287 - DNA, 14515 bp, Oryza sativa
ccatttgcgggagaagcagccgaggtggtggctgggcccgtgccggggaggggcggcggcagccgggcccgtgctgggcgggggcggcggcagcggccgcggccgggctgtgccgggcaggggcggccgcggccgagcccgtgccaaggaggggcggcggccgcggctaggccgtgccagggaggggcagcggcggccgggcccgtgccggagcgacggcggccgggcccgtgccggaacgacggcggccagctcgtgccggaacgacggcggcccagcgcggaaggccgcgcagcgacagctccatggattttttttcttttttccttttcgttgtgtgaataatttgaataattgtttgttgatttgatccgtgatttgagaatgatgtgtgaatgatctgtgatttgttgttgtggatgatttgggatgtttgagatattgggttgttgctgtggatgatttgggatgttgagatgtgtggatgattttgggatgtttgagaatattgggttattgctgtggatgatttgggatgttgagatgtgtgaacaatatgtgatgagtgacgtgtgaacacaaatatgtgatatttggcgctagaaaagaaaaaagaaaaaaataacttttgtaccggttggtaataccaaccgggactaaagatactatatctttagtcccggttggtattacgaaccgggactaaagatctatttttagtcccggttattttaaccgggactaaagatagacatttttagtcctggatttgtagtcctggttggaaaaccgggactctagggggttcccaaccagaactaaaaaatgattctccagcagtgtgtacctaacatgatcaaataaacgttgaactttgtatcatcaatgttctatcagcagaagtagtttaagcaagttttttttcctcgtaaacattcatggtgtcagaaccctgatttttgctatatatgctttagtttgcagtatctaagcgcctttttctgcatttgtccttatactattaacagatagtcacatggtcgtcacatcacccccaacaaaacccacatgctaatgcatgataacatgcatgcatgtggagagactaaacaatgcaatgtatagtcaaatgagtcatcaaattccttaatcatgtgttaattagcacaatacaacatgcggtgcgaaactttcggctctgtgtcattgaaaacatctgcatgctagctgattaacatcatgcagagtttgtaattaaacataaacatattaattatgtatacatatctgcctactttttttttgattatcaacatgtctctatcactgttaagcaaattttcacctgtctattactagctgttaattaattttttagatcccctatctgcttatacgtctcgattgggaggcaaaataatcccataaaattagacatgtaccaaacacttttgagattccgaataatatataagagttgccgctccgctcctaaaaattacactaaaaaagtggagtggcatttctgctactcctcacctccactccaccctagagtaggagctctataaaatataccctttactataaagacaacattacgatatggcacttatactaagaaattataccataaaatatgttggactaaggtataagatattgtctgttttaatttttttcttcacatggataaactgtagaaacaattctaattaattaccagtaccgtagtggagcaatataatttaaatcatacaaaactatgcaatgttaatggtgtctacaatatataaaacatttccattgtctaaatttaaaatcgtgtctatattcaagtaattcaaactaactatttaattggacaaatgagttgagttgatattggcttgttacgtttggtttggttttggttttggttttgatgaagacatgaaatgttccaagtcaaattttaattttttttgaacgttctatctttttgaataggagtatattcaggttatattcacaggaatcatatgagtatctaaatttgttttaaagatatagttttcgtaatatcataatttcatcaagacttagatataataataattcaaattttactctatcggtttctagatataagtatttcaaaggattcaaaaatcgtacacaaatataaacatagctagagtatttggtgtctcatcaacctccactcatttaaatttctttccatactagtacatgaataaccaaaatgacaaaacgaatgcagtgagatgcatgcatatatatgattccagttcaatgaaccttttggatccatggtactgctagctcctactccctaggttcatgtcagctagctcctagggtgtaccatttgatgcttctgactttttgatagctggattagtttaaatcacgattataaaattatgataaaataattaatttttagaggacaaggtagttaattaccgtggattaccttgaagaatagggaatcagaaagacacaaagccctacccctactcagccaggacactggacttcctcgccatcggcttgtgattcatccatctccttcccctcgcgactcgcggattcttgcaagcagcgagactcttacagcttccaaattcgcccaaattaagctagcttcgttggcgctaaaatttttcactattattgcaagaaagaaatagttttacaaggcaacagtagcacatccggcacaagcactgcttattgttgaaacccaataatcgtttctaattagccaaattgctcaagttccacccgcaataacgcaaagcagagggatgttccacttccgagcatctcctgggcaatgcagcatgcatatctagcagctcagtacaggcgttggacaccttatcccacaacaaggcatgcatctcttacacagcaccaaaaatatagaataattaattcgattgcttttctttttatagggatcagaagatgagcatccttggctggttgcctttgcttaatttggctttaatttttctgggctagaaccgaatacaattccttttttctccatatgaaaaaaaagagagatcttaattctgttacgaccggtgtagaaatccttaacactccatctttaaaatcagtcgtggattagatccattttgcaagtaacaatctttaacatatccaaaagatgcaagaatttctatagttaatgaagctgactttgttgatcaagactctaaacccgtgctatgcatatataggctatacaagattctaaactaatttaattttatgtagcataataacgtgctacagatcattaattgtatattctcgcagtatattatcttgaagtttgttatgtagtcgaactttaaggagctgcaggtcacttcaggatcaatggcacccaagtacccaaccaagaagtactacgatacaaaacttaaagcttgcagatattagttaatactacattcgtcccaaaatatagcaatttttaggtgttcagatttatagctaaaaattgctatatctgtgtgtttagatttatagctaaaaattgctatattttaaaacggaggtagcagttatttgttttacaagcgagagatatattaattatgatagcatgattaccaaagtttctagctattattttttaagaatacaacgttattatgatgttcgatccaacacgagagggatctaataagatcactttggacaagcagcatgatcgatgattcgtacgttggagtataaagaaagtcatcatcagttaattatctggctatataaagagagagagagagaggtcgatcaatcgaagcaagcaatcaagcatatgcatccgtggatctaacactactgtatcaattaagtagattctctatagcacttaactgcattgtagtactacactgggtagcaagatgctcggctaattactactccatccgtctcaaaatatcataataactttttcacctacattatcttctcaattaatcacaaccttacaccattcaaattcttacctactttcttttcttaatcaatcacaaccatccttcatttaatctcacatatttttttaatacctatacataagtctaaaacttcttatattttaggacatagtttgtgctagtttaatactacctccgtttaggttataagattttctagcattacacacatttatatagatgttaatgaatctaggcacacatatatgtatagatttattaatatatatatgaatgtggataatactagagtcttatatataatatgaaacggtgcaagtactaatatgttgagcaaatgaatgcaacaaaattaagggacccggcaccatgctgacccctattttggagacacacacgtacgcgtggcaagcaaattaaactggttaattactcctatcgcgatcctcatcatggccatgcatggggtaacgaattaattaagctgctggcttgggtatctcactataaatacccaaactggccatggtttaagcaaaaagctagctactcgattcattcgccgctagctagcttttgctttatcctccgaagagaagagggatcgatggaagaagttgagagtagttatcgatcggagatgatggatggcgaggggtggaagatgatgcagcctaatactaataagcagctggtgcagatcaagacgaggtcgtcgtcgatgcaggtggtgaaggaggagatcgaggaggaggaggtggcgggaggaagaggccggagaagaggagggctgaggcggtcggtatcggggagggtgagggagcagcgcgcgcgtctgtacatcatgcgccgctgcgtctccttgctcatctcctccaccttccacgactagctctacctctacctgcgccactattttttttttcttttccccttccttttctttagctgcttctgggctgggccttcaattatgtactgggcccggcccaactccatcttgtttcttttcttttctatatgtaactacgcttttttgctttgtttgcctgacttagctgggctgctctctgagagatgggccactgttgtttcgatctgcccatcctgatctgcatgccctgtctgtgtagacacatgtaccgtcctgctccttaatttggcagtcaaaataatttgctacaatttgaaagatatggaaagcacagcaaaatatgcatctaaacttttttttccaacaccgtatcgaaacatttcactctcacgcattaatcacctaattttaacggttaattagttaatatatataatcatgtgagatcttcttgttaatatataattgtaataaatacaacggtgtaatcggatcaaagttcagataagtaatttagaagaacatatttagtttaagtaatttatagaggaaaataatatttaaagcttcttaatggagtgttaatcaatttgatcctgcaacttacaaaatatataaattaaaagtcaaagagccgatcgactgacaagccgatgtagcaatgctaaccgatgtcggtaccagctgatgttgatagagttttgagcaatcagctatatatgtccaatgtagagactgatacttgagtaaataataatataaagacaatcagctaatgataatataatataacaataatataatttactagaaaccaatcggctaataatgatatgatagaataagcgttgatccgaaggttaaagcatacatcgctgtaggtccgatgtcattaaatccaaacgattagataaacagtgaaacttttgttccgatcggctaaatctaacttgtatataatccttataagccgatgcaacgtaggctagagagaaaccccgatgaaacccttgtatatcattataatccttgtagataactcatcggctgaaaccccgatgaaacccttatatgcaattaaaaagtaggctagagagtatggttctaagcacgacttagttcaaggcatattttattttctagttttttccaaatgagatgagaatatttgtagtctcgatgtgctaaattaaattgttgactgaaactcaataagtcatcttaatactcattgtttgtatgcatgcatatagtaccttggttttgttatatggtggatgagttaatccgtccttggtcttggtgacaaaataaatatgccttagacttttggatgaagggagcatctagtatgcatactcaactaaggccatatatacgatgagacccacctcatctgctagtttgaaccatcactaggatgccctaaggattataggtttaaatccaattaggttatatgctagagttctttgaaacaaatttctattattatgctgacgtacaaacatcctagaatgtaagaatctatgtgtctctattaacactagaaaataataggaagttgggagatttgtctcatcaccttatgtctatttttccccttttattcaacaaacctattggatttgtgccttatgacaaaagctggagatataaatcatttatattatctttaaaaatgaacttaagaaaatttttcaaaggaatgtttgtacctttgattcagtattggacacttagcaagaatatcatagagaggtaacacatggatcggatgtccacctaacattttctttttcttaatgaagaaccactagcatgcatattgttcgtggttccttctctagtagtttggttgatgtacatatttatactctctaaaaacaatccaatggtggtggcagtgaatctgtcgccccacctactccaatagcaatctttaaatattacccctttaacttcttaatattacacaacaactatatctaaatggatagccacatataaaattaatgtgggtagccacattttcctataggggaaatgtgggtcacatttttcctataggagaatgtgggtcacattttctctcctatagggaaaatgtgggtaacatatttcatggtaaatatgatttatttattttagaaaaatattttaatattttttttcattttatccgtagcaaacacaaacatttaactagtcaataatattcatgtattaatcgtattccttctttcagggttataattcaagtaatcagaaggtgattgcaaatgctaacacaaatagagataccaacaacttggcaatgcaaacacaagttcctactcatactagagagggaccaactttcacacaactactacttggagaggaagattttgaccttcctccgtatgttccggatgatgctaaagagagcaatcagttctatcaacaaacaacgaatgagttccttaacatgaaccaattggataacaatggtataggaactgctcagttggaatctcgggagcatatgatgacatatggcttaagttctggtataagttcacagcttttaggttctcaagcaatagacgtagttgatgttgtaggatgcctaacttcaccacggggtacccagctgcatgagggtcatcttgcacatctaatgtcatatatccgtgcatgtcgtgatctagagcaacatacccctcccaactttgtcatgcatcaatctattgggccagtgttgaaccactatgcccttagtgcagagatgtcatattccatgagatatccagaaaatgcagctactcgtggacctcaaaatattcttgggtttcctataaaaaatgcagacacacgcacagagagagacacacacaaacacatgtacacacacccaaacacagacacatgcatgtacacacacacataaacgcacgtatatatgtagatggtgaaccgcaacttcttcatgctcatccactacgtccatcgcaggcatgtcctagcccgcctccaaatcctactcgccgctcgcggtccttatatagtcttattaatttttacctagcttgcattgttcaatacatcatctactgatcgatcagctagcttgttttggacaaacatatatctgtataatttctcataagcaagtattgagttgattcattcaattcattgatcgattcaggtgtccaatcgctgctgcatgcacagaggaggcgcctgctggctcttctcaccccgtcgctctactacttgggttaattacaatcgacaaactactacctaagctagctagccgctggctttccttcattttactccctccgttccataatataaggcacaaccacttttattagatattccataatataagacatgcatgcaagcatgcaattaactatggcatcttctctattaaattattacttttttaaatcctccactctcatgttatctaatcctattggatgcatgtattatatttattaggatgattctaaaaaaaactacaagatgataataattatttattgatctttgggttaagggtggttgtgccttatattttggaatggagggagtaccatgcatgctgtaactgcgattcgtcagtccggtgatgttatacaatcacaataagtttatcacaactatagcacacaagcgttttaattttaggaacaattccaatttacccccttaaaactattgcgacagtataaattaccccctcaattaaaaaccagatattcttcaccttcaacttttcataccggatgaattacccaccgacggactcaggagcggtttttgttgtacgtgacgcacacgtggtagtccaatcagcataaaaaatataaaagggtagggcccacatatggtgactgagagaagaggtggaactgacaagtgggtcccataattttttatttttcttatattgattggattgccacatggacgccacgtaggatcaaaccgctccgaagtcaactagggggtaattcgtccggtatgaaaagttgagggtgaataatgtctggtttttttgaattgaggagggtaattcaaacctaagaagatgtcatagggaaaatatatacatattatatgtgctgatttttctaaaaaaccggcacttaagcagcaatgccataggtaccagttttactaaagaaccggtacatatatatacttacaattttgctatatatttatcgacaaatttttctcaaaaaaaatgacactgtaacttgcatgtaactacaatgtaacttatacgtaactaattttgaaccattagatttctttcaagattcgtgcaagtcatgaagaaggaaaaacgtcacggcgcgcgcacatgtgagaggatttgttcccacaacctccgtttcaccgaaatagcatgttatgtaatttttgaaagtcacatacaagttgttacatgcaacttacagtgtaattaaatcacgattgtcaaattgtctagtaggtgttggttctagaatttcgggcacttttagtgccatccttttttttgctgtgatactacgtacctggtactagcttggagtatatatctgctggtataccggccgggcagttgagagtaataaagatggagtaggtaggatttgcattgatatatagataggcataggtagtatgattaattgatggaagaagaagatacatccagaatacgagtacattagtgaatgagtagttaggatggttggggtgggcagaaggtgatgaggtagcgcttggcgtgacaacggttgaggctggtggcgtcgtcgtaggcgtagctgtacgcacgagggcagatggccttgaaaaggtgggagaagatggtggggcggcacgccgacggcgaggcgtagtcccccgtgcagcagtagcggtcgccgcccatggccctgcaggcgctccggcaacccgccaccctcccttccctgtcccgcacctccagcgccgacgggcagcacacgttcacgtccgccccgcacgccgccgtcccgcaccccacgcctccccccaccgccgccatcgacaccggcgcgttgaacccgtccaccaggctcacgtcgtagaagtgcatcgccgacgccgacgtccccagcgtcatctccaccaccgtcgcgggagtcgcccccgccgcgccgttgcaccgcagcacgccgccgcagtcgcccgtcgcgcagctgccgcgcccgcgggagtcgaagctgcagccccgccgcggccacacgcgccccgaccaccccgccggcacctccaacgccgcctcctcgccggcgcccaggtggaagccgcccgactgcggcgtcgggtgccccgcggtgcccagcagccccggccacaccgactcgccgcagttgttcaccatgatcagctggatgccgccattccctcctcctcctccacctgcaacttcatccctcataattaattagctaccaattcaaacggatcatgcatttctgcttgtttaactgccatgtacgtacaagctgtgattgccatgatgaggatggcattgacgacgagcagcagaggagtggccatcaactcaattaactgccaatatatagctagcttagtcgcttgatgcaactgatgatcactagtctgtggggggaggccagccaacatatatataacctgtcaacactgactataaaaattatgcagagggagctagcctccctagctactgaagctaactgacttgttagcttacttcctttcctgtaactaacacctgggacatccatctgaagcgaataaacatactactccctccgtttctaaatgtttgacaccgttgactttttagcacatgtttgaccattcgtcttattcaaaaacttttgtgagatatgtaaaattatatgcctacataaaaatatatttaacaatgaatcaaatgataggaaaagaattaataattacttaaattttttgaataagacgaacggtcaaacatatgataaaaagtcaacggcgttaaacatttcgaaacggagggagtactatctatttcagtttcatgtgttccataagccacaacacgttgctgccataattctgtcgacttgttcgtactaccactagcaatgtctacatgctcaatcagcaatttaggcaccactataggctacctgatgactgtgctaggctgctgtaactcaacttcacacctggcttcagttaattagcttactgacctgacctgctcttcacatcttattgcacattaattttcagtttttcacctatgtgcagtgcaatcagctaatcggatgcctggcgaccaaatcagtgcgagcagagtagcgcagcaaactccaaaggctgcaaattactactaagtaccaactttaatttcactttcttccttttcctttggggattgcgatccatctctcagcaggtactacgtcaggatctattccttgctttgcgctgaggtttctcgctttgtacttgtgctgcgcaaatgcatcatcaaccgcatgctactagagtatttatatatctcctcgtcctcgatcgtcatttggataaggaaaagaatttgacaagtcgtagccgtagccccagttgcaatctccttctcttttgcttttgttctctgcttttttttcacgatctctatcctgtgaatgccgctggggtctatgatctttcatatgcatatgtaattcatcagaaagcaaagcatgcatgtatgctctgttcagttgctttccaaatcagaaaaggagtcctagtcgtctagctcgatcactgagtcactgatatgatttttctctacatattcacaccaaagcctgaagatacattttaaccagaccagtcacatatatcgcttcttcttgttgatatacattatgctcaacagtattacaattttatatttgaaatatgctgcacacagactgtttaaacttgaaataattgagcagcacgcacaacacaaatacatgggcgtgctttttagcgaggaccgatattacagaacgaatataaaatacacaaaatacgtacatcaatttgtctgattagctacagtaaacgaataatgttaatctccttatcccaagttaatgctttcagtggctagttcactttcattgtgacttgtgagatcatttcgtctcctgaatacatgtgcatactccactatccttatcttcctctgtattagtacgtatcatcgtcaaattgatctggcttttaatctgccgctgccaaatagacatcggcttattgctgatctcttaactgtaccgtcagtgtggaagggaattactactgaaatcgggctccagcacggatggtcactagacctgccaggatttttggacatatccaagtgaagtgctttcatcatgttgaagcattccttcacctcatggtcctgcagttagtttaattaacaccatcagttaactctatatgttttccagacgggtaattttaccatcattgaaaatgtacagaaagatatcacattttctagtataaaattaatttgttacctccagatattaaatatctcgagttaccaaaagttttagtttaaaatttagatacctcagggtactttttcaagggtcgtaaaatttcttttcctagacactagtactatgcccgtatattgtaacatgatctagagtaatagggtggaaggggtgtgttggtttggttttttatcggcgctgtgcgcggtatgggagggggatgggtggaccggttcggttttttacaggcgccacatgctatagggagggaggagaacaactgagtgtttaaagtagtagagaatagagatagagaagaaaaactttgttgtatatgtattggagagtttgtttagaatcattgtcccatgcaacatataaagcaaccttaccctagatttgcatcataaaaagagaatatgcaaataaacagagtagctagtgtcctgttcacaatattgtaacagagcattacggtcggatgtgaatatgtaaacagagtagtccagcatttgcagatggcgacttgggcagtgaatgatgaatcacgaacgcaaaaataatagtaacaaatgggtagaatattgttgaagtatatatagggtaagaaattaattaaggtacgtaccgtctgggagaaaggatgaatgaggcggttgaggaggagatgattggggtgttgtggtgtagtagaggataaagtaagagcagaggcagcaagcagcgaggcatcaaagcggagaaaggagggatccaagagggagcggaggaggagggccctagtagttgtagtagtagtagtaacggggaggaaggagaaaggggtgacgcaggcgaggcgccagcggagagccttgagcagcgtgagctccatgtcccggatggtggacgcccggaacgagtgccccatcgcctcctccatctgtcctccacacaacacatgcatccatccttcagttcacttcgtatcgatcgatgtatatgaatatatgatatgaatgcatagatatgatatgaatatgaatgcaccgaaaattaaatgaaatgaaaatatacgtatagtacctgaaggtcgtggagcgaggggatggtgacttcgtcgagcttgcaggcgagggacaggcaccccacgctcaccacttccaccatccactcctcccacttctgccaatattaattggcaatgcatactcagttactagctagaggagacgtaccactactactaactgagtactccgatttgatcgatagatttaccaaccaaatggcaattgatggagaggaagcgatccagatagttggctgcgttgaacgccgtcgcggcctccagtcccagccttcccattgcctgatcattcatcatcatatatcaatctttcgattacaaattaaaaatttacacaacacaagagctaacaacaataattatttattttgcacatcaataatctatctcttagtgtctagatatcactatctatcagaatgtacagatcatggaagaatatatagctagttaattaatagagagaatgatcggtcgatacaagtcgagaatctgtacatacatagatgatgtaacgtacggctttgagcctggcggccgccacaccatgctgctgctgctgaagaagaagatgatggcattgcaggtagcagcagtaatctctgatctgaagagcgtaacacctctgcttcgccttgtagtactccatcacctcatcatcaatatcatctggcgtcgtcgtcccagcttgttgctgctgctccggcggtggcggcggcggggggggcgtagagtcgaaagggtcctcatcgcagtagagatcaagagaattattgaaactagtatcgtcgtcatcatccatgcttgatcgatctaccgcccgccgttcaccgtctcttcttcatgaattaattctacctagctagcagctgcatatgcgatcgagatgctccctccctcccatggattatatacctacctagctatatctaattaattaatgatcaacaagctagaatgtatatagccaccatgcaatataatggttgtgaaggagacgcagcaagcaaggcgaaggcaaaggcgggcggcatgatcg

SEQ ID NO: 80288 - DNA, 44911 bp, Oryza sativa
tgatctaattaacaaagcagccctagtctgtgccaagccactaattgtacatcctttttcactgaggatgaaggataaaaataaaacaatattctagtgtgttataacccaataagacaccattttttcctagcaatatttaaaaattattaatatgagaaacgtgtatctatggatgatgcatgtcacatatgacaaattaacagttcaccaacggtgaaactttgtgtgatcatcacatggtagctagtgaacacatatactacaaaaacaaggtactgtggcacttgataaagaaccaataacggcatagcattattatacagaaatctcttattcaaatacagtaatctgtctctatggatgataccccttataacaacaaattaacagtgttaaccaagggttgaaacctgtgtgatcatcatacggtagctagcgcgaatgcatattcctacaaaaatatggtacatatatatatgatacttgacaaagaaccaacaagaaacagacaaaaaaactggacccttatggcaatttagtgattgattggaaaaactaaatgtgcaataattcagtaatagaaactactaggtcatttgatttccctttgtaacgtatatattaattgtaagaatgtagcatacattcatatggggaaaaaggccaaaacatattagcatccccatacaaactataactcactagcatgtatattaacatggtcagtgtattctttaatatgcaatttttgctaatgtgagttccacatttcatgcaaactgccccaaatttgaagattatcctgtatgggtcaattacacgttaatataataatatactataaattagcaattctacctcacagagtgtctatatatatggacggtgcatttgcctacagtgaattgttttatagagctgaaagtagttgtacagttgatcttttccaacgtagctataaggtaacagtattttggtactgtcagatatacaaagtcagagcttgtacgttaaagtagttcttgcaagttccaagccgtagatgaattaacacatgacgatgttggtgagtttaactagtgtgttgtgttcatgagatatttattgcagcaagtttataattaacacacaaaagtatccttgataatatataagtaaacgacaaattttgatcaaaagcggcattcttcagcaaattttgctcatcaacagctagtactaaaagtggcattcttccaagtaaattatttaaactccatcaagttaaatcctccaaattttaggctaattcagattctagcatttgtacacgccatgatatttacatcaaatgaaacccctttcttaatttttcttgcctgctatgacacacatacatatatacacacacggtatatatacgcatatatgtacatgtctggatctcctgccgaggacaacctcgtcttctttgccttgttcttttgtagccttttttacatgaacagtagcttcgcccaatagaacagaaagaaaggaacaggcgtagaaaaaacaacacgtacgaaatcatggcccctcccataagttcatgcacggacgacgacggatacagtacacgcgcgagaaaattcagatcggtcgtgatttcttgcagattgtgcgcgcaaagatggagcaaattgcggtttggggagtgcaggttaagcaagttgagagaatttgattaggggaagaggaggaagctgagatgagtgagaggggcagtgggtttacttggatgaggaggagaactggtagaggcggccggcgtgggagaagaggacgagggcgacctcggcgtcgcagaggatggagagctcgtaggccttcttgagcaggccgttccgccgcttggcgaacgtcacctgccggctgatcttgttctcgatccgctgaagcaccaccttgcctcgccccatctcgatctcccgctcgagatctctcttcagtcttcccttcctctctctctctctagatcgatctctagcagaccagcaaatcaacacaaacctctgaagaattttcttcagcaaagcttagctgctagctcttctcatccatgcagcatctgcatgatggatggatcgatcagtgcatgaaatcaattccgattccttgctctctctcgctagctctctctcctactgtcacacacgcacaccggccggcctgcagctgatctgctcaagctgtggcttaattaggagtagcttttttctctctatgccctacttaatctctcctctcaagagagagagatagagagaggcctggcccagcttgcagcgccctgtggatggtggtggtggtggtggtggtggtggccgatctacagcttaattggccgagagagactgagcgcgaaagaaaggcaacgagagcgagaggccgggtcgtcgacgaagagaagaatcttttctttcgtggggtagagaggcagattgaatttggatctcatctcatattctcgtctcgtctcgtctctcaccctaggtcacgtagtagtagtacgttacgtttccatcgccccaggtatagcaaaaattaataccgccgcgagcgctcgcacaatcgcaattcgcaagcttgtaacagcgacgttaacagcgaggcgagggaagcgaccgggccggcgggggcgtcgaacccgaggttgtgtacgtatcacacggtgcggcccgggcagcagcgcgcacagaggcggaatcgcgacgtgtcgagcggacgctggtgccgggtgcttttatgcccacaggctaagcggagactagctataagctaagctagccagcggctgtagcgagcaacgcccaagctctcgttgacgcaacaggtaaggtggctgtacgtaggagagtacaggatggctgcctctcttcccccggcccgccggtccagccgcttccccgtcctcgcctcgacgctgccgccgtgtttcctacgtacccgacgcgtacgcacgccggggcgccgggccacacggcgaggccggtagctgggggagcgatacgctagctaggcagccatggccggacgcgtgcgtgtcgccggctggcagggggggcgttcttccggccggtcacagtgcacgtcgcgtcgaccgggacggggggcatgtcgagccatcaggtcggcggcgtcgcctcacgtgacgggtgggggggatggcagaggacagagaggaggaggaggagaggagggggatcgatgagcgcatgagctcatctgcacagtgagcggaacaactactacgcccagcacagtagctgtagcctagcactgtcactcctacagtgtggctgccgcgctgggcccaccacgtaaccctcggtctcgctctcgatcggggggtgtactgtagctgcaatcaaagtagttgccacaacttgaagagcgtacagtacttgctaaaacctaaaattaattaaaccggttagttttaatttggcaaatttgctacagtatatctaaatcaaaacgtggattttccgagaacactataaaaatatggtaatttgctgaagaacataaacatcgattattttattgttttcatcctatttgatagaaaaatattttaggaggcccctatcccgcatatgtgaacgaaggagtatgtctcagttcgaactgatcatatccccgcctctcaatctttgtgctctctcactcaaacccctattagcaggcagcgaggcgatgacatgagtggcgaggaagaagaggagggcaaaataaacatttcatatgcctcatctcttctcaattaagtggattttacattttaaaggccgtgatgttctccagcaaattatcacgttttttagtgccctaagacaaaagctacatttttaacggtgtccaccagcaaagatcatgttttttagatgttttgtagaaaatttttccttttactttacatttctcatattgaagttgaggttaagtagaaatttcataggtgttcattttgaaagttgataaaaccccatatcgtcaccgcccaactctttcttttaaacgcaataatttcattggatattctagttggagaatgggggaaattccaaaattctaaaggacaagctatttgacccacatgaatttgtgtgtgtgtgtgtgtgagtaatattccaaagccttgagtatgttgggccctatttagattccaacttttttcttcaaactttcaacttttccatcacatcgtttcaatttcttcaaacttccaattttgatgtggaactaaacacagccttggtacttttgtacagacatatgttcacgccatgacaataggttaaagctcgaggactatttctctttgaaattttaaatttcctttccaacgctagctagctacaacctctagatataggctctaatttgaaaatgccctaattcttgatgtgtattgagtatatgatatggagttaattaatttgcaatattaatttgcacaaacaatggttacatatattgagcatggtcacaccgtgatatatgctgctccatcttgttcggtatactcatttacacacacacgtgagctccattttaagttttaacacataattggcggatatagcacggggtaaaattacaatgagtgcatggtgaaatgcataggaaattaaatagagcataagaatgcacgtgcaaagagaaattctacggtcattaagaaaatacttactggtaaaatactagataacaagttttatactagaaaatatgatacgataaaggatggtaaaattatggctcgcaaaatatagcacgaaaaaagaaactgaactagctggtgcagtaggtgtccccatgcattaatgtactcccttgatagttgataaagaagtactccaagcactcaaatgtagcctgttgcgatgtctgagaaagtaagaatatatagagaggtagtagtacgtgagaaagacatggccggcccatgtccgtttcaattgctatgttttgatttgttcttggattctctttattttgtgtaccagtcccatgcatgtcctctaagatgcactaaaagttgcgaagaagcaatcccaaccatatcttctcatcagtgtcatttattaaactgtacttatcaagtacaatgttaggtaattacgaataaacctgcatggtcctaaactaattccatctcatatgcatgtgatatgttcagagctttagataaccgataatgtcactagctaagcgtgttacaccggtccactgatccactcatgctgatatataagttcaatcacccaactgtgtgttacacagtggacaagacaagtgaccaccgagagtgacgatatattcaggctcacatatggcaaaagtgtaaagtgggaggcaatgtcggcaccacataaaggccagccatatatgcatatatgaactcgtgacagaaagtaggacaagatcgatggaaaagggaggaggcgagaccaggttgggtatatagcaaagcggaacaaggccatatctatgcacacacacgcatgtgacacgcccctaggtacaggctgtgttgttacagtctaggcaaagtcgagtaccacgttacatgcaggaaaaaggagcaaaaaaaaaaaaaggccgggtcgtagtagagctgtagccccctgttgctagctggcccggccgcggcggcacgatcgccatgtagggagcggcatgtcgggcctctcgcggagtcgcggtttggcgcgtcgggtgcgtggcgatccgtccgtccaggccgcgcgcggagcggggtcacgcggcctccgctgttacgacgcgcgaaatttctctgcgcgttcgcggccgtgcgccgcaggcggccgggtgggtggggagccgtgtgcagcgggcgcgggtgggggcgtggccgcgtgggcgtccgtgctgggagcttgcgtcgcgctgcgctgcgctgcgcggtctgcgggttccgtggagccgtaccgtgcgcacggccgcacggcgcgtcgcggggctcgaaacgtggcgccggtggcaggagcgcgcatcggaatcggcgagttgcctcccagctccgtgcagctgcggtgctggcactcaccaagtggacgccggccacatcgcgtgcgtcgtcacccctccaggatctgaagtggcagaggcattgaggagtacagtaggagtacttcagctgggcatgtattccctctctccgtaaaaaaaaacaacatcttagtacaacgcgacacattataatactctctttgtctaattttaaatgcagttatggtttttcgcgtccaactttaaccgttcgttttgtttcaaaattttttttaaaaaattaaaaacataagtcacgagtaaagtattatttatgtcttatcatctcataacaacaaaaatactaattataaaaaattttcaaataagatggacgatcaaagttggacgttaaaacttatggttgcacttaaaatgggagtacaatgaatctaaacataaagcatgtccaaaattattgtagaatgtgatacatcataatactgaaagaaatttgaaaatatactttattttttcatattttgcatttatatacctggctgcgattaatttacaaaaatatacccaatccgctgaacggatgcgcgggagcggaacccgagccggtcgcgcggaaccgagatgcgcgaccgagccggtcccacacaactggcctgcgggatcgagtcggtaccgcggcgccgatgcgcgggagcgatggagcccatggtaggacgagtgaacgcggcggtgccgcagaatggcagcgcgggaccgacgctgtcgcgcggttccaacgcgcggaaccgaataggtcgcgtgatctttgagatgtgttcttcccctaatttttctaactcatccgcgcgcacgcttttcaaactcctaaacggtgtattttttataaaaagtttctatacgaaagttgtttaaaaaaatcatattaatccatttttgaaaaaaaataactaatacttaattaattatatattaatagcctgctccgttttccgtgcagaggagatcggatccaattcgggaaaccgagatgggggcggcatgtgggagcgccggtcccgcacatccggcatgcgggagcgttgccgcgctcaccacgcccgcgggaccagcgtggtaccgcatccccggcctgcgggaccggctgctcgtcctcactcccgcgcaaccgttctgcggattgggtatattcttgcaaattagtcacagccaggtatataaatgcaatatatgaaaaaataaagtatattttcaaatttctttctcataatactaggttatatttttttgacacagaggaagtagggggctaggggctaacctgcctagtgcatcctctgtctaaaaaaaagataaaccctaactataaacctaaacgcgtgtatgtctagatttacaagttagaattgaatatttttttaactaagggagtatgagtcattcttgccacattttttctttagtctcattggcacgggtcaacataggaaaaatcttgccacaaaatatatctatgaactaaacaagcatcttaaacttgtctaactaaggctgagttcggcacttaactttctaacacactcctctcattttcctcgcgcacgtgtttttttttaaaaaagttctttacgaaagttgctttaaaatcgcattgatccttaaaggctaatactccgcttcgttttctgtgcgggaggtggagtcttggtgtgccaaccttaagcaagttgtgagtgccaaccaaacaatgttgtaaactaagaagtatcataatctaaaaaatgctaagttttctatcttgtagttcattttttgattctatagctactgttagtaaaatctagataaaaatattaactgtttgagagaattgaagattctggagaagttgcagttactatcagctctccaaacaagatcgttaattgaccgttagtagatttagcgctcctttttgggaacatttagacgctagatttgttgcgttcaggaaattacaatgttgtaaaaatgcatatttcgagagctcgaacgttattagtagtataacaattaaggctaacaacatactacagtattaaaaagctcggcgaaccacctgttttagtttccagcgttcataacattgtcggaataaatctccagtcaatacacaatcagtaaaaacacacattcgcgcgcgcacacaagaactatatatctaatcgatctttgttcaagatgatggaaatccaatcatctcaagcgagctaatcatatgcatgagccgtatgagtatgacacaccatccgtggagaagaactgggaattgatattatcccatctccacacaaggcatgtcactagattattgtgcgatcaacaagcaaaacgttggttcaccggcaaacctgagctgaggcacgattcgttccagcacgacccaggacggcagaggtcgaggcgccgccatagctgatcaggactcggtcgacggtcctgatttccgccttcttcgggggaagtcgattggaattactaggtgtgttgggctggacatttgggcgtacatatgggccagcaaatgggtggctccgtggctgggcttctgtttcgtcgcgtcggtcgttgggccgtaacattttcggatggttttgtgcaacgcggggatcggatattcggaggaggccatgcggcgccagcaaatgcgacgattgctacgtcgtcgtcgacggcggcggcgtgcgtgcgtgcgtgcttccctgcgggacgtcgtagtgcgtggcgctacgtacgactgcacgatccctccctagtcctgggctctaaaacgtggcacggtggctggcaggagcgcgcgtcagaattgcctccagctcgacaaagcgatccggagaggcgtgggtactgactactgagtaggagagtgatttttgtgaactagtgatccgactcccacagcagggctgctgttttccttttcttttccattttttcgcgaggaagggttgatgttagatcaggcgcagattaacagatttagctagttctcccaataggacatgtttagttttttttttctttttccccaataggacatgtttagttttttttttctttttcttttatggattctagtatatgccgaggttaaaatgcaattagtttcatatatatgtttggatgatagtatatacttagttcacaatgccatgcctaattatgtgtcaggctaattatgtgttatagagaccatgagacttgactcgaggatcaacttggaaatcctgaacgttgatagcaaactggaggggcacagcaccaacgcttgtttagcacaatcccacgaaagatgatcaacacgtaggtgaaggtaagatgatctgggcctctggggccatccctggcaccaaaatcgaatcgatgtcctcgtctccataggatgtagaaactataacttcttaagtattctcacagtaaaagagggagcattgattcaagactcaattacagagcaagacaatcaaagctaagcaataaactttaacagttcgtctacgacagaaatgcaattcatcaaactattgctgcctcttcaacagattagcagcagcttcctacacaaccaaattatagcccatgtagtccatgaattgctgttctgtagattatttactacagagtgctgacagctgaatgaatccattccaaattatagcccatgtattccatgacttgctgctttgcatattatttactacagagtaccgacagctgaatgaatccattccattggccactgaatgaataactagattaaccattgatattttagacaaagtctgacattttcaagtggaaatatggtactaatgttatggtaacaaaataatatgctagaaaatctgatcaaatatatcaatgactagtatgctagaaaatacatgttgcgttgcctagcattattaacaccaccatcactggtgcaataacttatcataaataaaccccttcttccaacaaacttaccaagcaacggctgaagtaagtaaccatatttcacacaaatctttgttgtttgaagaaaatcttgaaaccaaacctttgccacttgatagaacatttccagtatcagcatccacaaattatacactttgtgaaactagatgtttctgtgaggttccaaaaaacaagaggtagatctgactgagctaaattaaagagaaatatatctgtggcttagctaagattatatagccttgatccaaacaataagaaaaatatctatacacaaggattgataacaagtttaaaacctgagctccacagatagaatatattgcattgtaatcttaagatataagagccacacagatactgataaacctaagctactctatgtaagttcattgactatctagaactaatcatgtgtgatattgcaggtcctaagagagtaagatagatgcctctttaaaccgttcgtgtttgctcgcacatattttatacatatatcatgtaagtaaactagtgctcctgcctctaaatgtaattaagtggcttcagcagctattctgcaggtattggtgtaagaaaattccagcattgcaatacatgtccgaacaaaggaaaatgattaattaaccattagacaatacacctcctgctcagctgcttgatgcagcaggtgtctgtgcacggctacttcgcttgctgcttggcgaagcaactagctgcggcagcatagcatccaagcaccaatctatcatgaatgcacccacagcacacagaagcactgtcgaatcaatcatacaaacatccacagatattatgcactatccaatggatctatctatgttcaagaatcaagatgattgataatgcaattatacaaatcaaccaaaatcatgaggcagatacgagtatcacaccatctgcagaggaagcacatcaaactgaaaacgctataagattgagcatgagccttctcggagggaggcatgtgagttctagcgaaagcgttaaaatgaaataaccaaataaattcatgctccttcagtgcatcaagattaagcaatcaatgagcaagcacatactggtaacgataaacattagtagtactaaagagacatgcaggctgtagcaaaacaaacccagcttgtgaacataaaacatgtcattcagaatctgatctcctaatcagcagcctggcgaaataaaaataaaagaagtctagctggctcccacaccacacgaattacttctctgatctctatttctgcatgctcttccactcgctccattgctggccaacaaaagaagaagacaactcagatgaattgtacacactgctaatgccataacatgcttgctacagttgtaagcaagacaattgagtaattgtagtagcacaacattgagcactaaaatgaagatgacaaagcagcaatatcagcatgtatgaattgcaaatattcaaacaaattaagcttgtgtgtatgagacaaaacggattacctgagcacacaaccctaggaattcacttgggcaaattagcatcagtatatagtcctcattcaacttcctcttgcctttgccacaaccaggaacctgaacatgacggtcaaggtatctgaagaactcagagccaaacaaacgctgcggaacaatcatatctgggggaaaagaaagagggctggactcgagcctcatgcttctcatgtcgaagcggcacatgtggtgcaccgcaggttccccacattcgctgattggccccaacagtgaactggacagcgtgaagtagagggcattgtcttcatcttcctccttcctcaggaaagggtagactggctgagtctccggcaatccattcttcttgaagtcctccagctcccacagacttcccaggctgagctccacatccttagtccatccccaagaggccgtgtccagcgtccacactgtcatggtcttttcatccaccggcatagaatcttcgaaggagatggagacgaacttgatcgagctcccagaggtgcaacccatggtccggtatatctccgccggcgcagtatccggcatgtccagggcgtcacactcgcacccatggggcagctcgatgaagctgaagttgacgtggtagctgtcgaagaggtcgctgcagcggcagcacaggacgcccttcgtgaggtcagcccagaaagcatggcttgtggacgtgaacttgacgtggtggcggaactccgatggcgtcttcccctccgggaagacgggctccttcaagtgccacggctcaatggagggacccggggtgtcacgcagcagcagaggcggtttctccgacgatggcggcggcggccacaggcagagcacatcacggtggtagtagttgcatccttgttcttctttctggtactccaaattccgcgcgaagagtacaagggtgtactcgtcgccgtagcgcacagggagagggtcgcacgggtaataggcctggcaatagggatgagcagatacatggggtatcatggagagcgaccggagagtggcatcgtagataaggtagtaattgtcacgagcgaaggagtaagacacggcgaggatgatgaggttcttgtccgcgatctcgacgtagccggtgacacacgaggcgtgtacgatcccgtgaagatccatcttcaggcagccagtttgttccgtgagctcctcctctatgatggagcggatgaccccgtcgtttgcagtgatggccaactctgattgatccaggcccgcgtcgccgtcggcgaggcgcacatatagcttcagacactccgccatcaattggccatacttcttcccggctccgtagttcttgttcgtaaaatcgacgaccttccacccttttgctgttggaccgatgcaaaatctgtagtccgacacgtttggatccagcaggacccaggaaggccatggcgatgacggaggcggagaccgagacgccgccatcgccgaggattgcggtagaggaaggaggggggaggggaaggaaggggaaggaggcggagattagatgtgtgcacggtgagatttgatgggggaatacttgagagaaactccctctcttaataaaattggtcgatccggaaaaaaaaaagggactagctacagttatagtgccatattttttaccaaaatatagtcggcatgtgtttatattgtaagtctctaaattatatatataattttagtgtatttataatgtaagtcttaaaattacatatgtaggtcttaaaattacatatgtcaatcccaaaattatatatgtaagtggtgtgcaagtggggtgtaactaccgtgtaaatttatataaatatataatttacaacaacaaccaaagtttaaaaaacataacagtatgcatctatggcagagtgtcagaaccaatcaccgacatgaaaaaaaaagtaaagcctgtgtgctgatgccccgtgagcacgaatcttcataccaatactaaggctcaaaattcgactgcgtttatgggaaaaatctgtcgccataattatagccaatctgaaaaaaaaaacttgagagagatggtgcgattttgcacggtgatacgatcatacgagtagtagaaagaaaagagggctgagtcgttagatttgggttgtcacggatgtccgattagcggacggtggatgtgtgctgtaaataaagaaacacataaacaaaagcggaaaatctatttcgagagcgctctcggtttagctctatagcacgaagcatctcacagccgtctgatcgtgcacgtcgtcatggcgtccatccacgtggatgtctttttcctcttcaaataaagttctctcaaattatttatccgatctacaatccaattacaccattgtgttcgttacaattaaatcttcacaataagatcttacatgattatattacgatgaaaaaatatttatatttgtaaattacttttattatatataaaaaagttacttttagatttgactaaattatttcttagacatataaatgtaaattcaataaagtctaaaagtaatttgcatatattataaaagtaacttaaaacaaaacggaagtaactttgtcacgacattaaaagtaaattatgtcaggattatggataccacatacctaatagtagtcgactacatctcagcaggacccaccacataccatatcttatacggaaacaaccttcggatataggaggagttacgcataaggaaggatgactagagttctacatggaaacgacaaggactactcggattgtatccatattggtttccctagttctacttggataaggggacacctatgggtataaatacaaggcctcctaggaggagaggggaaacagataatcgacacacccaccacaatctacagaacaacagaagccacaacatacaagccaacataggccaagacaagacgccggcagatatcgacttcagggataagcacggttagtcccctatggtgtctctggatactgtcaggagagacgaaagcgctatctctgatctcgccgggcacggattcgaggaggaagactaccctcttgtcgactacgagtcagaacttcagaccgccatgtcgacaacagttagataggctaccccacatattatactggtgtgattatggtgaataaagagcaacaccggctccggccaacaggatgtagggttattacctgacaattcaggggcccgaacctgtataaaaatcctcgtccccatctcttttacctcagtctcgcatatatcctagcaccaacgatcccccatactatgcaaataacagaatcgcgatatcaaacgtcaacaaatttgttgtaaggataaaaaatatgactttatctagaaattaaatttaatcaacacacgtaagtttaacaaattttgaaagtaacttcaatgttaattggaagtaacttttgcatggttcagaagtaactctttataaatatgtttaatcaccgattgcttttttcctttcatttttgtttttcatgtagaatgagaaaagaagataaaacctttaatggattgcagataacattgatggaataactaatgagaattaaccatgtataagaagtaatagttacttcctgataacattgaagttaattttctaacatgtaataaattacttttaaattaataaaatgtttgaatattgttgtgaccttagggcacaaacagagttgggggtaaacgggaaagtgtaaattcccgtttaccctgagagtgagcccaaaagtagatgtcaggatgtatataagatatttttttctctatttcattgtgtctttgctacaggactctggtcggccttttatagtgttcgaccatgaccacaaatatttacatctttgccatcatgggcttacatgaagttaccatattacccctagtgatccatatgccctaggggtataatagtactttgctggtggtccctaggtgacatctggtgccagctggttagagtagttgaagtggtccccatagttatttttctcgaatgagtcaattgctcgataagacttttccttcttttcttgttatttcagctgtcttggtcgcacccgagaactcgaatatactttcccattatcttggcgccttgtcactccataggaacctgctcggatacaactattaagaaaaataatgtcaggtggatgatgttggctcgaatacatctgtctacttgacattaactcgaatttacttttcctcataacgctgtttcctttgggtaacaacatgtcctaaaagaacttttctataaagaggagaacttcattcgagtttttatattttaggggaaactctctgagtattttatctttaagtagactttttgggcgaaatgtgtttttggccaaacttggggggcaaagtttaccccttgctacaacaaatatattcaatatgaatctcgttttgtcacatattttggtgtggagtacaatgatgtaaatagatcttaaaaataatacgtgatttaaaatatataatttattaaagagattaaaaaaagatacatactattgcattttttaagttaaaaggagacactagatggagtacaaaccagctaccactagctgtgtacaaaccagctaccactagctgtgtagtcacgtccacaatgaaaaaaggcatgcattaaagttactttcttttttataagttacttctataaattactattaggctttattgaatttactattatatgtctaaaaagtaatttataatttttcatcaaaatataatcatgtgagatcttgttataaagatttaattattacggacacaacagtgtaataagatgaatagtctaagagaaaattttatttaaagtatatatggatagagtctctcgtaataaatagagtggtagtttggttagtcaaaccagctccaaacaaaagcctcccttaatctgctacggagtacacggtagaccgagtagtcccgccgatacacaaagtgcaaaaccgctatattcggttcgcagccttattttgacaaattgaccctttacgaaaaattattttaagattggtctatgctaaaaactaattgaaaaatgagccgtcggctcagcgccattgagattggcactgatatataacgttttagcgccggtaacgttggcgctgagatcctagatgagctggtagcaaattcgaacgtggcagagggtcagcggcagaaccacgtaccggataagaaggaagcaacaatctgtaatatatgatgcaagtgtagcctagtggtgagagatgtgctggcatgcaagacttctcgggttagatcccctgcaatgcaaatttttttctttattttttttccttggtctgttctctttctgctttcgtgaactagcaaacagctgagagaataatcaatgtcacatttattttgttttaaaaagccaaccgagtgaatagaaaagaaggtaaaaaatcatttatttttttaaaagcatttatttatttattttttcttggtatatgttctctttctgccttcttgagagaataaaaaagatgagagaatttaaaaagccaactgagaataaaaataatagataaaaaatcatttgttttttaaaagcaaacaacagaggaaaaaaataaagaaaatgggttctgccttcttgagagaataaaaaagatgagagaatttaaaaagccaactgagagaataaaaataatagataaaaaatcatttgttttttaaaagcaaacaacagaggaaaaaaaataaagaaaatgggttctacatggtgacggcgggaatcgaacacaagaccatgcacacaccaggcaagcaaccaaaccattgcaccactatcacacttccaactatgatgcaaaaggaatattcttaatgtagtacgtggggtcagcgccaacagctttaacgctgaccctctgccacgtggaatttgctgacagcttagctaggattttagcgccaacgttgcaggcgctaagacgttatatatcagcgccaatctcaatggcgctgagccgacggcttatttttgcaattagtttttagcatggaccaatcttaaaataagttttcttaaagggtcaatttgtcaaaattacagatattcgcaatcagagacgcgcaagatcacgtatgtttccttttcccggcccgctgtggattccgatctctttccctttcgggctatccataaattggcatgggggcttgacccgttcggggagcatcgacaacgttttgggcttcggcctgtttcttttttgaataagttcatatgatatttcttaacttgtcgacgaatccgatttgcgtcattcaaccgaaaaaccagatacaacgtcaactgtcaaaaccggtgcaatataagtattgtcagggttacgggtcagacatatcctctaccccacgatatacgtcacatatcgacaaggcatatccacgtgtacacggataaatcctttagcacataaggaaactcttcgtaaagacaacagacaaggagagaccttctcggacaagaattgggttgcctacgtatcgtactaggtctggtatattcgagtcctactcggatagtgcccaacctacggtataaaagggaccccccggggagggcatagatgatcgaatctcagagccaacacaacctacatagcctacgaagtcggagtctgcaaggggccaagtcaacgagagctagtcgaatcgtctcgactacaatctcgccgaatccctcgagttccgtcttttcctgtgtaatccgtgttttccaccatataatcccatatcaactggattagggctattacctatcaaggggcctgaactagtataattcttgtcttttgattgctcgatgtcgtactacgtagatccttataccagcgtaccccaataccctctatatccggtctacgggtatcccccgtcgacaagtatcatggtggtttaaacagtggtgttagctgaagtggcgtctacgtggctaatttgaagggaatgaaggaggagccagcctggcgcggtgcgctcgtaaggaaggagatcggcttaggggaggagcagaaaaactaattttctcaaggacccacttttcattatgcgggcattgagatgttttgtgtaaaattccttaaaatatcgtaggacctatgagagtttagtttgttactgcctctgttttttaataaatggtaccgttggctttttaatacgtttgaccattcattttatccaaaaaatttacgcaattataatttgtctggtcgtgagttattttatcactcatagtactttaagcattatttatattctaaacatttgcataaaaattttgaatagacgaatgatcaaacatgtgcttaaaggtaaatgacgtcatctattaaaagcaaagggagtaccattttcatttctatccgatcatggtatatttggcattaacaatatttggttgtagtttatgcatttagttcgaaaacttattaaactttgatcgtgtttttaatattgcaagttttcaaaattactaaattaattttgatagggtagaatttgcattattatgtttggtttattaccctgttacatttaccattgctaaattttgttacggttcaaagtggccacgagctaacactactatagaaagtgttattggtgccgatcgggaaaccccattgaggtctgttttcctaacgggcaccattaaaacagcacagatgactcgagtaattggtgtcggtttcacaactagcatctttaaggcgcacgcgaggaaaaaaaaaacacacaaatcggctcgatgcattggcttgaacgaaaccaatgcatcaagttgctccccattgccccaaatcaaagtcaaatccccgaatcaaaattaaattgccaccaagatcgattgacatcagagaataaatatacccaacaacaaaaaataaatccacaaatccgacgccaccttggtgccaccactaacgaatccggtgcaagaggctggggagaggtcagccgctggctatcgagcttctccgccgccgcatgctccaccttctgcttcctcaccaccgcccgtcggtccatgtcacgttcagaaatttaacccaaatttccagactattttgtgtattaaatctctatctatgaatcagccagggtacacaaaacgataaattaatatacagatctaaacgtaaataaagcgtaaatacttacaaaagaggcacttcgtcctcacaccgaaaagaaagcagcagcagcggaaaaatagcgatcctaacggggcttcagctccactccacatgcaaaatttaactggggtctgagccttggtcctctaacttcgtcttcgactcagaagcactgcacttctgaaaaggaaaaaaatagcaagactgagtacaaccaccgtactcagcaagccacaccaccgatgcattcgtgcaacgggagacaaagggaggtttgtggctatttgcataaaggcagttgcaaagcatttgtagttttaaaaacagtaaaatagttggttaattaagacaatatttaatctccactggtcaacgctacaccacgttaaacaggcccaaccatcccacctgaactaaccagccaatttattaagggtgagactaatctcggtgaatctagtcgatcgcccataaccgcgggcacggctattcgaatagtttcaccttggccagaggtgcataactatatccacaagacacaatccactggcatgttacattgcccggccggacacgtcaccatgtcgagtgattgtgacaagacccttcgcataaccctcccctaaccatccacactatgctgaggtttcacctccaccccctacaccgggagtggacaacggacaccctggccgacccaactccatcacgcccaccctcgctaccagtgcctaggaaagagtcgagctatactacaagtcaagcagttatctattcccacttgtggtaaacgttgtaagtctttcaggtttcccgtgaaccggttcttaattgctatgggtgcgactaacaaaacaatgcacccacagcccaccattaagtcgcattttaattggatagttacgactaatgaaacatggtcggatgtctcgagcacgcagctcgtcgctttactcctacttctatattccaatataagctagttaccacgtagatttggatgtgttcagcaaacagacatttcaacttcctataacttaaaaactacatattttttacccacaaatatctttgtgagaaagcatgcgtgttatactgtaggtccatgctttcaggaatttcacatcatttttaggcctttctgaggatattatgtgtgatttgcaggtccagagatgcctcctgacaaattcatgtatgctcaaactaacgtttctgcatgtaggctgtagcggtttcagcagctatttctgcaggttcaatgtgaagaaaaattctagcgttcaaaatatagtcctaacaaaaagaaaaattgtagcattctgcagcgtgtgaaagaaagagagattgtttcgttttccgagcgcacactttccgaactactaaatggtgttttttttgcaaaaagtttctacaggaaaattgctttaaaaaatcatattaatctatttttaaagtttaaaataattaatattcaatcctatagttgatccccactaaggactattaatgctatttttctgcaatttggtgcctccacgtcatctcagttattttggatcgttggatgtcatttgtgaggcaagatatcagcgcttgtagcctccaacgctggcagctggcttacgggaactgtctatggccaccacgtaggctgcctgttcacttccccatcaactccacgctcctgcatgccgcattagtccggaaaggctaaggggcgatcgatcgctaccagctatcgccagcgatcgcccctaaaaccccctccctcaacttttctttttcggtaccgtattacttttctattttagtaattttatgcacctaaagtttatacaccttaaatttacacatataaaatttagagacctaaattttataagtcaaatgtttatatatccgattcaaatttaaatttgaattcacctcaaatttacacatataaagtttagagacctaaagtttataagtcaaaagtttatatatccgattcaaatttgaatttgaattcaaatattttttatagatagtatttatatacatctaaagtttatacacctaaagtctattgaccccaagtttataagtcaaaagtttatatactcgtttcaaatttgaatttgaattatatccaattcaaatttgaatttgaattcaaatatttttctttatatagtatttctatacatctaaagtttatacacctaaagtttatatatccaaagtttataagtcaaaattttacatacccgatttaaatttgaatttgaatttgtttttttctttcaaactaattttttgattttgttatcaaaaccaatctaaacacacacgtgcacaggaagaagaaactaactacaccaatctaaacagattaagccgttgcacatgagaatgtaaactgatcgtgcacggtgatcctacgcgatcacccgtgaattaggcggccccgcattagtcggacactcgggcctctggttcggctttttccacttcccccatcggcgtggaggttcctcaaaactactactcccttcatttcttttgttgtacgacgccgttgactttttaaccaacgtttgaccactcattttattcaaaaattttatgtaaatataaaaatacttatatacgccgttgactttttaaccaacgtttgaccactcattttattcaaaaattttatgtaaatataaaaatacttatatcatgcttaaagaacatttgatgataaatcaaatcacaataacataaattataaatatataaattttttaaataagacgaaaggtcaaacgtttgtataaaagtcaacggcgtcatatattaaaataccgagggagtatctgttagcctcccacagtcccaccgccattgaagacctccaacttcatgccatcaaggctttaatcctctactacacatgtaactgatgcatgttaggtttaaatagccttcactatattggggcttattccgctccatataaatagatgttatgtggggaatcggctatcagcggaagcgcgcgcagaagcagcgtgagtcggacgcagcgccgggattagcgtgaggccggcgtgcgtggataaagataagcttgcacttaattaggatttggctgttagagcaagtttaatagtatagtcaactaccagctctaatttatttatagccaatctagtagctcattcatacaatagttacatactacactattaatacctggtcccacctgtcatacacatactgcgtcttgaagtccgtgctacagctggctacaaatctgtagcccgctgcttttctctcttcttatttatctacttaaaatatgtttgcagctggcttatagcctgctattgtacctgctcttactaggatttggttgttatcttttagggcccctttgaatcgcagggtagaaaaaacggtggaatagaaaaaacacaggattctgataggaattgaagtgtaaaacagaggattgcaaaacacaggaaaaacacaggaatgatcgtttgattggagcgcaggaaaaacgtaggaatcggatgagagagatagactcaaaggaaattttccaagaggttggagctcttgctaaatttcctctaaaatccacatgcaatgtgccattccataagaacttcataggatttggaaagcttaatcctttgaatcaaagggccaaataggaaaatttcctataagtttttaaacctacgaaatttctatataaatcctttgattcaaagtggcccttagttttggagagttcgttacaattgtaagcctctaagatgaataaagcaagcaatcttcagtgtcattctcgatctgttacacaactccggcacggggcagcgaggttaacaacctcgccttcccgtcgaccccccttgtgttctcgtttgattctaatctgttcttagccacaacaatagccatcctataaggcatcgtttcgtcgtaggctcggagctccctagatgttcacagtccttccccttgctgtttaactgtttgccaccaataccccaacattatttgattggcactttgatattttccttttagcttaggcaaaggtctttccactaattttaatttcatctcttggttttggcaggtgtgatattcacatcttctgtagaataagtggatgggatttgttgatccagcatctacgaattaccgctagctggttgtgtaagttttgttgtatccctgtctttttaatcaggtaatcatctcatgttggtataatatactaccaattattgagctttgttcctgcagatttaattaggtattactttaatacaaaaatatttatcaatatggtcttacatgcccaacatcagatcgaaagctctgaagaattaaacctacatcctacaacgtcagctccaatgttcatcttgaaatcaaactgactagatttttccctcagggccgtgagtactttcagttttttttttctatagagttgcagtgaacacactcaaggagcactactccgtggaaagtactgttaaactactccgtggaaagtactgtcaatcatttaacagctatgatctgaagactttctttaatttgtactttttgttctctccactgcttgagccttgagaggtaattattgttttagcaggcaaatgcaaaaaaatccccctactagttaatactagttaataatacactaatggctcacctcgttttatacactaatggctcacctcgttttacgtatcttctgtttcgcgtatcttctcaatcatctctcggctgcttgggcaagcagcagcctatatgcccttcgtaaatatccacagaacactgccaattcatcatacatgctcccacagaagtgctatataatggatcaagatggttgggaattcaattgcatcaaattgaccgaaattatgacgcagataagagtataacactacaccatccacagagaagcactaggaattgatatatgtatcagcaagcatcaagcacgtcaaactgaaagcactatagaatgagcatgagccatccccaaagaaggtatgcgagtttttgcaaaagcagttcacccaagataaattcaaattacttcagtgcatacataaggttgtgagatcgacaagcaaaaacatactggtaccaataaacagaagtattaaagaacccagcttgtgaacatcgaatgatggaattcagagtccgatctccctaatcagcatttgatctccctaatttgcctggcaaaacaaatctagctggctcccggaccacaccatttgcttccgtgatatctctctctgcatgctttcatcaacttcctccaatgctgggcaagaaaacagtagacaagtcagatggatgacaatgctattgccatagcatatttgctacagtagcaaacaatacaatgggtaatagtagtaattcacaacatcagcatgtataaaatataagaaaacagtacacaagtcaggtgaatgacaatgctagtgccataacatgtttggtacagttgcaaacaagccaatgagtaataagtgtagtaattcacaacatcagcatgtataaaatgtgcaatcaaattaagatgttaccaatttcagcatgtatgaactggaaattcaaaagcagctgtgtgtataatcacaaaactgattacctgactccatctcgacccaggattgcactttgcccgcatccatcttcctattgtcaggaacaaggcgctgactatcaaggtgtctgaagaattcacagcccaacaaaccagaaggaacaatcttatctgggcgccaggaaagagggttggacacaagcttcttgcttgtcatgttgaatcggcagacgtggtgcaccgcagggtcctcccaccgcatgattggcctggacagtatgaagtaaaggtctccaccatcgccttcctccatgctcagcagggggtacactggctcggtctccggtaatccatccttcttgaagtcatccagttcccacagagttccgaagcgcagctcctcgcccttggtccactgcaaggtacccatgtccagtgtccactccgtcaccgtcttgtcgtcctccggcacagaatcatcgaaggagatggagacaaacttgatcaagtccccagtgctgcagcccatggttcggaacatctccgctggcccagtatcggagtcatcaagggcgtcagacttgcacccagggggcaactcaatgaagtcaaaatggacgaagaagctgtccaagaggtccttgatgcggcagcacaggacgcccttggtgagatcagcccagaaagcatggctactggatgtgaacttgacgtggtggcagaaggacgctggcgtctccttcgagaagcgcggtttcctggtgtgccacggttcaccggagggattcgggtacatcttctctcgcggcggcggtggcggcggtggcagcaacgttggaggcgacgacgactttggaggcgtccacaggtagagcaagtcaatgcaggtggatcgtccttctctcttgtagggatagttcttggcaaagaggactagggcgtactcatcaccgtaccgcacagggagagggttcgacggtaagtagatatcgcagcaccaattcgggatggggatcatggacatggatgcgtgaatggcatcatagaggaggtagtgcttgctagatgtgaagacgaaggacagggagaggaccatgaggttcttgtctgcgacctcgaccgcgggcagtgacacctgagatctcatcgatcttgtcgaactcgatggcgcgaatcgccagatccggcaccatgaggccggggatgaagattcggcggccttggaagctttcttcttcttgagttcttccgccacgatgttgcggatgatattcttgtcggcgcagatggccaaccgagagagagccgggtgctcctcggcgaggcgcacatagagcttcacgctctccgccaacaaggggccgtacctcccgcacccttggtacctcttcttcttcaagtcgatagacgcccacccttgttctgttggaccgatggagaacacgtagtcgggcacacctggatccagcaggacgcaccgagacgccggcgacgccatccctagggtttcggtggaaggggagaggaggagaaaaaggggaccggtaagattttgatgggagaagaagaagattttgattcggaagcggtggagccgaggcaaacccgatccgactatagtacgagcaaagaggaacgagcgttgaatcgttagatttgaggtgtcgcggatcgtgagattggtggacggttggatgtgttgcctaaacaaacacataaggcgacatccccctgaacttggtgcacggtagaccgcgtagcctatctgggaacgcgcgccatctattttttttctttttcttttttaatataaaaaagtgcccgtaacattttaacgggaagaaaattgaggaaaagtcgaaatatttacattctggaattaatggaaatacaaattttatcatctttatataacgctacatatgatatcataattgcacatatatacgatgttgaagaaaaaaaggcacataaaaattaaggtgaattctaggctgacctggcttggctatatgataggtctaacatcaccgtactatctgtcgaattgcaaacaccagcacgaacgattagaactgcatgtaatgttacatcgtagttgcatatcctctctaaaaactgatgacatcattgaatattgggaacatgttttcatcaagtcatttttattgaggccccgtttggtagggctccaaactccaactcctaacactaaacttcaacttcagtgagagctagctcctattagagttgtgccatgattatggatacaacacctaatagtagttgactaaactcggcaggacccaccatatacaatgtcttatacagaaacaaacctcgtatatagaaggagttccggataaggaaggataaataaagttctatatggaaacaacaaggactactcggattatatccatatttatctccctaatattatttggacaagggggcatctatgggtataaatacaagcccccctaagaggagaggggatagtcacaaagccacaagccaacacacgtcccccctaagacgacggttagatatattatcacaattattgtagatatattatcacaattattgtactttgtggtttctatatcaatcccatataaacaggatgtagggctattacctgtcagataaggggcctaaacatgtataaaaatcattgtctctgtctcttttacctcaatctcgtatataccctggaaccgacgatcccataccatacaaataccgtagtcgcggtaccacccgttgacaagttggaaactcgttaaaagtgttcggctaactttcagctctagatccgaaaaaaattgaaaaaataaagaaaccaagccaccttggccccagccgcgcatcgtctccaccgcgccgcgcatgctgcccgttgccatcccgccgcgctggccgtctttgtcccggccgcgcaccgcccgtcgttgtctgtcgtcgcccgtcgccaccccgaccgcgcgccgccggtcgtcgtcccgccgccccacccattgacgtcccgtcccgccgcgccggtcatcgtcgtcccgtcccgctgcggccgcccttcgtcgtcccgtcccgccgacactgaatcgggattaggaggaagatgtggaggagagagaacaggaggaaaggaagatgggggtatttgagtggcattttcacgtaaatacactaaaaagttactacctccgtcctaaaatatagcaatttgtagctctgaatctggacacgtgttttggggtagtaggtcttttggggtggagtggagctatggagcagcaaaaacccagctccaccccgtagttcattttctaggagtagctttgccaactccactcaaaaaatggaggatctggaccgtttggcacagctccggcttcaggtaagttaaagttgggagctagaactgtgccaaacgaagcctgaattgatcttattgaactctattttgatgagcggtgacaacagaaatttgaatgatgcacaattcttgtgatctgtgagggacatacacatgcataagtatcatcttaatccaaattgagaatgggatgagctcttataccttgattttccttttagggatttataaattacgtctagaatttataataaagttcaattaatttaccagtgaagtgaatgtgagaaataaaagttcccaaataaaatatggctgaatttagtttttattaaagtctccatgattaattacactatatgattatttttcagaatattcatagctcaattgacaagtttagtaatacaaatatctttttagcatttatctctatctctatattatatatatctctatctctactattataaaaattgaaggtgtttttgccgatactttggtacgtcatctgtatataagtcggtttttaagttcgttcgcttttagaaatacatatccgtgtttgattcgggttttaagttcgttagcttttgaaaatacaaaagaagttgtataaaaaatctctttaaaaaaacttgcatgcaaacttgagatgatcgaactcctaattgcaactcatgattttatggaaaaaaaatatccaagcgaattcccacaacgaattccaccttaactgaaccgtataataatagtaagattgaaataaccttcacccgttgcaacgcacgggtattttttctagtactattataaaaatttaatatgtttttgccggtactttagtataccatctgtgtttgagtcgatttttaaattttatagttgggtgcccgtgcgttgcaatggggaaaatgtgcatcatttgaaatatacaatctatgtcatatataaatatgcacaaatcaatgaggaatcgtttccttgatctgaacaaaacgaaattgtaacgaatctgattcatttgccaagttattatgctatatattaagaagtaaaacatgtagatcgttagattcagcaaagagaaatatggacatgtgcacccacgtcaattctatgcttctttatatgaacaacatggtttaatcacattccgtagcacacaaagaaaaatagtacgtatgcagatcaaaaggattgtgtgaaaaatgagaaaaggagaggctacagaacatgggtacttagaattaactgacgaagcatgaatttgcgatattttcaaaccatgccaaaatgttacgatgcatttcttcaatcaccaaatctgcatacagagctagaatgagcatctctgaacaaatataattttcatcaaggaaattcgagttcaacaatcagataattctaattacaaactaagagagacaacaaagaatgatttctatatcagtctatctttctggtcaatggtagcccgacacatactcgtctcaaacacgataaaatgcccaaacatagataaaataatgaaaacaaatccatttagttgttctcatgcccaaggtgcatgcaaagttttatatgggcatggtatcttaaataaagcttttaagggggttattgaccaaatgaaaggactactgaacattaaaagcttgcacgggttaaaagcttaaaaggaacctcaaataaagcttaaaaggacaacattaggtacctcaaatgatgtgtaccgtcagaacatttaaaacaaacttgcttgggttcaaaaccttaagctgcttttcatctggcaaaataactggaatattcataaatgaacagcaacaaactgaatttcacaatcttagaggacacaaataatgaaggcgtaaagtattcagttaaaaatatattgtgctgaaaggttgaagtattcttttttcagagcaatacatgcttaaaacatgacaattcaagagcaaatggcgtcctatttactttatatggtttaaacggtgatagtggccttaattaaagtatgcagaaatcatcggctctcaaaagtattactgattttgactgtaacttaatcctagttcctgcaccaatcagtcgtttcagtcatcccatagagaatgcatttggttctaatttaagcagttactgattcagtttgaatgagctgaacaatctactacagattctggtgcataaattatgtaagtgtgcacgtggaacccacgtcaataataagataaaacagagaataagcccataatattttcacgtctctaataagatgaaacagaaaataagctcctatataacaatttaatgattccatgcctctaatacgataaaacagataataagctcccatacaataatttagtgaccatacaatactttgtatagataatctttctgataggaagagcattgctacagaccaaaggatgaactgccccgaaagggcatagcatgagtacaacagacccattatatataacgttaaataacaaatacataaatgaccgtcttcccattttactgccaaatgatgccttcgaaggctcatagatgaaggaagggttatattggcctcagtcctcagaagtacttttccatgaacccgagttaaatataatagaggtgaccaacatcagttaaaagaaacacatgtagtagagagaataaactttatgcaatgtaaattatgaagtaatgctcacggaatcagtgtcagctaaaaaaatgtgtggttatgtattaatgtgatctaaattagagttcgtaagtactgcagcctattctctacaacgttaaatggatacggaaattgacggggcaaggcaaaccggcaaagtgttctctcgtactgcattccagataatcaaatgtgcagtggatagtttacagcgatatgcaataatattaacaaccttccttttctatactcattcagcttaattgaaggaaatgattctgccaagatgcattgatagcagtaagatgactgcattggtaaggaagataatatacaggtaaagaaactaaccgtgtgagcatagatgatgcaatttactccatgactgaatcagggattagtgtattttctgctcgcatattgactaaatttcattgagtggaggtcttctctcacatttatagaattcaggtgtggtttatcaccatgaattcccatcagcaattacgctgatcatcagaacttaacatgagacacttaccatgaggaagtatatatataatcaaatccaaaattttatgtctaatgtgagcacctagccagtaaaacaactaccaggatcatgaccaaacagagagacagtatgttaataccataggagaagtcgttgtagtgatgagtgtgcaccacatgtaaatgcagcatcacagatcaataaattgacagacacaacatagatcaacgatatttctatcgcatgttaaaaaattgatatcgcagaaattaatcaagtaaaaacaggacaaacagaagaaactggtcttattttcacagtaggaaagagtacccgggtgatgaaggaacctgacgtcctgaagaagagtgagcttgtgtccagtggcaagatttcacttcagatctacgccgtttgtgagataataatttaaataccatgggtaggtacaggatcaatactcttttttcgctggtagtactctcgcatcttttgaagcctagcttccttgtcgtcagcactaagagcagcataccgctccctagcactcttccgcataaattaaactcaattctcggcagctttgtatataagcgattggagttaaattagtgatgccgccaagtgtacctgcagaaacttgtacagaaatcatttcacaacatagcaacagtacgaagaagcgagacgaaaagggagaaaacagataatgtccacaaatcagatacacatggtagatataccttcaacaggaaagtgtttcttttacttaaaacgaaactgtctaagtgatactttcacatacattttgattacagctcgaacaaagcattacagtgctaaaatcactttgaaaagtgaattggtttctggacatttgctcaacaaatttatgaactttagttgatttgtaacttttctagatgggggatgtctagcaatcgaacgctatataagaaattttgtttaccttttgttgatgggaatgtccctcagtgatggaggggagacgggtgagtactgcatcacccgccgacagcatccagcgacgatcggaggactggcgggcagcttccggtgcggctgatggaggggagacgggtgagtactgcatcacccgccgacagcatccagcgacgatcagaggactggcgggcagcttccggtgcggcgcgaaagggaccgtggtggagatcgacggagaggagcggatccagttgcgagacgtggcgtaggcgacggactgtcggcgtggatgtgggctgcgcacgggggaagcggagtcgacgatggaggccgccgcgggatgagggtggtggtctagtgggaggccgggatgtggggggttgatgcagccggctgacaggatcttacaagattcaacactgatttaagcaggaaaaagggaaacaaatcacaagaacacaagaacacacgatagataggcaactttagtggaattatactccaatccaacaggattgagtccgccgccgccttcgcctccgagttgccagtctcaagacatgtctctgttcttcttagacttgagtacatatactactcctcctctctctcacgtgatacatcgccagctggacagagccaggctgttacaacgacaactgctttacgcaacccattgagagacttgataacgtgggttgggcttgataggccttgacgaccgacgcttggccaccaagtcttgttctcctcctccttgcttcgcgccatcgctctccactggagcttcagcttcttcctcttgctcttcagattcatcaggacggatctcctcttctgtatctttttgtaccgctaccttggcgttgcttggcgtgttcctgacaatccctaccccttgaaagcctgcttgtccccaagcaggaagtccaggaaaccttgtcttcaaatcttcaaggtcttcccaggttgcttgctctggtaatgtattagaccaatgaattagtacctgaggaatagtattattacctttcttagtgatgcgatggtccagtacagtcaaaggatgctgtatagaaggcatgtggggtggcagaaggggctgaacaggggccttgaatcccttggcggcgggtgatggagaggaggacgcggcgacggaccggacggcgtgaccggcgttgggggtagtgtctagggtttcggagtcggccacgaggagtcctccccgcgccagcggtggttcgacggaggcggtggcagcggcgaggcgagcagtggggtagggagctggtggagtacggcggggaggagcgaaggcggcggcggcacgggacggttaggggacggtaatggagccgtcggcgacgcggtggaggaggacggcgatggcggcggggaggatcgaaggcgacggcggcacgggatggttaggggatggcgatggagcggtggatgcggggatgcgggagcgatggagcggtggatgtgggagggatgaggcgaggagctgggtggggatcagtgcgccgttggatttagcgatccgacggttcacattctgcgtgtatgttagggttggagtgaccggcaccactatgaaattttaaaatagtagagaagagttatctctactaaaatttcgttgtctgttaaaaaagaaaaaaaaatccgactcaaaagaggtaaaaaatgaagaaaaaagtccgacaaaaaagcgattaaaaaaaagcttctaccgaaaaaaaatctcgactccgacttccgtaaaaaaaagaaaaaaaagtttcatcagtaaaaaaacaaaaaagaagtccgtttagtccgacttccataaaaaaaaggtctcctcagtaaataaacaaaaacgaagtccgtttggtttctttcgcacgggtattttttccgacttttttgcacgtgaaagagttttttttagcacgcacttaggctcttggttttttcgtccgtattttaatctgatcgtgcctcccgggcgctgttggtttttttcgtcaattttattgtccccggttttttctcccgtgcactttttgggttttctcatgttttttaatccgatctgttcgccgcacgcctcccgagttaaaccctgatgccgcgccgccgccatattgattgtgcgtttatcctccgatttgattgaaaaatcgattccccactcctccgtcattattttctccattattttccctttcgattcggttttaatttgtcggatttaatctccgtttaacggttgccgatgatgacaacaatcttccccggccgtttttatcccgagttttacgctctgattttggaaaaaacggaaggcgatcttccccggtggttccctcaaccaattttggatgatcgagaaagattcgacaagatttgattgggagatttgctccggcaaccatacggccacgagacctagcaaccgtacggacatgggactatcttcgagaggttgaagatggtagtagactgtgcgagttgcgcttacagctacctgtggctgagtcgaagggaagcaggcaaaacggagagaggtagcagactggcctagggctaaaatggaaggaacactatcggccctaaactcaggaaagattttcattaactttttcaattataatgtatgtagcgatcccaatattttaatatattgctcagctcttaatatatcagtgaaaaaacgcctttacccgttgcaacacacatacacttttctagttcaaataaaaatctaaataaacccctcctttctctctgggccatttttagcccacttctttccttagcccgcaacctagccggcccgcaagtgcgaatcaggattcagactcatcaagcgaccgcaagtctaataaccctccccctgttcctccctcactatggcctgggtcccaacgctacagtgtcatctcctacctccggtcggactcccgcatctgcccgactgtttgaagccacctcctccgtgaagtccgactatattgttggtgataatccaaaagtgattgagggtttcgattcttatcttctcctctttccgtttttctaagaattggatcaaaccacatcctatctgagttaggaatcaagtcagctaacactggatttttctggctcagaatccgttttcgcttaaacaaaaatcgcgatggacgaaaggtcagtgtttttttatttttttttccagctttgttcgccactttttttttcaagtacgaatcgaacgttttgtcttgcttttctttcgctttttttacggggtgatttttttcgcgtgaatttttcgcccatcgcataaatgaaagggacgcgcgctggggcgccacacgtcggattgcagagtttttagctgtgtgccattaagaaattgttgacagaaaacacgaggcctgggagatttgcttaactccactgcaggtccaaaacccgccttcggatgtgtgaccgtgccagttgatttgatcctacaatcaaccagaaacgaatacaaagaaacgcgattaaatccataaatgatagtcgatcagctaggtgccgatgacatatcatttattttaggccgatgtcatgtgtacatcgatcggcagtcgtgaataattaaggaagaactaaatctactcgatcggctgtagatattaacaatatataactcttatgtcgatatatacttaaatcaagtgattgtgatagatcggtcgctatgccgagacagtataaatcacttagatcgaaatataaattaacaacagaactatatacgtttatagcatagccgatcagatagatctagcgtgcattggctaataatctgataccactctatattaagatattaaagcaagtagaatatatcaaacagaagcataatatacttaaatgcaacaagatcttaacataaagggcagatttcacatgtcaatcaagcatataagataactatagttaaatcagttaagatcggctgaaaccccgatgctacactaatcggcaaccaagaagcaggctagagactgatattctaagcacgacttaatatatcaaactcaactgatgcagcattaagtatgaaaagaagaacaatatctagacaatcaagccgctggatgtttcatagagtggtagatatcttatacaatccaagctaacgtcgctatttaacctaatcggttgccttctactaacagatgttagccgattgtaggttagatgacgatattaccgaagattatacaagatatatgataacttgacgaattacataaacaagattaaagtatcataaagatggaagtactaatcctgagaacacaagccgccataacaagttttacctcttgttgatgattgaaaccgatgcagctcaacccgaaagcaagaactcgtcgaaataaaactaaagcaaaaagggtggcgatgcgccgaaattgtattgaacgtgtgtcttttttttacatagggctcagggtctatttatacccgagaattacaagatatgtccataccggacacgactattatctctaacaaactctaagataccataagtctttgcggcagacttttgcccaaacatatctctaaggaaattacataaaatatcctaattaatagatacaattgccttctcaggactctatccatgcgtggcaatcatcttgaagcatatcaactcaacccgatgatgtacaccgagtcgtattcttggaatcggctgtatcggctagccctgtctgactcgaactttgccgatcctgaccgtagccgattcggattgcagccgattcttgctctgtttccgcaacgatcttcgtcttcgattccgcttcgatctaatcttcttttccgatgctgatattatcaaatttggtcgttaacagaaatatagtgcctgcctttgtgccaccaaaaagttcgagccttcctatatgccatcgttgagaggccatgtttccttctatgccaccaagccaccgccaccgctcctcctcaccgagacgccgtcgtcgccgctcctcctcaacgaaccgccgccgcaccaagcagcgccggccggcccacggcaaccgatgtcatcactcatcaagcaagaacgcgcacggagcgacgccgccacgacatcatcttcctccccgtcgatctggaccacgccaagtcgagccgccgcgctaccatcgtcgtctcatcaccacgtctcatcaccacgaccaaacccctcaagaacccccaagattgatgcaccatggacggagaacggcatcatattctccaactccgtccgccggcgtcaaacttcgattccgcctcctccggtgagccattgtccaattctggttcattcacaggttagaaatggaacagattagtaatccagcaaacgaagaggccatcgttcattcgcaggctagaaatggaacatattagcaatcaaagaaacgaagaggcgagagcgaaaaggagctttactagggccattctcctcgctagagtcgaagagcagctggaggccgaggcagatgccgaggaaggggcagtccctacggatgtactcgcggagcgcgttggccatcccggagcgggtgaggacgtccatggcagagctgaaggcgccggaccctgggaagacgaggcggtcggcggcgaggatgtcctccgggctacgcacgtcacagatgctgaagccaaggtggcggatggcgttccgcacgctgcgcacgttgcccgcgccgtagtccagcagcgtcacggctgtcgcatcgaaccgacggcgaagcggaggaaaagcaaagcaaacgcggcggtgaggccatgggtgaagtgaaacgccttcgagctccggagttgaaacgccttcgtcgccggacgcgcgcacggcgagcatcgagggaccgcgaagctggctcctccgcttcggccgaccaacggagcaggggggcggcgtggatggaggtggcggtggccgtcgctccctgcggcggcggccttgtcgccggcctcgccgcgccaccccgcccctcctggtcgccccgccgcgccgtcgagcaccgcctcggctggccgcctggctgccttggcaccgcgccggtcgcctgcctcagcaccgcgcctgaccgcttgtccgcgcgcgccgcctgacctctgtctcaaacgacgcagagactgaaagggcaagatgcacatttttcctgcacgggcccacatgccagagctgttaaacggttaaaccttaacaaaatagcgacggaatggtgtgaagggcacgataaagttcaacgatgtcatgagagaggctcgaacttttttttttacacgaggctcaaactttttagtggtatagaggcaggcaccatctttaatggaacacaggtaaaaacctccggattgcaatagtgtgcggggcgaaaattttgcaaaaaagcccttcgcgtttctgtaattggatataggcctctcacatttgaggggaaaaagtagcgaatagggacttcgttgtgatatgtggaagatgaggggctttttcgcaaaaaaaaagcccactatcgcggacgagtctacagctcaggcgcccgattggtttgcagaaaaatcggtcagcgtccgatttacgtgcaaaactactttaaactgatttttctcttaaattacttatccaaatcatgatccgattgcaccattaaattcgttgcaattaaatcttcaaaacaaaaccacacatggatatattccgacgaatttttttagcttattatcgaattatttttaaatgttgcacgatgttccaccaggtatatcggaattgtttcactaagtagatcgaaaatgtttcactcgtttaaatcaggtgttgtttctccttatataaaaacaatgtttcagcaaatagcgaaagaatatttcagttcactgcaacatttgatccatacatagtgaaacattataagtacactaggtgaaatatttttcggtggaacaaaaaataaacaaaattcccttaatagggggtttccaaaatatgcgagtttttttttgcaatggagtatttcagttcactgcaatattagatctatagatagtgaaacattatgattacactaggtgaaatatttttggtggaataaaaaataaaccaaattcctttaatatagggttttcaaaatatgtgggtgatttgttgcaatgaagttgtatgtgtggataaatgacaggtgaggacagggatacgtgagggggcgaggggcgcacttgatgggagagggtggagcgaccgattttttttgagaaaatttgatccatagcacaggaaaaaacccggtaccaaaaaatagcacaacaaattttccacttcggccagaagcacagggcaccagttttcttgcgattcatagcactcccgtcacatttgccatccaaacatgtgagttgatatgaaaaaagactcatttgcccttcttccccacgcaagagggcaatggagctcagaccgacggctccctcacgctccccccgcgtcgcccacgcgcaggccacacggtgggcgaaccccgccgtcgccgtcgccgccgccccccactcccctccccccttcctcgccaccgccggagctcaccaccggcaaagccgatggcggcggcggggccttctcccggcgtcggtgagtggtggcagcgaggtatcccggctaggcggcggtagatccggcgccgccgtcgccggatctagcaaggccctccgactttggcggtggagggggccgctgagtcgcgaggcgacggtgactccagcgcgcgcgggcggcggagggcagtgctagggctgacacgttgaggcgtcggggccagctggggtctccaccgtcggctccggtggacggcgaggcacgtttgggccagccggggtctccaccgtcggcttctccgccagccaccgaatccccttcgtccacgctcccaacatcgccaccagctccgtctccgcccatcgggtcattggcctcggcatcacctctaacgacgacgacggcctcacgggtggctcgaccgcgtgcggctgcgaagcaaggcgacttggttgacggcggcggcggtggcggcgactgcttgcgaggtgcggcgaggcgacgacggcgatggctggagggtggttcgaccgtgcgcggttggtccatgcgatggctgcgaggcacagtgaggcgacaacggcggctccttgctcgaccgcgcatggcgtagctgctccgcacagggcctgacgcgacgagatgacatggtcgaagggtaaattagtccgaggatatttctttctactccaaactaacaccgttatcttaaaatataacggaagtgctatgtatcgaaggaaaattggtcctccgtgcttctggtcgaagtgaaaaatttgttgtgctattttttggtaattttttttcggtcccccgttgagcattctcgcactatcgcgaataggggcttcgttgtaattggatataggcccctctcccgcgccgcctccgcctccccctcgccccgtccccgtcgccgagcgccgccgccgccccctcaaaccctagccgccgccacccgttcgctctccctctgtcgcgccgccgcctccgcctccccctcgcgccgtcctcgtcgccgagtgccgccaccaccccctcgcgcctttgccacctcctccgctgccgccatcgccggtcactcttccacctgcacgcccgccggtccccaccccgacgacatcgacctccacgcccaccggccgcccaaccccgacgaactcgtctcctgcgtccctcaagcccgcaccggcggcgctcgcctcggtggcacagggggaggaggacgacgaagagaagacggaggtggatgacggcggtggcggcggcggctgcgcgcggacgccggatttggggtgcccctactactacgctccaccgaagacggtgacgacgacgccgccgccgcctcctcctgcggcgtcggcggttggagggtgggatttctttaacccgttttacggggcgcccctctgccgccatcgccgccgccgtgtccacctccgccgtcgtctcggagcgccgttgccgtcggcgaggcgagcagccatctccgccgctgcctccccctccccctcgtgcgccgctgccgtctcatcgccgtcttcgagcgcctccgcctcagggccggcccagcagtgcggccgcactaggccctcaaactcacaggtcccccacctagctccgtaagaatcgtaaagagcgatgccagagccgcttattccaaaacgcgatacgtctgagattgccgccgtgatgagtatgcgatgcgaggcatgtagcgattccatctgttttcgtttcttctaatggaaattgggagatgacttctttcctttcaaaaagaagagtagcgatcccatttatgccattgactgtcgactgtcgggctcgattctagcgccagccaccgtccccggccagccgctccacgagctgccctgaatcgggactgctagagtgcagctgtgcaagaaacgggctcactaccaatctgctcatctgcatatgacatagggggtaagcagcagcaatacagtgttgtcatcgttgccaattgcttctgttgttagtaactgacatctttggcttcatcagctctctatttcttgttcagaggttgagcttgcacgaagtggtgttcggcgtgtgttgtcgactaacttaccgtgcccatccatggtctaattaatcaggaatatttcatagctttgtaatttactgccatgttatggactcactaatatattgtttttttaattaccagccgtcctgatatcatgttattgagaaagtttgtatcgggtaaaagaaaatgataaatgagtttatagaataaagtaaggggccaatgtatgaaaaactgttggatgagattgatattgatatcatcaacaatagtttcacatatagaaatatttgaagaaatttttagataattcatgtaaatactaatttgtattcaggttgttttttgccagatgtggtctccatgcggtcggggtgaggtcttgaccaggctgacaggtggagaagcttggcgtgccttgatgagatcttcctcatgtccatcaccctaggccgcaagcggcgccattggcttctttgccaacacagggtctgctccgccaacgttgttgtgtgagttaccttcttcctctctgttttctttatcccttgtcaagcaaccaaaccctgacatgctgacgatatcatgcagcaattgtgtatttgagcatgttgattttgtgtgtgatgtgtaatctgcaagactgcaacagttgatcctatgttgatgacagtaatactatgggagggagggagaaggtaagctaatcaagagcgatcttgtttttttttgggcataatcaggagtgtcatcgaggtgaagcttggcaagctcaagtgcatcaatgatgattgcgcttatattcccaagctgcagctacgagcattggcccattgtcatggatcatcccagcagactgtgtgccaccaagtagtagatgattggctgctacatccagagacgcttgccaaggttgttggacagtgtttctcgcttcgaatctttcacctgattattgctttcagattcttaacatgatttcccaatatttaaatattgacctatctttgaaggtgccacaacgaggaataggccatgaagaagacataattttccccattttgtttgttggctctgtactctcaagaaactagcttccagagtatgatttttttttttgtttcaatattatgtacattgtcttttttttttgtttttttttttttttggggggggggggtgaattgtagtcaattaagacaaatagcaatatgatatgtattttatgagaaatcaatggtgcgttgcttgatctgggagaggcacatctctgttggtaatcaggcaaatccacatgttattctttacttttactgattcaagtagttaatggcttaatgccgacaatgtctcatagttacatcattcgatgatagattatcacatcacctgaaaatccaggctgaaatgactataaactaatttacagaaagtatcaaggattgacctatgtggtggttgcgtatgaacctgtgtgtgcttctattattgatcaacacacaaatgtatatttttccatgaagttacataagcatgtctagctatctttttcaatcgcaaatagtcataaacatcttgttttaaacaataatcagggttgtattatcgcgataggtgcatggaggcctgaggaagttgctcactactaatgtcagaatccacatgaatcatctatgcaggtatagttcattttattgaacaaatacattatttatgtgaaaaccatcttggtgtctagatgtacggttgtttacatgctcttgccataggtcctgtactgcttcgaactgcaaggaactggcagtacaacctgatcttaatggttttcttgtcagtggagcttcattgaaggtaaagaggaatacaaacatattagaataattgtgtagacacaattacctgcctgattcactgaataccgtcttctttcttggttgtgtaccctgaattcatttacattatcaactctagcacggtgatgttttgcctaagatcttcacccttctcacctcggcattgaaaaatgcctgaagaggaacatacctttttccgtttgactttaaagtatgctatgcaactattaatgcttttatttattgtataaaggaaacaccagtgtattggcttgccatatttagtcagtaaactcttgagatgagttatttagcaacattaggaatcatcaatcaatattggcatgaaagcaaccatcat

SEQ ID NO: 80289 - DNA, 40479 bp, Oryza sativa
aattctctatagtatcgtccatttcataggattttcaaaggattggatagatttcgatcctctgtctcaatgggctttatagaagatgttcctatagaattgaaatcctctaacattattatgttttcctcccggtagagcatctccatcagtcttgttaaatttgcctctctatttactcatttgccagccctcaaccatttgaagagccctccaacccatttggagagtacagtttagttttccttgcaacagtctctcctatatactctcaaaactgacggtggaacaagtatgtcagtctcacattagcaatagtcttcccatcgagcaccggtggcgattcggttggctagctccggcggctcgtagagctgccgacccaagcgggcaagctcttgcgtctaaccggcggtcgggaggtcgcgactcgtcaggctggctccggcagtaggaagaggcggcgacccggcggtagggaggccgcgactcagcgagctagctccggctgcgtgggacaaatactcaaaaatcttagaattatatcgagttgtgtgtgaattagattgcgaataggcccttggtaaaaatgaaaaaaaatatgggggttttcagtttttacaagcccatttggtcaatactgggctacccgttgttggcccgaccgccggaggctcactcgcagcggtcgatcatggcggggatgtagaagagccggcgggtgacggcgctagacgattaatatcggcgtcggcggcaggagaaagcgtcgaccctcctccccagaatcagaggtgcactcccccttcgtatcgtgatcaatcgcttaaaaaacttctgaatccttcatcaaccgaagtaaacacgcgtccctcgttttttgcgcagggttggtgcgctgggtcgtcgccgaggtcgccgccggccgctccccgaccgtcgcgctccaccgctaccagaactactgctcctccgcctccgccgccgccgcgtccccatggtcggtttccgcgtctcgccctaccctaccatctcatcggccgtttcaaattctcaccccgctgtatgcgcttgcagcgcctgcagctacgacgtccccgtgggcacagatgtactctcgctcctccaccggggctcccacgcctcccggctcagtacgcgtcgttgatttttgtctcaacctgcgtatctacgatcatgttaatgttaatcagtttgggatgttttaatcgatgtgcagatgtgctcctcagggttcttctcgtcgtgcagcaactcctgcagcagaacaagcactgctccaagagggacatctactacatgtacccctccatattccaaggtctgcataggttccatgcctccgcttctgcttttgtttcctgctgtgtgtgacaattggaattctgacacctgtttttgtctaaatactgcagaacaagcggttgttgaccgtgcaatcaatgatatatgcgtactcttcaagtgcagccggcacaatctcaatgtggtatgtaccgcgtaatctgtgttattttccttcagaatcttcagttttgcttctagaagttgcgtgtgcatcacataataagattccactttccagctgctacatcctttgtgcccacatttctgtcattaatcacctggagccttttttttctcaatgctgttttacatcttgaattcatgtgtatgtactgtcataactgactggaatgtgtgctaccttggctgcttgcaggttcctgtggcaaaagggtaggaactctgtcaactatcatagagttggagtgtctgaagatatgtttaactcattctactgtcctattgattgtccatgccaatacttaataagataacttctaaccccttatcttccaagcacttggtctgcttaaaacaaaatctggatgtaaatagtgagatgcttctcttttagcaagggcttatagagcactgtgaagctaccattacagtgctatgctcatatattcttcacctattcatttcccctgttaaaaactcatcaatgtctttattattccagcttggtgatgggctggattagatttttagagggagaaaaggaagtctattgtgtaacgaatgtcaatgctgtaagttctatgagtttcctttaatcactgtaatatgtttctttctttttattgatatggtttgatttttgccttcttcaaatgcaggccttctctatcccagttagcatcgaagcaataaaaggttgttcagaaatttaaagatctaaaattcagtatttatgttactgttaatctgcactgaaaataattcctttacaatttgctgacatggattgcgtgaggggttggaccataatctcaattattcagaattagccaccatcctttgttttgagagaatccactttgatatattctgaatcgaatagctaggattgatctcttagcaaggtgctgttcattagactaaagaataaagtcagtgcttagtatctttacccgtcttgatttaagatatgccagaaaaagactggacaacaagtgaacccacagtttattcttcattttccttacaaatatgcggttgattatacttatatcttttactcactttatgttacagatttcctctcttgttatctgtgaacttcagtgttatccctgatgcctgaattatatctcaaggaaattaagctatcttaggttttctcttgtagatgttgttagtgttgcggactacatacttattgtcgagaaggagacaggtatgaggcttaaagattcctcatgtgcatgtgatacttgtactcttccagttccagccttcctacagttcgcttctgtactctccttgcagtgtttcaacgtttggctaatgacaagttctgtgaaaggaatcgctgcattgtgattacagtacttactaactgctgaatctggtgttatacacaaaatatcttcttgcatttattcttatctagtttgatgttgttctgtctgctcagggaagaggctacccagatattccaacaagaaggcatatactctttgttatacttttctcttttatttttctgaattgatatttcaaatgtaaatactttatttttccagattcttgcgctaccttgttgaacagctgcatttgccagtttactgtttggtggatgcagacccttatggtttcgacattctggctacctacaaatttggttcactggtgggtcatgatttatctaattagctgtttgctttgtatttgctattatgcactatctgagcatacctgttaattaaaaatcacatataaccactttatgcaaatgactactacactttccttatcagtagctcccaatagctggattgacctttatgcattacatttttgtccagtatcaaggcacatttgaatcaaacagtatgccttcagtttgtttggcagctctaagcccttttagcatgtcttgttttcacgatattctgtcccattttgctggtagatttggaccttgcaagtttatttaattttccttgaaagcttggtgtatttatttgtgttaactaactaccttctgcaatgcgcttgtgtaattctcattctatttaagcaattggcatacgatgcaaatttcctgcgtgtgcctgatattcggtggcttggggtcttcacatctgattttgaggattatcgccttccagactgctgcctacttcacttgtcgtctgaaggtgactaaactgagggatataaatgactgacatttctacaactttttcttggaacttataagtaccttgtttgttcttattcaattgtcaacctcatgcttcatgtattctgttgcagacagaaggaaagctgaaggaattctctcaaggtgttacttgcacagggaagccccacaatggaggtaaggttgtacttttcgtacccgtattacaagcaattcatgattatgatgggagtttacaagttagagctcggacttagctagtggaacatttctttgcttttgttttaacagtagttaaagtcatttttttgaagactttcttatgaaaaacaggccagcttactaataaaagctgtactcctaacttagtgccttcccttcagtctcatttccttagtttgaaaaactccactacgcccagtaggtgcaagttttggggatgaattttagtgtaccacttgcctaggaagacttggcccattttatttccagtaactttagccctgaattttttacactgatatactttatttggcaggttggagttagaagccatgttgcaaaagggtgtcaaatttgagattgaggcgttatctgcatgttccatttcctttttatcagaagagtacattcccaagaagatcaaacaaggaagacatatataagattggttgtacctgtatctatccagaaattttcatgtggcaaaagtcttattttgtttttgtcatgctaactgtagtcacatgtatggcactctggtagtttaacccccagcaagtattttgtagcaattgtttatatatgacggtgatttggtgctgtctcaagaactgaaaaccacaaatttacagcaactgaaattttactattactatctctgctactaagagcatctccaaggtatgtctaaaattaggctcctaaaaacctgtattgggagtatcacaaaagatattgggctcaaaaatcacccacatctccaacagtatcccaatacctgattccaaaagaactttaaaatctgccatatcatcactggtgggttctcttaaactgatttttctccaattgggagtgcgtggaggtgcccaaaattagctcctattgggttggattttggatgtgcctaaatattgggacctcctttgggaacctgttggagggttggttttacccttaattcccaaaatttaacttttaggaacaagattaggcctctcttggagatgctctaacaataccacctaaagagttgtgcagctttatttggggtttattgcatttctaacagaaaccttttataagtgaatacctctatagtctgcaattatgcatgtcttttctcattttctgccagatcgtcatcctgtggaagctgagattaactatcccgatcttacctgagacttagtctccagccatcatcagccttttttccttgcagagttgcagttatggagttaagaagaacgggcaacaaaacaaaggaaaggttgcttaaattccaggtgaaatctacacccacacaagttatatcatttgcacataacaagccgaaagcattgcattgactgaaaagtagcttatcgagtttcatatatagtctccagccatcatcagccttttttccttgcagagttgcagttatggagttaagaagaacgggcaacaaaactaaggaaaggttgcttaaattccaggtgaaatctacacccacacaacctatcatttgcacataacaagccgaaaacattgcaatgactgaaaagtagcttatcgaatttcatatatgcaggtgtgtgagctcggtgttacttcacaaatacttgtctcttacacatgttcaggagctgatccactatgttagatgtaggaggtaaggaccactcatttcttttgttacttactgaattacccgtgggcaattagatagagtataggtgataattagcggaagcaaaggaaaccgttgaaacaccagatcaatggaaaaggcatctgttttcactgagcagattgtgctagggtcaggtcatatggggagagagtgccagagtggtcgacatcgagcttttcaaactcctccagaaaagaagaaatctcctcttggttgatcttacccagttctttgagcttgtacacaacaaattctgcagcactgcacagaccagatttcatatatcaacactgattcttttagggacacgatggaataaaaatactctatgtgagttgtgtacttacccaacttgtcgatcatcatccagatcggctgcctcaagatccatctttgtcattttccgtgtgagaacccaattggccagcattttctgccgtcgctcggtgtagatctcagcaaggtacatgaagaattgtgccatgatgatagtgctcgtgataatccaaaagaccgcgaaaacacgtcccagtttggatgagaagcttttatccccataacccagggtagtgattgtggcacatacacagtagaaggaatcaacaagactcagtttctccactttccacagaaatacggtcccagaaataatggatagcaccagaagcagtgcatttgtgtaaaatttgtactttatcctgtttgtctcgattgctctaagcatcttggtctcaccacccttcagattcgtgtgcaatgctttgaagaacagcacctcctgcttctcaacaagataatctgctactttgctgacaaagagagcaacaactgccatacccatgaagacgaaagcacaagcaagcagttttgttgtgtcattgtttgggacgaggtctccatagccgacggtggtcattgtgacaacacagaagtacaaggcgtcaagcactctatttgttcgcttgcctgatatctcatccatgacagcataaaaggccaggacgcccactagaagatagataaaaaggagaagtcctactagtctgaaacttggcctcatctccttgaataactccttggctttaactgatgagcccttttcaggggggccttgaagaggatccgtggaaggagtcgacctgcatcgtcgaaaccgatttactccttctgacggcttccgctgcagcacattagggttatcagctagcagtgattgctgaatgctgttgtcatccattggattagcctggatctgttacggtcacagccaaaaacctaaaattcagaaaatggcatgaacgttgtgcaatttgacaaataagtgggatggaaagaaaggatttgtaagctcaaaagttatgtaaaactaaggcaatatttgctggatatcacaggattgcacagagaaccgaggggctgcattcttctaagcattatttttttgtgaattattacatgctagaatcctacaatatctgattgctccaattgcaggtgtgctacgccagaaaattccagtcacctgcatatgcctcctataaactgaattctatcggaaagaggtgcacggctggtcatgagcaactctaattgagcagcaggacgtgaaaccattctgctccatttccccaggtgagttaccatcatcctaaaccctaatcagctaatgtgttatttgacttgagcattattatacgctagcagcagcaggcaagatgatctggttaaggccaaaatcaaagcaaggcagcctgacctttttgaccagttgccctttggtcacgggaagggtgcaggtattgactattgaggatctctactaccctgatcggatctcccctcgatctgtccatttctttgtcgaccaagtccccccacctatctctatcctcattcgtttagataatatttctccagttctctcttcttctccataaaaagggcatcaaaccgtagaagaaatttgcgagacgatgcagggattgactagggtggtcgaaacagcaaataaggtactagcacacatcaagaacagctgctctcgatacagtcccacggccatatgccagtatgccactgctcttcgtgcgaagaaagcaagggaggcaacgggagacagagagagcttctcttacctttcctccggctgaggggacgccgcgcgtcgatctcctctccctctcgcccgacctgccctgagccgcctgagacggatgccccgcgcgcgcgcgccactgctgctgcgcgcctgcggggttgagggctctggctcctggctgcaacaccacaccggccaagattctgcgcgtcgttgccgcgtccggggctattctattttaaggcgtccggctaactccaccggaacggtggatgttgtcaacgttggggctagcccaaatctatcaacgagctcagcgtacgcagccgcaggtgtgttctgacttgtgaacttgtgacggcaactgcaaccagcggccacaagtcgcagtcacaggctggatctactactagggctgtgtttagacgtagttttgtaaaattttggcgtgtcacatcggatatatggacacacaaacaaattacagaatacgtctttaaactgcgaaatcataacgcaattaggcttaaaagatttgtctcgcaatttacacgtaaattgtgtaattagttatttttttcgtttatatttaatactccatatatatgcccaaatattcgatgtgatagggtgtaaaattttaccaggggatctccggtagaacggaaggcagggattggtttgcacgaaccaaaggggaaagaaaaagaaaaaaaaggttcggtctgacatatggcattgccctgcgtccgtcgtcgtgcaggatgcgtccattaaggggccatttgaatagcaggattgagaaaatatagaaataggaaaaacgtaggattttgatagaaatataagtgtaaaatagaggattacaaaacacaggaaaaaataagaatggggtcccttttgaaacgcaggataggaaaaacacaggaatatgaaaaacgtaggaattgaagttgtatgtttttctaattctacaggaattgaaaacacaggaaatggagagaagagccctttgattataccacatgataccctcaacaaaggaaagtttcacaagaggtctaacctcttgcttatttttctatggaattgatcatagaaatgcaatcctatggaagttttcctatcatcttcctatgaatcaaagggcaatataggaaaaaatccttaggaaaatgaatcctccaaaattcctttgctaatcctccatttcaaaggggccctcgaccgtttaattgaaccacaggaaaaacgcaggaattggatgagagagatagactcaaaagaaaagttaccaagaggttgaagctcttgctaaattttctccaaaatctctatagtatcgtccatttcataggattttcaaaggattggataggattcgatcctttgtttcaaagggctttatagaaaattttcctataggattgaaatcctctaaaattcttatgtttttcctccccgtaagagcatctccaacagtcttgctaaatttgcctctctatttactcatttggccagccctccaacccatttggagagccctccaacccatttggagagtaaagtttagttttccctgcaacagtctctccaatatactctccaaactgacggtgggaccagtatgtcagtctcaccttagcaatagtcttcccaacgagcaccggtggcgattcggttggcgagctccggcggcgcggagaggcggcgacccagcgggcaagctcctgcggcaaaccggcggtcgggaggtcgcgactcgacaggctggctccggcagtagggagaggcggcgacccggcggtagggaggccgcgactcagcgagctagctccggctgcgtggagaggcgcaccggcggtgattcggtcggcgagctccggccgcgcagagaggcggcgaaccggcggtcgggaggtcgcgactcgatgggctggctcccgcggcagggagaggcagtgacccagcggtagggaggccgcgactcggcgagctagctccggctgtgcggagaggtgcaccggcagcgcggagaggcggcgaaccggcggtcgggaggtcgtgactcgacgagttggctccagcgatagggagaggcggtgacccggcggtagggaggccgcgactcggcgagctggctccggcggtgtggagaggcggcggcctgacggctaggctccggcagcgcggagaggcggcgaagggagcccgcacctcggcgggctggctccagcgacgcggagaagtggcagcccgatgggcggagatcgcgtggaggcggtggaggtcgcgcgactggccaagtccggcaggggcggcgaggctagcagtggcgcggagtacaccagtcgccgcgggcttcctccgcgcgtcgtcgtcgtcgccgtcgccggagcggatggtggtggcggcagcggccggagcaggtcgccatggcgtcacaccagacgtcgtcgtccctcgccacggcggcactcgaagccgatggtggttggctccagcactggagcacgagagaggacgggattattgacgtggggaagtgaatccatgtggggcccaccatttggcgatgcgtttttgcctagccaaagttggctatccggttggccagcatgttggacctcttttttacgtttgaatggccaaaatttaacttggagaggctgttggagatgctctaagtcttgaaagtttcgaaacatttgccattagaaaatagtattagcttcatccgttttataaaaaatcaatcagtatcagatatgacacttaggtaccttattaaaaatcgttttaacagttgagggatgcgtatggtattgttgtccagagacaaatttcagactcaatgataaattgaggacctaaagtgaacttattcattcgtgcaaacgtttaacaatcacctctttgcgacttcctcatatgtcttctctagtgtgatgatcagattctcctcaatgttttggtagggattgccactatgtaaggattgttgcaaaaaccatgggattactaagaaaaactgagagatttaaagaaccgagaggattatcacacgagataaccgtgataattgaggagataactgcatcggtttagtagcgatagaaactcatgagacgtcgttagtacagtagcagtcatgatacacataggaggggaaactgccacgctgatttcagaacatcgagcggttggtgctaatcgatctgagagaagtatgagagtgttgagataacttatatctccggttaacttcgtatcatctttagacaactacttcaacaccatatatgttgctccctccaatctaaaatgtaataacttttagcaaattatttggacaaaggtatgtctagaaacatagctgaaaattactatattttaggacggaggtagtatatgcaagaaaagagcaagacaactctgatcacttggaaaaactatgctcaaatgtctcttccatttctctcatcaaaacaaaaggtagctcggttgatgaaatttatacccgtttctatattttgaggtgtttttacaatgatctttactggtagtagaattaatctaaatcatctatattttctaatccgaaatatcatactccttctgtcctatagatcagacgagacatttcatattacaacaaacccgtcccatggtatagcaatgaatctggatatttcatagtatatttagttctaagttgttatattatgagaccgagggagtatatattatacaccacctcaactactggaagttgaattttttttactgatagtaaagctcataaatcaatggctaaagattattttcactgatgataatgttattaatagaatgcactactagtaaaaatcacccaccaccgtgtagatactcttctattttaccttcaattcacctgttaggcaatggctgacgtagttggaggtagactagagccatatcatacagcacacatgaaacaatacaaccacagaatcaacatcacgagagaaaacatgtagtatcattcatttccctgcaggatcaagacaaatacctcgagctggacagttctcttctctcgacacacccattctggagaggacccatctgaccttttcactacgggccacatgctggcatggcgaaaaagccatcgccaatccgccattggtgttctcagcctcaagcccagccttctggccagtactgcctacttgccttcatcccaaggactcatcctcctccacttctttccctccttgttctcttccttatatgaatgcaatcacctttcaaaaaagattgaatgcaatctttgttcttcatcgatcatagtagtttggggctgtccagtgacagaagagaatgccttcttcaattatggcagaaagctctctggcttgtcctgtttcctgacgtcggaatggcttatgcacagaagaccatgtattaacatgtaactatgtaaggcaaggaaaattcagaacattttggattcaattccactgtgaagaaaaagggaaatttcagaacatcaccttgtatagtcataatattgagtttcaaacctatgatacctagaaatttcagagcacttattttgcaggaaccatacttttcctaagatttgcagaacaaaatttcttggcttcaaacttggaagagttattcggagaacagatactggtgatgtgcagtgtaacacatccacagcatgctccaccagagcaaagatgtggagctcatatttaaggcaatccctctcttgaaacatacgccatttctctcatttgttttcacttgaaaacggcagcttatttacctaccctaccctgaattgacagactcttaaaatcataatttacgcattgctaatgagcctaattaaccatgttccagatgtaagttttttcatctccttggtccatacttggaggttatacttactctctggattcaccaatgaagccattcaatttcaggctccagcagtggtatacttggaggaggttgtactcttcagcagagccattctctttatcatgttgtagtctcttatctctgaacttctctgaaacttcaattccatccttgaactttctctgaaatagcaggagcaattcagcactcatgatcatttcttcacttccagctattgcatgagattatatttcactagcactcatttctgacaagacagaacgatttagaagcgagattaattagtaagggagtgattggctgattgcactacagtgagagcaaagaaaccctgacctcatcaggataaaccaaggtctgaagagaaggttagctgggactcttgttacgtgcgcagccagcagccgataaagcaggaaaccgtgataggatcccgtttggaagcgttcgtagctgacaaaatgtgagccccataagctgtcaatttttagcctggactcctttctctacttaagtagaaatgcgccgttgtgttcaaccgtttttcttgcgtgcccaaagggagataccctgatgtcgacacgaatcctctccatcggctgtcgtttcaactgttgctgatgaactctaagagaaccgcagaaatcgattgatgccatctcttttgttctttctttgcgtatgattcaaagaacataacacgaagcgatgtacgggaatttagctggtttttttcatgagattggttatcaaacattcgctcaattcattgcaacaagtacttgtttagctggcagagttgagacttgagagtccccatcgattcaacctgaggccaagagattccaaggtcactgttggaatccacattatctttcggcttgatcctaaccttggttgggaatcactcacagttccatccaggagaacggatggctcacgacaccaatgcaaagtcgataataattcgatttatttcataaggagcacaaatgtgtgcatggcctccatgttcttgcaggtctcactcagctaaaaaaagacggcaacatcatgctcgttatctaatcaatgcatatatagcagagatcgatcgatcgatgtcatccggccgttagcttcagcaaattaaattatgcgtgtgtaggatcttacttcacggctcttttgatcttggaccttcttgctggtcattaattgtgattgctacatgtattttctttaaggctaatgtgatcgtttgctcactgttaatcctgcctaactcgtcttggtttttacatttcatttagtttcctgatgctgcatctgcttctatataaaccccttgctgccttgcagcttttggccaagcaagagctaaaagctagccgttgtgtgagggactgagagctagtggtgcactagctggctgtgaatctagccatggctctgtccacgttcgtccttgccgttcttgtcatgagcggcgccgccgcccttggccgcgagctcgccggcgacggcgccgccgccgccgcggcggccgacgtggccatggcgtcgaggcacgagaagtggatggcgaagcacgggaagacgtacaaggacgaggaggagaaggcgcggcggctggaggtgttcagggcgaacgccaagctgatcgactcgttcaacgccgccgcggagaaggacggcggcggcggccaccggctggccaccaacaggttcgccgacctcaccgacgacgagttccgtgccgccagaaccggctaccagcgcccgccggcggccgttgccggcgccggcggcgggttcctgtacgagaacttcagcctcgccgccgcgccgcagagcatggactggagggccatgggcgccgtcaccggcgtcaaggaccaaggctcgtgcggtacgaactccggcgaacacgaacaaactaatgattacttgatcttgcatgcgtcaactggtaattacgtaattgaatcgaataatcacctgataaaatttgcaattaattaactgggcgtgcgtgcatggcatggcatgacacgtacccgcggtcaaacggaaaggtaaaaatggtcaatccaagtaaacagaagattctaccgagccagtctacagaacagtctacgcatgcacttttagtcaactcgagagtcaaacatagctaaaactgtttgactaatatgtgctactaatcacaaagaagaagctgtattagtgagctgatggattgactaattaatcaatatatgcatgggcatgcaggttgttgctgggcgttctcggcggtggcggcggtggaagggctggcgaagatcaggacggggcagctggtgtcgctgtcggagcaggagctggtggactgcgacgtccgcggcgaggaccagggctgcgagggcggcctcatggacaccgcgttccagtacatcgcgcgccgcggcggcctcgccgcggagtcgtcctacccgtaccgcggcgtggacggcgcgtgccgcgccgccgctgggcgcgcggcggcgtccatccgggggttccaggacgtgccgtcgaacgacgagggcgcgctcatggcggccgtggcgcgccagccggtgtccgtggccatcaacggcgccgggtacgtgttccggttctacgaccgcggcgtgctcggcggcgccgggtgcggcacggagctgaaccacgccgtgacggcggtcgggtacggcacggcgagcgacggcacgggctactggctgatgaagaactcgtggggcgcgtcgtggggcgagggcggctacgtcaggatccgccgcggcgtcggccgcgagggcgcctgcggcatcgcacagatggcctcctaccccgtctgattatataaacaaaacacacgccgatcaaccacgtcattaattgattcgatggatcagtttcaaaatataagtcattctaacattttctacattcatattaatgttaatgaatctaatatgaatatagaaaatacatgaatgacttacattatgaaacggaggaaatataaatattaattaagatgtgtatatatatgtgctctggtatgtatagcgacactgcaccgtgtcaacatgtattctgaaatctgaaccggccggcccgtgcaggaagtctgcaaaagttggacgcgcggggctgtacgtagctgtgtgtatattgtatagtgtatatactacttaccatgatgaagttgtacaaagtgaaatatgttaccatattaccgtacagtgtacacagtcttcactagtacttctttcttaggtctctcacagtgcgtctaggtggactgtgccttagtcccgccacgtaggtttttttccgccgtgtcgcttggacccgcgccttagctagggtgctcgtgaccaaactaggcggcgcgaaacctcgcctgttcgagggcgtgcacggaggaatcgacgcgagacacgtgcgctgtgggcgtcattccctcgccgtccggtgctctcgcgcgggattcccctggcgaaatcccctattcaccctcccaaaaatcccctcccgccacagatcggattggaagagaaaaggcaagaaattcttgaggattggaagagaagaacagatcggattcaacaagatgaaaaagaaaaagaaagcaaaatcatcatagcaaaatcatccaaaccaacagatctggacatgcaagaaaagaacggcggcggcgactcctgcttctgctcctcttcttcgtggcggcggcggctgccgcgctcgccgcggcggcctgtgtcgcgtggcttcgccgctcccctgggtccggcggcgctgctcgaggtccccctcggcaaggtcgccacggtggaggcgtgccccgctcgagcctttcccctcctccgccggccgctcgtccgctcccgccaccggctgcttgtccgctcctgccgccggccgtccgttggcgccacatcgtccactcccaccgctcccgagtccgcgcgggaggagaagcgagcggcgcggtcaacggcaaggcgcacggcggcggcgtccccggcgtccgccgcgagggaggagagcacgacgagggaggagaagggaggagaaggcgaggcgaaggggaggagaagccgagaaggcgatttgctgagggtgggggtaggtgaggaaaaataatttgtgtgcgctacccgtgtccttgcgtagggtgccgcccactgcgggcttcgtttcttttatctgtgtctctatccaactaagccacacatatatgggtacttgcactgtggggtgggtgttttggactaactttttaggctaggggtacgggccccatagcttgcactgtgagaggccttactacaccgcgatgcgcgatcttgttctggctggcagcttttttgcctctggtgctctacatgataatggttgaaagcgatagcatttctttcggagactattctcactcaattgaaaattaactatatctatcaatatatttatcaattcatctgtcagtattgacaacaatctgaccatttcttttgacgtcgtgttgttattgacaccgaacatttgaattgataaatatagtttcttctatatagataaatttgtttatatatctttatctaataaaaaatacataagaatttcggtttaaccgtcgccgatgatggccgtctagcgagcttccctagcattctgaggctgtgttcgtcatttgttgttcccagccagaacagtccgtacgaaaaatggagcgacatattagcgcatgatcaattaagtattagctttttttttcaaaaatatattaatttgattttttaaacaactttcgtataaaaactttttgaaaaaaacgcacagtttaaccgtttgaaaaacggacgtgcggaaaacgagggagatgggttgggaaaagtgggtgccgaacacaccctgaggctgtgttcggatgtacgtattaccaacccagtgcacacggaaaacagagcggtccattactgcgtgattaattaagtatttgctattttttttaaaaaaaatggatcaatatgatttttaagcaactttcatatagaattttttttaaaaaaaatagatcaatatgatttttaagcaactttcatatagattttttttaaaaaaaattacaccgtttaacagtataaaaagcgtgcacgcggaatacgggggagatgcagcctgagtccgtcctgattctaggagacggtatcccgtccttcccgtttcacgtgcaccagctgcgagggggaacgcccgctgcgcgcgggcaaaatcgctcgcttgcggccttctggtccatcattcgtactagccccacacagaccacagcggcggcacgctgcacgcacgcaaaatttccaccggaaaagcccataaaatccaggaaaacgtggtggttttgccaacctcccgcccctcgtccaaaaaaaaggcccggaaataaaagcggattggaatctggtggctccgggtccgtgcggtgcgggtgcggctcgctcgacttggcgtcgttggagtccacctgacctcctgtcctccaccgcccgcttcccctcgcctcggtcgtctcggcttcgtctactcgtctcgtctcgagtccccgactcggaaagtccaaagccccaatctttccgttcctccccctcctcctcccggatcggaacaggagagcgggagctccgattcggtagcttcccccgtcgattctccccgccgtaagcgcgatccccccatttccacctcttttatttctttccgttcttgctcgatccggttcttggaaactagggttcttgggggttgggattgggattggggttggtttctttgcatttcggggggggggggggggggggtcccattgaccgaatcgaggtttgttcgcaggatttttgccctagccctggctgacgccgctgctgctgggctggggggcgccgccaatcgttcgcgatgtcgtgggggcgattccaccgcgcgccgttcccgtcggggatcccggcgatgacgaggtgctccaggcaccagccccccgcgccgcccaccgtggtggtgatcgatgaagacgacgacgacctaggcgacggcccctccgatgaggaggtcttcataatcgatggtgatgcggcgaaaggccgcgcgtcttctgggtgcaagactaagagagggaacagctcgtgtagtaatgtgattaacttagatgatgatgatgaggaggaggaggagggtggtggtggtgatagggcaggacccagctctgccggtgctgccgctggttctccagcagtgacgacgcccggccgtgtctccccgagaaacagatatggactggattatgtttctgacagttatgagagtgattcgtctgaaggacactccgacggagatgatggctcggattgtgagattcttgatgacgcctctgggtcagctcgcaaacagtgggagaaggctgcttcgaggaaaagcatgcctcaaggtttccggaagagtacatccacatcaagtgccgagtcaagtacacagccagatgaaagtgaggagaatgatgcagaatgcgatataaatgagtacatcaggaagtattttagtgaagatgtattgaagaaaggtggaccaatcagtacaagcggtgcaaatgctaaaccttcagttccagatgcccatgattgttcaaagggcaatgcttccaatgcaaatgaagctgaagactgcaatgccacctccagaattgatcctgacccagcttgtaatgacgaagcaactcattcccaaaatggttctgtgcctgaaaaaactgcagaaagaagtcaatctccacacatagatgaaacctttgaacctgaacaatgtacagactacagctttgtctctgccaacagggtttttcctgcatgctcctcagcaaattggaaggatcaaagtcctacatttgtcagtactcctgaaaagctggatgaaaagttatctgatggcacatatgcacggaaggatgaaacactaatagatgctcacaataaaagtaccacaaagaacaaagagatgtgtcctgaaccagataatggttctctcgatggtcgactaacagaagatccacctctttctagcagatgcgactgctcaaagcaatccgagaaaaaatcggcacatttagatgcaaactgttgtgcatctgctgcttcctccaataagaatccttctgcaaatgtcatattgggaggttgcatgccacctcagaaggatttagttgatggtccagaaaaatcaggccaacctgccgtggctcaggttgctgcagacattcaggatggtctaatcggtgcacgtgaaaagcacaaagaatccgatgagtacaaacgggcacaggaggaggagtgggcatccagacagcgtcaactgcgaatacaggtacgatttgtgccgcttttagtttaattgttctaaagttatacaagaaggatgtgaactgcatgaatattagaatgtaaataagttcagtgttaatctcaatgagcattatgctattgcactatattgttggaatgtttagttttgaggacattgcggcatgatagtgtaatcacaaaacaaataaataaatggatagcaggctgagggaagcaagtagcacctacatgcaattcatgatgtttccttttaaaaattattgcaggctgaggaggcacagaggttgcgaaaaagaaaaaaggctgaagcaatgcgattacttgacatggagaagagacaaaaacaaagattagaagaagtccgtgaatcacagcgaaaggtatcttgttataacctctagcgtattagcaaacacttgcatgattctctattgtccgcctatgtgttttcaagagcatttggttgcttcaatctttatgtgctattgtttaatatttagattgttcctttattttgttgaatcagaatgaagcggatatacaactaaaagaaaaataccgaggggtggtgagattggagctcgaaagtatggaaagaagatacattgatatggcttctatattgcgtgcattaggcattgctgctgaaggtggtgaggtatattattcatattcaacctatctcttccttgtagtagtaaagttattaattgctgctgtttttcttcttgttatatcttatctgtctctccagtacaatataaaatgctagtatcccttgtcccttgcatattgctgttaaactcaataccttataacagtaagcttcatgaacagttgtatgttgtccatttcatgatatccatctcattcacggaccaaccactaattgatctctaataaaaagatgaggaattgccatacattttcatgctaaattgcaatctggaaccacttaacctcttctgaaacactatgatggactgaaattttactccctatgttgaatttttaggcacctctagatttcatcttgttgattgaaacgcacacacaataaactatgcaaaatttgtatacaccatttctggctatcaacttccatgctttacattcacatccatgcaattcagttgcaaacaacactatttcgcatggagagaactatatttaatgcagattattgcgttattactacaagtagtttggtttttaccttcctttgatagtctctgcttagttcaaagccgggtaacaaattttaatagagggagtgataattatacttgatttactaacggataaacattgtgaagcaacatttcttaggaaaattggcaaacattatgaaatggaagtagttatgttttatgtaccatatgaaaccaacttacgaatctgttacttcgagtgaattaacttattacttgttattgttgtggcatatgcatagatagatatatgcacttggaaattgtatttcaattttctatggagaaatcccaaattcgtttgtttatttatagaagagatagcttctcatgacaaattttggaagatttgccaattattgcctctggcaatctaggcgagatcaattaccaccttatgccatgttctgatataagttcataaaatgatacccataaatgtaaataaggaattattgatctcttcccgctgacaattgtttaatatgaaacttttttcaggttaaagctgcttacaagcaagctcttttgaaattccatccggacagagtatcaagaagtgatatgtatcaacaggtcaaagcagaggagacattcaagttcatttcacgcctgaaagagaagatgcttcgagtttaatactagcatatccctgttcagttaaatacaacctctgaccaatatctttatgttaaagttgtggctagattaatttattcataggctgagttctcatcagccggcacatagttccacagttctgaatgccattcttagaagactaatgcttagcattcgttatcctctcttgagaatttttagtggtaggggagtcagcagtgacagtgagcttgggcgccttggtatatttcttggtttttgtaatgggtaaaatgtttgtataggagtgacggcagaagatcattatatacaagatgatctcccattatttaactgagaatgtcacgccttattttctttgtaaacagtcgaacgatttatgcctatcaacttgttcgcatacaatttattcgttatgcagtatgcgctcaatcagctctgccggtgatcggacagattcagctccaatcagcaagataacggagacttattgtctacaaagtttatttatcttacagtaatcacactatgcacaatgctgaaatttcgctatttaagtcacacatgacaccaatggagatggttggaaacgggaaaatttgttcatgctactcgcatatattacatgggtaaatactggtgggaggaagacggtgctggacgaagccaaaatatacacattgcagcttgctactaatgctgaatttagggctaaaatgctttcctcgtctcgcaaccgcaagatgacaatagtactagtagtaaaccagagcagcaggcgaccggaccgggtcaggttgcaacttgtgattactggtatggatctgaagcctccttagccgttgatgtggctcagcatccatggtggcagcccaatgcgaacatgctgtggctgccctgctgctacatcctctatcctttcgccagctgctgcagggtagttactgtggaacgaataagcacacctcttagctacatcaccaaccaaaatgacaagaaaaagcccgctggcgttttgggggaaaaggggcagatttggcgtgttttcagacaaaaaaaagcgtaaaattctgaggtgcctaaaaaaggtttgatagttattggtttatacaaccttgttagaactttcagttgtttggtggttggtgccaaaatatgcccctattaagttgttggtatttttaatagtattttagctaatgtttgatttgctattaaaatatagtgataacatatataagttgacaaaaaaatgtagcacttccaatatttgtctaggttttagtatcgtcaatattttgatatggtagtgaactaaacgagccatttaattttgttttctaataaagctggatctaatgatctttagtccaaaaggttattcgtctgtgctacataaggacgaaactaacttcaggctgctagttacttacctgatattagttgttggaagggcttccctcatcatgaaggaggatgatgaggaacttgtttgaggttgtgtctggtcccattgcacttgttgcttctggactttctgcttctccaccagctgtaggaaggagcaagggttctgtcaatttaacttgattgatgttaaacaaaccaagatcagctgaagcatggaaactagggggcatcaaggctagcagcctacttctttctgtaggaccttattctcctcctgcagtgacttttcctgcagcaagaatccggcgtgcatgttagaaaatgaaagtgtggcagcacttgcagttgcaagcatggcgggaacttaaaataagagtatgaaacataacacgcgatggtatcaactggtggccggccaaagatttctcgagttttgacaaggttatttctagcaagtcccagtactcaattaaaggtctaacatggttgacatcattaccttccgttgaagctcgttaatggactcgagcattagttggctctgcacataaaggagatttgtaattgtcagctcgtaaaacatacaggacatctatatttagctgtataaaaaccatataaattttgcacatattgttgatatcagccttgaataattctcatcacaaaaaccacctttctggatctgatatgtttcaacgaattttccagctgctgctccagctgctgcagctctttgagattcaaagattcaagatcctctcccatgaggtgcctgcaggatttaaggcgaacaattttatgtcaacagtgtatagtacataatgtcataatggcaccagttgtgagtagtttccaattacttttgacatttctgtattgtctcaaccttagccttcagtttcctatattcgtggcaccagttgccctatacaagcaagcatagaagatttacattaataaatttgagtaaataggaagtatcacaatactattcatacattagctgatatttgaaaaattgccaggaagaactgattgtgcaaatgattgtgccctttggagtaccttgaatttctatattaacaagtgtaactttaatcgattttggcactgcatatagctaaaactgtggacacctagaactgcaagatacctccgtggagaattgcttaggtacagtgtatattgaataaatggatttacttcagtgtgcttgcagtaaaatatgattaactttgtcccccactccacacttaccttttcttctcgacactcatcaaactaaatttactggtggatgtacagtgacctccacaattctaagcacagaatcactaatattacaagtttagaaattgaatgtgctgaagagtatacaatagtgccatccaaaatctatatagagaaaagctctaagcagatagtgcatgttaggaaagggaactataatgtatgtttccttgacaattcatcagcgtgataactatattatctactatctccaaagtagcaaacatttctaggaatgataacagggttacagtctgcctagctagttcagctttttgtaatatcttgattagaaaattctcagtctcactctttatggtatggaaatatgacttaccactgtctgcataataactacattagttcagtcaacaatgttcatacacagcaacttcttacaaaaaatattgcaaacgaagaatatgcatgtctacatgggggatgctaattggcgagcgcaagtcagttacggaactggcgcgcgcgccagctggcggtcccacgcgatttttttcctttttttttgtgtttcctttttttccatctttttcgtttttttctttttttcgctattctttcgtgttttttctgatttttttaattgttaggatacgtgttttcaaaaatatttgagctgaaaattttcaaatcttaacttgaaagtttttcaatctgaacttgaaagtttttaaatctaggcttgaaagttttcaaatctcgagttgaaagttttcaaatctgggtcgaaagttttcaaatctaaacttgaaagttttcaaatgtggacttgaaaattttcaatcgcgagttgaaagtttttgtcaaatctaaacttgaaagttttcaaatccggtctacatgtatctagccataaaagaacttctgattttggagtacaccattagtccatcaaccccaactaaagagtaaagattattcgtaacaaatagacgaatggatctttttaatagcataattgactatagtaagtcccagctaaatgaaaacaaggattatttaaggttccaaacttctgatgagccacgccaaaagttctggaaaatgtttattttgttttatttgatgaaaaatatgttttgtgatattctctggcacacaaaattccataatgagtgttgatgtagtcatgcatccaaaatttttttttatagtttttcattaggcaataactatgattttgttccagtaaaatccacaaaaggtatattgaatcatagtgtaaaaaatgtttgaataagagggaactggcaaagctgtatacgtgtaaacaaacatggaagataaatttgatctaatttgtgaacaaaatttcacttatgaaatgtaacaataccacaatttttaatgatctgacctgagagagagagcctaattaattgcaccaatataaagaacagttcagtttgagttttcaagatttcagacagcaaataggttcaattgggctgggatgccaaaaggtcaggacgctatgtaataaaaaatggatataatctaatttagaataaatctacatatttgataagtacattgaagtaagagattactgttcaaagagatgtaaagcaatatttattaaaagttgatctacataacaatggaaaattgccataaaaaatgatgcctaattgatttatccaacttgaggagagctaaaatgttggatgtacccgtcttgaatgagtcaaccgaaacaggtgtagtgaaaagttcaaaaaataaacaagatattgagatatgagaaacaacagaattagagctctttatttttacctgagtgtcagattcagctgaaataaggaccttttctgcataggagtagcgctcataacgttcaaggattttgtccatactgtgaaaaatgaggaatatacgtttcatcatttgaaataattgtaataataactaagcagtatatatattcttccatctcaacaacaaatgcacatatggctgtaccttttcatatacaggtcagatacatacactgtatttatgattctggtctgttttttcttgaagtccatttttttaagaaaggataggaatttaacaggaaacctactttagtttccaggtttaaaataaaacgaaggaagaacaagaaagttgcacaggcgcgcacacacacttcaaaatctacttgagtgcaaccccttatgttttaacatggagttgttttagaaactgcgtatgcagtattgtcaaaacgaaaaggtgtatcactgtaacatcctaactgaaggatgcccatttctttgaatgtcttaataggtaagttagtgactatcactatgatgagaatatatatatataagtaatacaaaactagatattgttatatatttatgtgttgaagtaacttacatattgtgtgggaatataatatcaatacgatttcacttgccatacatgtactaaccaaaatcataggactagcagcatctaacaaaggccctcaactactaataatctctagttcaaaacatgaataggtttctcaaatgtcacagtggatattatgacatgtaaatgcgtaacccataataaaatgccatttgttttattcaaattcttttttgcaattatgtaaaaaaaagtcatgcttaaactacctttgatgcttaaaacacatcacaacaaaataaatgacaattacgtattttttaataagacgaacggtcaaacatatgtataaaagtcaacggtgttatacattcaaaatttaaatgggggtacttcgtagtggtgtaaataacaacacctacattttgcagtttattcttataagaacttatgtaagatataatacagaatagatttgccaatctacttctaacacaagagttggattaacacaccacccccccacacacagaaccctaaaaaaacaataaattgttgtatttatgcagttcatgaaaacggttttttgggcaaagctaacaataaacattttcatatatcagaatgatcagcttttggtggtagcactgatatggttcaagttctgaaacattattaagtcttactccatccgtttcatattacaagtcgttttgactttttcccaagtcaagcatctttacatttgaccaatttatagaaaaaaaatagcaacatcaacaataccaaattagtttcgttaaatttaatattgaacatatttgataaaatgtttattttgtgttagaaatatttttatttttttctataaatttagtcgaacttaaaatagtttgactaggaaataaattcaaagtaacttataatatgaaatgaattataaatggagggagtagcttcattgtttgctaaagtatttccatgttcttgaggcactttgaacaagttcactttataaccaaaggatatatactttctacggcatactaaaatgtcaacctttcaaaagggtctgtataaccttttggggaaagataatatgcatatatatagaaggtatacttctggggcaaagtcaaggtaaacatgtaatacaagcatacatgtcaagaaaagcttaagcaactgaactgtatctcattttcgttaagaaaaagaaatgaaacaggatagcaagtataactatctatagaaagaattaaggggaaatacaacaccctagactcttaagcaaacataactttgttgaaagagaacatatttgcttcttattcctagacagggtctaatcaatgataatcaagtaagatcacatgtgatattgggttgtctacattaactaaatgaatactctgccgcgttgctgcgggaaattaagttgcataatatgtacaaataagatgaaatatgaatattaaaactaaaacaaattgatacttatgagtttaaggcctaaaaatgattgagattacttggtgtaatgagagaagaaagaagagaaaatttgaaccatatatctattatccaatggctagaaataattggggtaatgtagtctaataagaggagagaaatatcattaactacacttagtggagatgaactatataagtatataggataacttgaaattaatcaacctatggaaaattaacaaaattattacaaaaatgaagtgtcaagagaattaatacagtattaatgcttaaaagatattgtgaataatgcaatccaaactgaaaatttatcattagtcccggatatatacagacgttgctacagttcagtcaacagcaggaatcaactcaatactgtataaccaaatagctgaacaggtatattatgcggttatgagtttgtatgtcctacgcgagttggaccagtaggcctccgagcaagttagaccaattaatgcccgcaaatatatatccattttattattttgggctaacttataagagaatatttgtatttttctgaatcaagtagactggaagtctggaaccctaatagcgtgtgagacagtgagagccagagttaactcattgccgactcatctatatacggctagatgcaatactacaagagtcttgttgtgaaaacagcatgcaagtcgctgcgagctctattaatcaaagcagagttctgaacttcgtgcattggattaagatggaggaaaccaactttacaattctactgcttatagttaaaaagaattaaaatatctcccgagtcacttcaaatatgactactgtttgtctgtgtagacgttcatcgtccaaagagcagtaggagagtattttactacatttgaagtacggagagttttctaaattggcacccaaacaaatatgaaagaactagtgtcttgctactcctaaacgacaagcatttataaatattacccatcgtaccaatggagtaggctcaatattcttattggcgcagtaggtaactacttgcttagctttaacaagaaagccagtcgatctattgccttgtgatgaattgtaagtggttgcatttgccgctacgtatgccagcttaaggcatgctaattaaagtaacatcttaattaaagttcgaagaggatttgtcatgtttcccaactaggttcatgaaagcatctgtttaaagctaaatcttggaaaagtcttaagaaggattaattagcataactacagtaccctgcaggaacctaatggagttgatttccaaataagacgtttaatgacgtacgagaaacgaaaaaaaaatcagattaatccatcggctcgtgtactcccaccccaaacttgataccttgaaatccaaacactgttacctcacgtgaagctctactcctatgtcttaactcactgatcaatggttagagtgagaaggatttcaaaatatgtgatactaatgactcttatctagagatgtggttgctagcattatggggatgcccaacacactacccttattggattaaatcagcgaggagttaattaagttaattagtcgttcattcatagaattagaatagagtataagctgataatcactgatcatatggggagtctgattagtagatataaggatgcccacaaaactgaagaaaatttataacagccagatcaaactctattcgtatgtagtgaggaaaaaggagagataagaaaatttttaacttaaaaaatatataagaactggaattaaccatcaaactctaagatttgcatgttgacttaacaaagcttgcataacaatgcattaatagtaaatcattgtcgaaaacatcaagaaggataaatatccttcagatgatatggtatactggaagcatccaacgttttgcttcttagttctaaatttctaatgtctgtttcttcaggaaccatatgcacatcccaagaagaacctgacagaaaaggtagaacccagcaactaaagcgctaactaggatgaacctttagcttataagttcttttttttcctgttaactcctctctacctcttactaagtcttaacatcttaacagacctccgatgtaatgttgtaacctttgtacctcccctctgaactaagaaaatcgaatgagttaagtgggaaactctcccccaaggtgacttttcgataaaaaagaagcagcatgaaaccagtctgtaatcaggctagctagaagcatggatgtttcttcagaaaccatgtacatctcaaaaagaaccttataggaaaggtagaacccagcaactaatgaaccattagattgaactaatgacagccgggaattaagaagtaaagattaaaggccagccctagcttataagtttgttctagtaaaatcttttcgttctgaaaagcatggcatgcatcagcaaagagtccaagaaagctagaggcagacgaaccagcgaaaagggttccaacaagtcaccagcagcttaagatatgaactcctccatctcccgatgcatcccgtttcatcttctcccttaatatgcttagttgcctcaagagaaagagatggccagggagagagaaagaagatctaaacgagcccagaattaatatggggaatagtgaagaaagaagaggcacacacaacacaagcagcaagttcagtagaattttagatgaacacaagccaagaccattttaatccccaaataatcccaggtccatcaaatctacgtactagagttcctagctaatcacccctctcccctttgggtgcaaagctagcttgtcgccaagcaagcagcacccatcggcagggccaaaaaaaaattccccaaatagcgcagcagcaacgccctctccagcgaaagcggagcataaaattaccctcgtacgggcactgtagctacagtgcacagatgcaacgcatctcacctcacgccgtcagctcaaagcctgaaatagcaaaacacgctgcctcctccatcgccggcaagcaatcaacaatcgcagcagaaattcaaacagattattggggataaccccgaaacacacgcaacaaaattaattcgagcaatcaggacagatcgaattaatcacacacagaattcaaaggcaatcgatcgatacgaacagaacggaaacgggaacacatcatgtagcgcaaggattgctcgattaagcgaaaagaactgaaagcttagagacaagcgatgaggatgaaatttaatcaagcacacgtacgtacgtacgtaccatgagtcggtggcgtactcgtagagcttgcccttggtggagaagatgatgagcgcgacctcggcgtcgcagagcacggagatctcattcgccttcttgagcagccccgacctgcgcttggagaaggtcacctgccggttgatcttgttctcgatccgcttcagctgcaccttgccccgccccatcttcctcctgttcttcctcctcctcctcctcctcctcctcctccctccctccctctctctctctctctacctccaaccaaaattaaccctacccacctcgctatcagcgacgaccactagccctatagccacacctatccccacacggcaactactggtggtggtggctgctggctatccgcctatcccctagccccggcccccatcacgtggacacggcgagacggcggcggaatgcgtcgcgcgcgatgggggggaccgatcgatcgatggatggatcgatcgagtgggggagacgacgacgacgaggaggaggaggaggaggaaatggggggattttaaagggagcgcgcgccggatcgtcggaggaggaggaggcggtttggcgataccggggtggtttcgatcgcctccgctgtcgaacggccattgggcgaggcggcgccggcccgggccccgcctcccggcgacgcgtgcgtgcgtcgtactctcgtgggcttttctgggccgatccttttttgggccgtctcgtctggccaggcggtgggggtgggccatggcttttcctgcccaattaggccgcggcagcaatgcgtcgtgatgggacgggatggctcctggcttggcttggcttgggtcggccgcaaaacagtgcctgcgtcgtctcgtctcccgtcggccccggcgagggggtgtgcccatcaatggcgtcgcctgtcgctcccagagtggatgattgcctgattggcagttggcacccctgcagctctgctttgggttgaatgcagcaaaggcattcgttctctttctgctgcttttgacctttgtggatgaatgcatttcctccgtattaaagcctgtttagtagatcttcatctcttaaaatttaactttaggagttaaagtttaaagtgaagttgtgtagcggtctgaactcaactccacctctctagtttattttgtgataacgctctagccaactatatttctattttaggtgtagaaactatttggttggactccagctatagaatgagtggagctatagctagagccatactaaactggtccttaaatagacttcattttcgatcgctttaactttgttctttcttacctataattaatctgtaactcaaaattattcctaggttatcatttgacgataatttattttcgtattaatgagtgttcatttgatttttcttctctcaccattagtttgttagctttgttctaaaaatgtagtcttcgtagaacggagaaagtattttgaacaggaagcagggacctactcatgcagtaggatgattgattgccctccctatgcacagtaggaattttaacattggcttgtctggttctcaggggctatgcaaaacttgagctacattattaaatattttggatcagatctaacatcacatcgttttggatgggacttaaatacggacttcactgtgcattcttggatacactagctagaatgttatttcattctcttataaaattactgatttaattgtacgattggatctatctgtctctttgtaaggatgcaggcgatgctatcttacataagagcccatattctaagttaattttcatcaacaagtatataataaaaatggatgaaaaaaaagtacaattaggtttactgggcctcaaagcctgcaagcatgtcgcgttggcatccctattttctaacatttatgtaatgattctattttcccaactaccatatattctaccttaaaacttgacttcttgacgtatcatagcagcatctctttaagatatggtgtatgattgataatgttagattccccatgggcagaactaggtgaggacaaaaagctcagctcagcttgtaagccaaattagctgagcccgagcctccatcatagctcttttccgaaacgagccagagctgcagaaccgtcaataagttataatgtatttggttgaaagggatgagatagtcatgtggggacaaatctattttcagggtgttcggttcgataacaggtgggacagaataatccttgaaatggaatatttttctagatccaggtcaactttatatgaaaaaaattaacggactcgaattgagatgcgggccacaccctcacattccttataaaaaaaataagagcattatatcccttatgccaaagacatagatggggctatcccatctcagaaaataaggatggacctaacatatcccacttcatccccaaataaacacacttctatagttgtacatcaacttgcaattgccaatgcatttggtagtttcatgatttatatgtgcaatacctgtacatagtggacccaagggaacagagaatcatgggaaatgactataggggatgaaccaagggaatatataggacacattaaagtgttgctaaatactagagataccccgagaaattcccctctgaaatagggaacaaatggaatttaattttggatgaggggattgaatccaagataagctaagagaacaggaactgtgttgtcacactcacatgttatgcttggggaatttgctgtgacaaggggaaaaaaatgaaaatgtaagcaaaataccaagtatatatcttattaactgaagctcaaccatagtctccaccccccacacctcaaatcatctctctggtccctgttcgattttgctcatgttagcatggaaaacacgctgagacattagtatccgattaatgaagcattactaccatgaacttgaaaatggatttatgtggtttttaagaaactcctatagaattcttttttcaaaaaagtgcaccatttatcaattcgataagtgggctcacgatacaagagagtagctcaccccatcaattcaaaatgaggccaaaacccctaaccgctccgtcacttcctcaacctcactaatgacaatgcacagtgcccgctggaaggccacttcatggtaaacccgcctctaaccgggcaatcacaagattaaaaaaataatatttatatgatctaaattattattattaataatagaaaaataatcttgttttgtttcaaaggagggattttccttttttttcatttaccttgagcgaagctggaccaaattgggatctaatatttttttgtccgttgactttgagcccttctttctcccctccctcctccccgcacaaattttcataatctctccttcattatatatgacaagccatcccaacaactttgcctagccactaaatctaaccatcttgattagctgaccacactaccaagggatccctccttagagtggccctattaaagagaataataataaaaaaaacaccgtacatgatgtataatgcttggtcatacctcaaagagactggtgattgtgtgaagttagagctatagcattgacacagagcgagatgtatgacaatgatgatatacgcgtaggggaaattaattagaatcgcctgatcacgagcgagaagttcctatattatatgatgatgatgtcatgccattgtcagcgtgtgaagagccttgttgtgctttgaacttgctagttatatggccgtgtggtctacagttgttaggtaggtagttaatttgttggtacgtatgattgttttagcccgattttctcttcattttgagactaatcattcggtgttgggggtggtggtataacagttctctccttaaaacgagtcacttttttttaaaaaaaatataacgatgaaaaattaccgtgattgtagcatgcagatacacgatattggagaacaatgtgcgccgtgtttacttccaaagttattcttcaaaacttcaactttttcatcgcatcaaaactttcctacatacataaactttcaacttttctgtcacatcatttcaatttcaattaaatttctaattttagtgtgaactaaacacaaccgtgggactctatcctatgtgtattttacctctaccattaatgctttatgccgaccacgaccgtcaaatagctgatgaacgcacaacatgcaatcctgcaaaagattacatactttacagtcattggatagtaaccaccatatcagcgccccttgtggatgacgacgacaactttcattctcatgtcgtgtcattgccaaaagatatggaagaaacttatctttacatgcatagtgtctgcacaatgggtgagatgcaaacatgtaattatctagggcaatagagattaattagagaattcatattactgaaaagcgacaaaacacatgttgacagaagggataacccactagataacaatattctttctggcgcctttctagcaaacattcatcgtggcacaactgctcaactgcttaacctgctgttaaatgtttctagaaaatttagatttcttcagaaaaataaatcgtacggaaaattgctatattaactcatgcacatttcattttagcatataagtacaatagctactcttactgactaaatgtaatgtttatttcttttggaacatgggtgctcgtacttatgactaattagtctttcattagtatagacgacgtacatgttgacagcgagacgtttgtgcactccgttaattttaagatataccgacccaatctttttaaatgtgctcacatgattagggtgtgcgtgtgtgtatttataaaggtgagcacgcacgcgttgtaaacgcttgtgtttgtaccagcatatgcacttctgagcacacctccctaactgatattgatacttttttgaaacctaaactgatattgatactctctccggtaaaaaaagtactgatattttgatatgcatacagtcaacaagtttaaattttaaccatcaatatcgctttgaatattttgattttgattagattagtctttgaaaataatttcaaaatattataattttactatattttttatagattttattctagtaattaccaacaaaacaagtgtcttgatgtgttaccacacttcaatatccagaacacacttagagcacgtataataaaatgttataagggggctataagagttaccacaccagatttatgatgtgttggagaagagaatggaggagacagaagagaagtgtgcttctgtagcaagctgtaatatgagctccaaaaatctttaagagaataaggtgtgcaaaatacttcctccatttcacaatgtaagtcattctagcatttcccacattcataatgatgttatattgatgttaatgacatcaatatgaatgtgtgaaatgctaaaatgacttacattatgaaacggagggagtacgtattaatagtgctatatgtataactatagttaaatattgtatgggtaagatattagattagttataaatgatatggtaagagcaatgtgatccataagcaaaccatatatatatttatgtggaagagaaaaataagaaaaaagtgaaaagtattggctctcatgcaagagttagctctacacatgcttaaaaaaagtatatattaaactcatagtaagagaaagagagagaagaaaaaaatatagtaaggccggtctactatatatattaaactttatatatagctaacctattatatatatatgttagctaaacaatgatcgctaattaatagtaaggccggtctactattaaacttagttacgttggctctactattagggagcagttaactgtttataaggcaaaaaagacaataaattaactctcatcggtactgtacataataacgttaggcggagagcataaatgcaaacaacgcacaccctgtgcaaatattcgcaaggatggatcagatgcagatccgcagtgaaggagaaaaagacgggtatatatatgtatgaagttctaaaaaaaaaaaaagtgtacgaggcaggaagctgccggcgtcgcctcatcactcatcagattccacctgcaaccaaaaaaaatctgtggactgtggagcatggagatcgaccacaattaaattcgtcaataattcctgcccaaagctagaaaaacaacaagccaatatcaggagaagcatattcctaagtgagattacaacaagagagcagttaggccacacatccctctccacatagtactccatccgtcccgtaataagtttatttttggctcattatatttatcccaaaattaattttatttttagtgatcattgcatcgaagtttatgaaagtacaaaataattatactgagagtatataaagtgagaaataattgcattgagatttgataaaatatgggtgtttcggtctttttgttttgtatcgatatgtgcgagatgaataagacaggggtaggccatagcttcgtgctacgcaacatagtagattaatttggagatgaagcttgggaggaggccacgggcagacaaagtcgttgtcctatccaaatgtacgaccatctctgtctaatacatcttcgcttccgtccataaatataaggatttttattcttaagtaaatgaaaatgtttttgtaaacaatggttatttttaaaattttgaattgcttgtattaacttcccaagcatctcattggctaaaaatatatagatgttagtgttttagaattatattgtgatacaaattttaaatcataaaaatgcttatattttgaaacatagggagtagtactctagtgccccacctggctccacgcggcccctctcttattcattttcttttcttttggtggtgatagtgcgtgtggcatttttatattttagccggtcggtggatggacctcgaccgtgccactaacaatgtccactagtttcataccttgcacgtgagtgttgtctagtcatcatgactatacgcatctctttacctaccgatcatgcttcatttagaatattatgtacagctacctttattgatggggtgaaattatgttgtctcttatacgaatattacgcacttttttaaaaaagtttttttttttggcctaaggtagctacatatgataaatggagtgcgatatttctaaaagtaaggtctataactgttgagcactacaacatcgtggatatatcgacttgatatcacaaacatgatgtaaacgcaaaaaggatggttgtcccgcttttgttttcacggtaccatatcacgcaccttactcgcagtgacagtactcacaaactgttcatacaagacaaaactatacatagtagtagtacattacactgagaaaagtttggcaagcacttaattagcaacaaattgaagaggaaggagagaggaacttctgaagcaacatatagaatccatacatatggccaaactcagctgatacttgaccctgattaactgaagctgaaacggtagctagctagctagctaggccatccactcaggaggataaccgcccggtggcggcgccggcggctggttcacgtccacggcatgaagcctgcaaaaattagcaagtgcatatttgccatcagtccaacatgattcatatatagacaaccatcactttgccattattaggacaaatcttgataatccgtggaaaactaacttgtttggtgcaaaagcggaattaatgatttttttcccctctaaatgaaagctccatttgtcaaaaagagtgtagaaatctccctttttctaacaaaagtttagcaaggatgaagacagtgcagttcacgcacccgagggcctggaagaagtgctctggttggggaggctcactggaaaacacgccgccgccgccgccatggccattgctgcagtttccgttccatggaggctgtgggggagctgcctctacgtcgatctcgtcaagctgaaacaggaaaggatcaaacaaccaaattaaccaagagaagagcaacgttgtcactgccgatcactacagagaatgatcatgatcaagaaacatgtgcgttctccaaatagcatgatgtcaaattgatgcagagaggtgaaggctgagaagccgatgcatgcattttatactgctgccatgccaccagccggggggacctaccgacctatatatacttggcctacttgtgcatcatcggcttttcaatcacgagcccacaaatctacttcagaggagatcgagcaaaattcttgggagtggtccaagaagcgagtcatgcggtccctaactacaaatgcagagggagctttttctatatggtttctaggtagcatttgagtaaatggaaatctcgtaccttccttttcaggaccctgtttgcatcttgtagcatttgttcctgaagaaaagttcaatattggagcaattagataaaaacaaaccgaatttgcactgaaagaggtacaagtattcactgtagtgtagtatatcatttggcggcattgaagaagatatttcagtgttacctttctctttaggtcgcagagttcatcaagtagtacctgagtctgcaaaatatgtatgaaatcatgcacagaagagtattagaagtcacctagcttggagcagctttttgaatcgtagagaataatatatatcccttaattttttaatgaaaaaaaggaa

SEQ ID NO: 80290 - DNA, 26432 bp, Oryza sativa
  unsure (1)..(26432): unsure at all n locations
actcagttactctcaaaacctccaggcctgtgtgccaactgccaaccctattccaattcctctcactagcatgaatgcatgatagaatctagtttgtcttttccttatgctgaagaaccttctacagaagaatgttttgcttttgcttactaatcatagcgtggtcagctgaatgatcttgtcaagccttcatctttactatttatccctctaaaaacaaagggttgcaactattcaatgcaggaccctgacggacaacatcatcgtaggggtatcaaaagggtttgacaagaagcttcagttagttggggtcgggtaccgtgcagctgtagaaggcaaagatctcgtgatgaatttgggattctcgcatcctgttcggatggctgttcctgaaggcctgaaggttaaggtggaagagaacaccaggatcatcgtgagtggctacgacaagagtgagattggccagtttgctgcctccataaagaagtggaggccacctgagccgtacaaggggaagggaatccgatacgccgatgaggttgtcagaagaaaggagggtaaagctgggaaaaagaagtagaaaagctcttctgcttcatcatcgtttcgttcggctggtattatatatacttccttttggttttgatttttccccatgtgtaagtgtaatccatcttttacgaacaaagagaacaagctttttgaatcatgtaatctctcacggcttgtcgagatataggactcaaaatagtggagtcacactgtagagtcactactgtttccatcagcccatgttttgcccttgcagagtcacaccgaaatactactgaattaaactaaggctggttgattaaccttcacgttgttgctgcactggagtccaaaggaaccagactttcagaaacccaagtttgacaaaacagtggtaaacaacctggaagtctgtaagcagtcgccacgccatttaagggccctgagaaaatccgacgcggccgcgcatcagccatcacgtggtccgcctctgatattcccggttccaataccgcgacgcgcgagcgcacgcaaagctgacgcgcaacgcaacgcaacgaaagcgatctcgccggacacggccgcggcgcactacgccccgaaccgaaccgagcagctgaccggtgatcgaagcgctagcaccgtagcacgcgtgtgcacaccaccagcgcaccaaaaaacctccataaaaacacgcccttttgccgctatctactgctcgtagcacctgcttttttgcgtgggccggccggactcgtcgatctcgtcttcatcatcgcgcgctgaacagaagaatcagcggcggcgcatgcacgccaatcgaggcagcgatgatcgtccaaacctctgacctacacaaagtcacaaaccaggctggactggactactgcagtgctctacgatcaggtacaataccattctataataccattctcttgatttatctacttaaacttattttaagtagataaatcaagagagagaaaagcaacgggctacagatttatagctagctgtagcacggactccaagacgcagtgtatctatgacaggtgggattatgtattaatagtgtagtatgtaactattgtattaatgaactattagattagctataaatgaattggagttagtagttggctatactattgaacttgctctaagtcagttatactaacttataaacacattttaaaaagataaaagaagagagagaaaagcggcgtgctatagatttgtagccagctgcaacacggactctaaaacgcaatgtatatatgatacgtgggaccagatattaaaagtgtagtatatatttatatgtaactattgtataaattggctattaagtaactatagatgatttgaacctagcagctgactgtactattaaacttgccctactagctgcggtgtgtgtggcacttttgatcttctctgtgctctcagcctcgctcgatcgccacttaagtcgatataaaaattggacgcctactccagaattgagtagtgcaacaaccgccagctacttggaaaattctccctttcgtgtcatcatgttccccttctctcgcaatcggcaggtgatctacctgaaatcctgatcagcatcaattaattcgatctgctaattaagtagtatcactgattcccttctttgtgttgagtaggtgccatttctcaaagtggaaggcggtgttgacctacttggctgcatctagaatctaccacatattcaacccagtgtaagtatactttataattagtaatatatttgcaatcagcttatttgcacgatgttagttagttgcctgaggctgtttgctacgcaagtcggagctaatactagctgcatttctttataagctagtgagccctttttttcttcacatcacatgcgcaggaacacgaatgaagaaaagcattatacaaccaaacagagcagtcctaactcaccaactaacccaaaagaaaggaatatattgttaacttctcgttcgaataaaaacaagctactttttgtgaagccagcaagcaatctggttgcatcgtagctcaggcacggcacgtcggcagccaacatatcatgccgattcctttgctcctaatctcacttaaacagaagcatgcaccggccactttcggcgtcgcgaaagccggtcggtcgatgagatctccgcccaaatccacgtgtcagtgcacacggagacgcgtatatatacattggcacgttgatcgagcatctaagcttaactgaaaattttggaatcttactgtaaacgcaatggcttgcatcttttgattcagtcactttgctgtagcggtaaccaagcagtagtaggagagagaggaggtagcgattacgacggccaccgacaccggccgccatcctcccttcctttcgcacgcctcgtggagatgcccggtctgcctcgcgcgatcgaatgaccgatccatccatcggccaccgatcgatgaatggtaggttccacgaggcgacaacgaccgcgcggccgggttggcgaaaaaaaaggcgaaccagtaacgcgaccgcgcgagatgggagcggcaatcgcagcactgttcgggcgggacaggattaggtcacgcccggttgggagctcgagaattttctcatctctactcgatcggtcgccagctatcatgcaacaggccaatcgatcgcaaaagcgcgcgccgtggctatcgcctgtatatcgcgaggtggggtggtggattggccgcgggcaacgcaagtagcgcgagcgacacggtggcggggctcggcgcgttgcggcaacgtacgggggctcggttgttgcgagcgcgcgcgcgcgcggacaccgccgttttctgcgcaaccaccgggcacggtggctggctgggcggccgtggggatgggatggatagccccgatgagtacgtcgtccgatgagaatgccatgtgcgccgtgccgggcggtggggatgggctcccggttgttggcggtgttttggctttggctcatggctccgttgcgccgccagttcacaacttcggatccatcccgtcccgtccgtacgtggccccccgcgtcggattcattccgcccgtcgtctggccgtcggatcaaagacggatggctcgacgtttttcgctgtagtttttgctttgttgtcttattttatctgtgttttttgcgggtcctttcggtttcggataggaaagggcgagcggaaagtgagaaaagaagggggtgaaaggcgtaggatccctttctccgaacgggacgcttctatggggcttgtgacgtgctacggtattccatttcccatagtttgtttttgtcctggttttggacgcacgagtcttacaccacggcatttgttattgggaagacgaccaatggaactgtgagttgaatggtagccatggaccatggttctcaataacaacatgtgaaaaagagataaaatggctcatgattcttgaaccattgaaccttacgcattgcccagataaatgtacgctttcaaactcaaccaatttagagcatcaccaacaaattatgtataattttctcctaaaaaattgtttttggttttctaaactgaaaataagaagtgaaaaaattcttccgtctaacagatagcctaaattcaatcctcaaaacttaaaagtgggcccttctattaaactaccaagagaaaattctgtttttttttctttcacgcgcagaaagatcgctatctcccacgcgcgggaatgaaggagagaggcgggattgcatgattgggagcgactttcgcgcccgcatataaacggagcgagcaaccgggggaagagaactccaaaactcgagtaggagggtaggggatctgttggaactgatttagactaaaatccctcaattagttttaggaatcatataggtagcctgttggtgatgctcttagtgcttgggtcgcctgtgcggcatgtataccaacatgcatatacgtgccaaaacgcttcttttctttatgtcatcatctgttttatctctgtcaacttaagttattggtaaattggctaatgcattgtactacacaacattgaaaattttagaaacatcacttgtaaagctgtactgctaatcaattatttaatgttagttgtgcctatcaaaaggccatggaaccaattattagggttttctgtgcgtatcaaaaaggtcacatgatgttcttcgttagcactgtgagagtaattgcatgcacactactgtgtagatgacgtgttcgaacattggactctcgtcaaccgcaagctgatcccattattctcattggccgcatggatcggcagctgcagctgggacccatccacaggtacaagccacattatggctgtgtttagattcatagtttggatccaaacttcagtccttttccatcacatcaacctgtcatacacagataacttttcagtcatatcatctctaatttcaatcaaaattaaaactttacgctgaaacacaacctataactaggatatatacgtactgcacgagagaacgtgctggtgcacgagacttgcggcttgtgggcgcacggcatgcatggtccaggtttccaaccgcagcctgcctgcttcgcccatccgtgcaacgaccccccaactctgaaaggctgctccgaaatctctgaactatgattagcagattaggtttgacattataatcacctcattaattactgccaggtgtttactgtcattctccctacttgacccattttttgtccccgggtcgacgtcacaaaaaaaggctgagcatgattacgcaccgctagtttcactttcatcggttgggtgagtgactcatccagccgtgtgtatgtacaaagtgagatgagaacaccaaactcaccgtcacgtcaggtgagtacgcgcactagatgaaaactgtctagaaaattatcgaacaactgaacatcttttctgggtaaatgatactccctccgtcataaaataagtgcagttttacactattcatgttcaacgtttcaccgttcgtcttatttaaaaattttgttatgattagtattttcattgctattagatgataaaacatgaatagtattttatgcatgactaaatatttttaaatttttcacaattttttcaaataaaacggataattaaatattgggcacggatatccacggctgcacttattttgagacggaggtagtataattcttatttcttttctaaaaatacctcaacgttttaaatatgacgttaaatagttagattgatagataaaatcatagaaattattttcgaagggatattaccgttttgaccctttttatcccggtgcatcgtgtgcagcaaactttttttttcttggtggagctggcactgtagctgtaggccactggtgatcatcctggggaagaacgccaggtaacaacagccgtgacgcgacgggcgcgcgacctgttccctttcgggtgcggacgtgtggttgattgtgtgtgcgagccgaatgctgcctactgccgccgctttttttttttcttctttcctttcttctccctttaaatcttctaggtacttcttcctgacttcctcctccctttcttctctcgccgccgagagacacgaaaaagatggtgggtgtatagctacatattcacgccacaccgcatcgtcatctacacatctccacctcccgcggcatcaccactcactccaccgccgcgcgcttgttcgcagctcttcctcctcctcgcattgcaggcggctgccgactgaatcaaggtgagtggtgtgtgttgtgtgccttcctctctgtaactctgttcatcagtcggagttaaaagacttaatgagtttatgtggtaggattgggtattaattttgatggtgctagctggcgttcttgatgattgcaggaaggtgactgtccttccaaggattaatttcagcttttgattttttggagtgtgtttcactcttcgaactagtcctttgctttttcttccttcgtgtgcttagttcctctcttctttttgtatctagtttggtactggtagtcgattatgtagtcataaatcagttgcaatcagatcaatactttggtctcaattcttctccgtctttagtcttctgtagtagaggtttagtttctcaaccctgctctgcttttgaagaaaaagaatattcaggtaggattctgagttctgatcagtgggagctttgcgttgcagatgaagcggaccatcatcgtcaaagtggacttggaatgcgagcgctgctatgccaagatcgacagggtgctcaccaggatcagaggtaggtgctctcgtcgcacggtttgcagtttctaggatcaaatggtgtttctggcagcttttgagctgggttaatcgtgacaacaaagatgaatctttgagagttcttgcgtgcgcagacaagggtgagttcgtcatcgacgacatcgagttcgacgtgaagcacaacaaggtgatcgtgtcggggcccttcgacccggacaagctcgcagacaagctctgctgcaaggcgtgcaagatcatcaaggagatcgagatcgtcgacctcccgccgccgcctccgccgccggcgccggagccggagccggagccacccaagaaagaagagccccagccaccgcctcctaaggaggaggagaagcccgagccgccgccggcggtgattatcgtggagccaccggcgccggcgcccgagccggagcccgagccgccgaagaaagagccgccgccgccgccgcctcccaagcaggagccatgcccgccgccgcccaaggtcgtcgaggtcccttacccctggccctacccctacccgttcccgtcgtggccgtccgactgctgctgccaccatggccacggcggctgccactgctgctcctgcgggaaggcgccggagccggcgccggcgccggcgcctccgccgccgcagtacatcccctgctacccgccgcagcagccctacccttgcggcggctacaggatcgtctgcgaggaggacccctcctacgcctgcgccatcatgtgacctaatgatcatcgttatcttctccttaattaccttctccgatctctcctcctgtataattaagcacgcaccgtacagacacgcacatatatactacacatcctacacgtactcctctttatctactcttatacactccctctgtaactgttgatttccttacgtcccatttagaggtgaaaaataagtaagtatatatcgtcattaataaacagtcccaagtaaattcatgtacaagcatttgaatgcattttagagagaaaaaaaaaaggaggaagagagagctgttcagtctgggcctttgatggaatgatcgtttcgtctgcaccacgactgctttgctttgctttgctttatttacgttgcactcggggacatctcactgtcgccaccagctttgctttgctcccttgcctccatttgtcaccgtgtggtgatggaaaatcacagattagataatgcaacagctcgctttttcgcacacgtcgtagtccatcccgccccagccgtgtagccagatcggtgcgaaaagacgcggccgatagctgctggtacgcacgaatcacccgcgccccgcgagaccgcgagacggcaacgcgcgccgaggcgatctggacgagacgacggcgaggcgagacgggcgacgtggtggcgtcgcggtcgcgtgcgcctcggcacggctcgatcggtgaggtgagcacgagaccgcgagatcccgcggcttggggcgcgcacgcacgtcggcgtccgatgcggacgtgccaccggcagcggtgcgccaccaccgctttgtcgctgcagctagcgtcgcgtgggccttgccgcatcggctgcgttccgtttcgggttcacgtgcgtgccggtgtttcggctcatgggcctttattttttccggagtttggcaacgctgcggaactggagttttgtccttttggtgttgcgttgcattgtgtggaccgcgggagaattggtggtattaccatgtggggtttgttttgatagtagtatttggggtatgtatgcatggatatctttgttggaatgcagcatgggaactactgaaactgcccctgaactgacagaacatacccaggttccatcgaagatttgttactcatcagtggcaggtgatcatccctggagccaatcaaacgcagcctctttggttagatggcccttgtggccttgtaggcctaggactaacaacttgagaaacaaaaaagaatctataatcagatgagcataaaggtaggcagccaccacacagaccagacagcctcctctgtgtttactgtttctgaacatttgtgatatctggattgcagtgttctagactcgttatccccttatccttaccataacaacagttttgagtttaggactccccagccaacgggtacccacgaggcggccgttcagacgtcctatcaggtggccagggtgcttacgtgtggagcaccgctgctttgcttgacactgtcccattagcaaatctttcgtcctttagccgactgatctgtacgcatccaaccgcagcctcccacctatcatgattcctgacctgtatgtatccataatccattggacatacgtgcgtgattgcacttgcatagtttgcatcttgcagtgcctcgtgttttcagtgtttgattagcacacgatttttattaggagagcctacgtaaaacttgaaaaaaaaaagcccattttgatttcagttattttttgacggttagaagaacatttagattcgtgtgtaaacattaaaccatctccctctttcttcttctccaccgtaacttgctcgagcagaccaagttcgccagcacaccatccttcccgcaccacccccacgcgccgcttctcaacctcgctaatgccggcgagacccactaaccgttagagatgcaagtggatagtcccactacccgcatacaaacctgtttgttagtttatttttcatatgatagtataaaatttagaagaaaaaataaactagaagtgaaataaacatgctaaaaaaacccgctcgcccgtcccacttgcattcctactgaccgtccctctgctctcttctccctcctcacctaagacacgcccttcattactcacagtcatcattttaagctcaggaaaaacccttcatttttcccagcccaacccctcctttaccatgactgtaaccttgaaccctaattagttgggcccgtcctagccgcactagagctggaggagagggatgccgtcacaaatctcaaagtgattttgacggtccaaaatttgatgaaaatcttacttaaatttatatcgaatgaaggttaacaattctgatttgtattataatataccttgcattgaaacaagcccatacattataaagcaatacctttttaatcaactactgtctttttagttttactctagcgtattttctctctcttttttttttcagagcattgtggttttttttcaatgtgcaaccactaattttggtttcctgtgattttctcctttttctctcactactttacttcgacatacgatgcacgcgaggggagcggtggaaaggaggatgacttctcttttaaggtactccctcggtccttccatcccaaattgatcatccctagattatttttgaggttttcctaaattgatcattatctaagtgttatctattcgtttattcgcgtaaaagtatttgtgcaaagttaatgtcatcgttgcatgtttgttcttttatctgtgcaggagtaaatggcactaggactttaggcgcgcttcgcagcgccctaatgttcgttaagagctatgtagcttaggagcatttacaaaaacattgaatagtactcaaatcagagcaaataataggactatgcgagaactgctgagaccagtattatggacaacgaaaatcacattacaacgggcaagtaggctttgcaaagttctactgggattatttaaagcatgtcatcatatctgtaattgtatataacttcactgtcattcaaatattgaaaaaaattatatcaaatcatcatttttttttaatatcccatttagacttagatcaagtacacagatagccataagcacaatcgatagattctataatcactttaaattacatattgtcggtaagaaatgttacaactttaacaatggatttatcttagtaaacatgttcttaatgtattcattctaacagaaaccgctatacaactcgaaccctgccatcacgtgaggatcaaaaatagagcttgaattctgcaagataaaatcacctaataagttagtccaaaatccatgttaacttatcctacttaaaagagcaagcaacaaaatatatatatatatatatatatatatatatatatatatatataagtctatatacaaatggacctaatcattcggttttgtaaaaaagagctaattaagtaccattatgtggcaatgatatattatatgttgcagaccatgcacctaaaagcatagatatcaagaaacatctgcttatgttaatgaagcagaaattcatttgtaggacagctcccccctaaaatagtctctgattaactaaatgttttttatgaggcaacagaaaagctagttggttagataagacactctttagaaaagtcatatgcccaagtaatacattactgaaatcatttctgatgaacaataatgttttggataactaatcacattactccaatacacatgggagttctacaaagtatgtggcatgggttctcagtctttatagttaataccaaaatctgaaacgtcacttccaaaatgcacattatagataaggctacagtagtagatgactaataagactgcaactctacaatgcttgaagaacataagtccagaaaaaaaatcgtacaccatttaccaaaatggacatgtacaaagcgaagaacaagcaacacataaaaaatctgacagtcctgttatatggtaagttgctaacaatgccctataaaaaaaagcacgcaacccaattatatgtatagaacatgtttacctccaaagcaaataatagtttcagatttgttgttacttgccgataccaatattacatttatgaagcaaacttgatttgtcaacaaattaaggagtgctcatgtatgtaaagaaacaaagaatttgggaatggaaggttatagtagaaatgagcattcagacatgtgggatctgatatggaaccttcggtgggtacaaattaactgacaaagcgaacttcatcacacaatcatgtgcaaaatcaaaacaatatagtgacatttgtcaaacttacctgagtttctagctttgtcagattcttggagatttttcatttcaaagaagcatcatgtaaactcacaaaataactgtgtaataagtaaaagagtaaacaacaattaattcactttccactgattcatcccactactgcactgaaacgcagaatccttcagcaaagcagtacttgtgtatgaaatcccttgtaattgcaatatggatgcaaaactgcatctttagatgctagcaatctgacatggtggcaaacaattagtaccaggtgctgaccagagcaagtcgctgagaagaatgaagaggctgtactctcatggaaaaagcagcactgcaggcgcagacagagaatgggaggaagatcatgagtggatcgagcataaaggaggtgattatttggccattgcaacaacacatcttcttccccagtagcaaaattgtgccatatcgacctcaagccctcaaggtgcctgggattaccatcaacgctggaggtagaacatcgaacgcaattcaaattgcagagccgcacgccaccaacttgaaccaaagtcgaggtcaggctccatcccaccggatcgagtggttgcgctgtctctggtctccactcagtccctcaccttctcctgatgcatcatcacccagagaagaagatagatgagtcaacggtagcgtgagaatgcaaggggaggaagggagcccaagagtcgtacgtaagggagagctaggagggagagaggcggcggcggcggctatgccgacctcgagcgcaacgcactggattgagaacttcatgttgagcttgagtgcacctacccaaaatcaggcgatgggccaacagatcgatccccacacagccacaccatcgatctctatcacagtgcccccaaagctagctccgcatggtccactccccctgctagaagagaagggcctgggtcagcagattgatccccatgccatcgctgggaacagatgagaaggggaaggcggggccgacgatggcgtgaggatgcaagcgaagggagggagggagcgccaggagatgggcaggataggggagagctcgaggggcaagtcgtcgtcgccggcgaggagaagcgggggagggaagaaaaagcggcggcggcgcaaggacaagggaaaggaagagaagggattggggaacagtagtggctagggtttcgggggattgggtgttctttttttttttcagaaaactcccttattttctctttttcagagcgctgtcctatacttgaaatgttgtctctttcacgtaagatatatcttgagggcctttacataataatacataagacaacgaacttacattgaggaacttaagaaagattatcaaggtaagggagggtttttttttgcaaacttaccagctccagcgctctctggtcgcgagatgctgatcggacggcgctgcggacgagtaaggagagcgcccgagggcctttacataagaatacataagacaacgaacttacattgagggacttaagaaagattattaaggtaagggagggtttttttttttttgcaaacttaccagctccagcgctctctggtcgcgagatgctgatcggacgacgctgcggacgagtaaggagagcgcccgaaaaacaccagccttccaacgcgcgggggacgtggatagacgcgcgtgcgtccacgccgtccaaaattctctggtgcgagcagatcgccccaatctttaactaccccgattgctgcatgcctcgtatgtattcaattgcatatttgcatgcccatttgcatgtataatacaacaccttaaatcgataaggtgtattttcagaagtaatgatgttttctagtcttgatgttgatgttgttcgtaaatatatgatcaaattgagatggagggagtagtagagacggggttcataattccgacgaaaactggttgaattccacgaaatttcgaggtttcaacgaggctcgaaaatagaacccgtatgatatttcgacgagtttcatccaaattcaaatttgaattgataaaaaaggaaaataaataaataaaatattataaatagtatgatactcatagaatctattgggatataaattttcaaaaaaaataatgtatttcgtgtatttactaaaatttacagtaggaaagaaaagaataacaaattaaaaaaaggaaaacactttcagtttacctcttttcaagttaccgattgacatttcgatgatttcgctcggaattttgttaaggccgaccagtttttcacgaacttattggtaaactcagggaatttatattcaaattttagtttataaccccacaaaaaaaattagtttataaaatttgttcggaatctatcggctttccacttgattttatgaaaaccgttattccgatagagcctgaaacggaaggccatctcggaatcgtaaaccctgagtagagatagttgagacgagcgtgtgattctctaggcctaatttgaggaagcccacgaggatttcagacctctccgggaagcccaagaagaaaaactcaaatggaacgatgggctgggagcctgggaccatgttgaactggtgtttcttcgtgtttttttgcacgcggagaaaagaaagatgagtctccagttaactgaacttccttctatggatcatcggcatctcaaattgttttttcttgaaacaagacttcctcaatttttggtacgtgagtaatcgggatgaacgaatgcacagaaatcttttcatttgcgttgcagctgggaaattccttgctgagaaagttcggctcgtctagggaataatgaattccagccggtaaccggatcacccaagccaagcggaaaagtacaccagaggtccatgaacttgtcaccgagatacgaaaacgtccttgaaccgtaataccagacacccgaggtcccctaactttacaaaaccggacaccggaggtccctcggcggttttcaacccggttttgtccgacgtggcggctgagtcagttgggacccacgtgggccccatatgtcagccggccacgtcagcctctctcttccccctttctctttctctgtttctctttccttcctctcgctctctgcttgcactcgtagggacgatgccgcggaagcggccgggagggagcagcggggcacgccgtcgatgcggcggcgaaggaggaggaggacactggcggtgaagggcggtggccagcccggagctcggcggggcgaggcaggagaggcggccctatccatgacagggagcatggcggcggcggcggccccatccctacccggaggcgccaccgacgacgaggccgagcgccgccactccctatccgcggcggcggcccgtgggaggaggacatggcggcgcggtgatgcgggaacaggaggcggcatctcccctgccagccgagcgccaccactccccatccgctttccccctgccggccgccgcgcgcctcctactctcccccggccgccgctgttcttctccccagcttgctcccgcctcgccgctgctcttctggtgatcgccgccttccaattcctccaccgccgccgccatctacgctcacttcctcgcgcgcctccccgctgtcgccgatcccgatgccttctccttctcgcgcgccttccacgagctcgccgccgccaccgccaacttctcctcctcctaccgcctcgccgccgccgccgcggcgagttcttccttgtcgttccgctgctccctccgcggccaccccgccgcggtcttccgccgcccgctccgccgcgaccaggcgcacaacaccgcccgcctcgacgtcctcggccattgccaccacgagctcatcctcgacgcgtcgccgccgcctttgatttgggtttccgccgatttgactcacggcggccttagcccagagcgaagagggcgggcgggggaggccgccgccttgcttcccgccgctgccgccttgctcccccgctaacagagacaagagtgagagagagaggaggaggaagagagagaagaggggggagagggatgaggctgacgtggccggatgacatgtggggcccacgtgggtcccacgctgactcagccgccacgtcggacaaaaccgagttgaaaaccgccgagggaccttaggtgtccggttttgtaaagttaggggacctcgggtgtgtagtgttacggttcaaggacgtttttttatctcggtgacaagttcagggacctccggtgtactttttccaagccaagcatccaagcttggacctgtgtgcagttggatgcaggacactagtatcaccgtgtttagttttaaagttttttttcaaatttccaacttttccatcgcatcaaaacttttctacacataaacttccaacttttccgtcatatcgttttaatttcaactaaacttttaattttagtgtgcactaaacgcttttatgtaggatgtgtctgtccgtgtaaatagaaaatcgcctcggagtgggtgtttctcccactctctcattgccatgtggtgcagttccattcgtggagtaaattttaattgtgccgtacgagcagtttcgttggaacacccaacggagcactgtacgaccataccgattgcagtcttgctaggtgtacaattggagtaacgatatatcgtgcgtggtgccgtggtgactggtgagcagtgagccgggtgattattcgtcgggatcgatggtaatttttctcatggttttctacagtagctcgtgcctcgtggtgtcgtgggtttgtggtctcgcacatgaaagcagcatgccgggctcagggctaacggggacatatatttatgccttttgcatattacaattttgctttgccaaaagggagaaaggcatattcgatgaaaaagaaaaggttttgaaagtatacatgtgtgtctctgttgctttatcatttacaaccctatcgattaatgaaacaatgtatacgtgcgtaccttgctaggcacgttcgaccatgaaacaatgtactggctctagctattcacatcattaagatattgctcaaattttccctgtacacgaagggcataggcaagaagaacaatagggagccatcgtttcgcttattcgtgaaataagcgaaatgacatatttataaatgaaaagtaatctgtgaataaaacttttatatatgtgttcttagcgatctaaaagtaaaggctgaaaaaataaactttgctgaaaaacctcaaaatcagctccaaatttaaggttgaaaattcaaattttggctgataaatataagcataagcgaaaaaagagaccgatatatcatgtaataccattcatctctacctcttttttctagtatatcttgtggtcgagacatctcttatttgtctctcttctcccttttcgtatatccacataagcaaaataatgggtattccctttgttgtaaaatataaggaccatatttctaaaaattattgtaaattttaactaataactaaagtaacaatactatatatgttgagtatcatgaatatgatatcattaattagggttcctttgaaacgcagtattctcaatatacttaaaaaaatacagaattgaagtattctagtaccttaagtcttgtggattgaaaaaaaaacagagaaaattctcacgaattattgtttagatggagcatagaaaaatgtacagtaactagaagatagatggacacaaatgatcttttccaataggttgaagttcacgttagaattccttcaaaatctctacgtctcgagccaatctaaaggaatttcataggatactttccttttatccaaatgaccacgtatgaaagttttttatagaattgattttttttttcttctaaaattcctcaaggaatattttgttccaaaggagccaatagtatttgaaattgcattcatatgatgttcaattttatactccacctgtttcgaaatataaggtgtatttcttgttttctgcaaagtcaaaatttatttttttgactaataattaaactaaaaatatgaatgttagtctcatgcatgtagtatcacttgatttatattttaaaatatattcatacaacgttagttttttagttgctgataacatattataaaaatagtattggtcacagtataatgttggagaccgtatagaaacataatacgcctcatattgtcagacacatggagtaactgttaatactattacgaaagaaattaaaagtgaaagttttatgttggagaccatgaaaacttgtatggtattttgaagaaaaggagtatatataaggctttgacttgtctagatgcatatgtcaaggtacaagctatcaacatcgaagggtgcactacaactccatatatgttttgtcgcataagtcaacaaaggaaaggatagtgaaatatctttcacacagcaaatattttcttcactttaaaatatagtattacactgatgacttctgatattatttccatcccagtttgatcactacctaagaaaaaggcactaaaaccaaggtcactaaaacatttatcatagtaaaattaatcctcatcgattaatgtggtatgtcggttcgtgcgaatcatgtccaacaaaaattaattcatactttaaatgttgcatagattaaaccaataaaaattagtcttggttagttgcacgtatacagttatatacatgcagggcactccacggtgcacatgtactatttgcacaaagaaacaaagagaagctttgttaaatgatgattattttgaaaaaaacttaaaaatcttggatgatgatcaaattgggatagagagattatatcgtttgactatgttttgattaaaagtttagtgtaaaatgtaaagttgtaagtcatgcttaaaatatatttagtgataaaaataagacacacatgcttacatagttttagttttctctaagtaagactaacgatacaaatatcatatctaaaagttaatatagtccatatattttaaaggggaagatgatagtttatgtttgttagaatttaaaaaaaaagtattccaaacatataccaaataagctaacaatatggaggtgtagaattgtgggtcatgtattggagtcaaaggctaacttgaagtactactaaaataaggatagatctatgacaacaatttttaatggggttgtttggcgggacttgttgcagcatctttgctacgctgcgtaacctcgtcgcttggctacagcctacaacagtggacagacttgagggcttgaggccgctacatgtaggatgtagcggctgctcgttgttggtataactagttgtagctgttgtagttattgttggctggctgctgcaacaagctcttccgaacaaccccaataataaaacattcaacttatttactcctacgatagttaggctctgtttagtttgcgaaaaaaaaaatttttggtgttagatcggacgtttgactggatgtcggaaggggttttcgggcatgaataaaaaaactaatttcataactcgcatggaaaccacgagacgaatcttttgagcctaattaatccattattagtacatatgggttattgtagcactaatgactaatcatagactaattaggttcagaagattcatctcgagatttcctccctaactgtgcaattaatttttatttttatctatatttaatgctttacgcatgtgtctaaagattcgatatgatgtttttaagaaaaacttttggtgaactaaacggggcctttattaaaactttaggaaattgattattctttagcgtaaatcgaatagcactggatttcatcatctgcctcatagctcaaactcacgtgtgtcagggttatggataccacatacctacctaatacctaatagtagttgattaaatctcggcaggacccaccatatactatgtcttatactgacactgacctcggatatggatgaagttccggataaggaaagacaaccagagttctatatggaaacgacaagaactactcggattgtattcatattggtttccctagttttacttggacaaagggacacttatgggtataaatacaagaccctctaagaggagaggggacacggaacaatagatcaagacataagatcaatatacaagccaacatacgccaagacaagacgctaggtatcgacttcagagataggcatgactagtcccctacgatgcctatggctaccgtcaggagagatatagagttgtctctgatctatgcggattcgaggaggaaggttaccatgttgtcgactacgagtcaatactacagaccgccaggtcgacaacagttagataggctaccccaaatattatactggtatgattatggtgaataagagcaataccggcttcggccaacaggatgtagggttattacctgacaattcaggggcccgaacctgtataaaaatcctcgtcgttatctcttttacctaagtctcgtatacatcttagtaccaacgatccccatactatgtaaataccggaaccgcgacatcaaacgtcgaccgacaacgtggtacagtataaaaaagtttttaaatatttttaggtctgatcaaaccatcgaatccaatcaatacagggcctactctaccaaagttctggcctttgggaagcatttccccatttttttagcacttaccacgagtggaaaaggacggacttctgcgcgaggaagaagaaccggatgacgttgtacggctttcctctctcggtttcccgacgcgaccgcctccgccgccatcgccgcctctcctcacctcgccgcgccgcgccgccccgcctcggccgcgcgcgtcccctcttccccgcctaagccccgcatcccgctcacccaccccacgcaccaacccccgcctcgcctcgccgtcgtcgtcgccgtcgccccctcgcctcgccgcctctgcgtggtggtgaggtagtaatcgctgttgcttcggtttccctttggttgggaggtgggaggaggaagacgaagagagggagagagagagggagatattatcttgggctgccttgccgtgcagtgtggctcgctgtcccactcaggtgcggcgctattccaatccgtgcttatccccggcagaatccaatccccctcgcggcttttctccaaaagcgctccgccttctcgcctatttcgctcgctgccgcggccatgattccccgctgatacctccgcgcgcccatttggttcctcctcgccgaatcccccttcgcagccggtggttctagttgaggaggaggaggaggggatttggttgggggcgagggggaggagggggttgtggagatgtcgtcgtcgcggtcgaacaaccgggcgacgtgctcgcggagcagctcggcgcggtccaagcacagcgcgcgggtggtggcgcanacgccgatggacgcgcagctgcacgcggagttcgaggggtcgcagcgccacttcgactactcgcgtcggtgggcgcggccaatcggtcgggcgccaccaccagcaacgtctccgcctacctccagaacatgcagcgcggccgcttcgtccagcccttcgggtgcctgctcgccgtccacccggagacgttcgcgctgctcgcctacagcgagaacgccgccgagatgctcgacctcacgccgcacgccgtgcccaccattgaccagcgcgaggcgctcgccgtcggcaccgacgtgcgcacgctcttccgctcgcacagcttcgtcgcgctgcagaaggccgccaccttcggggacgtcaacctgctcaaccccatcctcgtccacgccaggacctccgggaagcccttctacgccatcatgcaccgcatcgacgtcggcctcgtcatcgacctcgagccggtcaaccccgtcgacctgcccgtcaccgccacaggcgcgatcaagtcgtacaagctcgctgccagggccatcgccaggctgcagtccctgcccagtgggaacctctccctgctgtgcgacgtgctggtccgcgaggtgagcgagctcactggctatgacagggtgatggcgtacaagttccatgaggatgagcatggtgaggtgattgctgagtgcaagagatctgatttggagccgtatcttggcctgcactacccagccactgacattcctcaggcatccaggtttttgttcatgaagaacaaagtgcggatgatatgcgattgctccgcaacgcctgtgaagatcatccaagatgacagcctaacacaacctataagcatatgcggatctactctcagggcaccccatggttgccatgcacagtacatggcaagcatgggctccgttgcatcacttgtgatgtcggtcactataaatgaggatgaggatgatgatggagacactgggagtgaccagcagccgaaagggaggaagctgtgggggttgatggtctgccatcacacaagcccgaggtttgtccctttcccgcttaggtatgcttgcgagtttctcttgcaagtatttgggatacagatcaacaaggaggtggaactggctgctcaggcaaaggagaggcacatcctccgcacgcagactcttctctgtgatatgctccttcgagatgctcctgttgggatatttacccaatcacctaacgtaatggatctagtgaaatgtgatggtgcagcattgtattaccaaaaccagctttgggtgctaggatcaacgccctctgaagcagagataaaaaacattgttgcttggttgcaggagtaccatgacggttctactggattgagtaccgacagcttagttgaagcaggttatcctggcgctgctgcacttggtgatgttgtgtgtggcatggcagctataaagatctcttcaaaagatttcatcttctggttccgatcccacacggcaaaggagattaaatggggaggagctaagcatgaaccaattgatgcagatgacaatggtaggaagatgcatccacgatcttcattcaaagccttcttggaggtagttaaatggaggagtgttccttgggaggatgttgaaatggatgctatccattctctgcagctaatattacgtggctccttgcaagatgaagatgccaacaagaacaacaatgcaaagtccattgttacagctccatctgatgatatgaagaagattcaggggctccttgaactgagaaccgttacaaacgagatggtgcgcctaattgagacagcaactgcgcctatcttggctgttgacatcactgggagcataaacggatggaataataaggctgcagaactcactggattacctgtcatggaagccatagggaagcctctggtcgatctcgtcatcgatgattctgttgaagtggttaagcaaattttaaattcagctttacaaggttggctctatgttgaacttggcctttttgtaccatccaacttaatcataatgtgtccattattttttgggtgactaacttaggtcttctttcttgtatttcaggaatagaagagcaaaatctgcaaattaagcttaaaacatttaatcaccaggaaaataatggacctgtaattttgatggttaacgcctgctgcagtcgtgacctttcagagaaagttgtgggggtttgctttgtagcacaagatatgacagggcagaacattatcatggataagtacactcggatacaaggggactatgttgctatagtaaagaacccttcggagctcatcccccctatatttatgatcaatgatcttggttcctgcttagagtggaatgaagctatgcaaaaaattactggtataaagagggaagatgcagtagataaattgctaatcggggaagttttcacccaccatgagtatggctgtagggtgaaagaccatggtactctgaccaaacttagcatattaatgaacacagtgatatctggtcaagatcctgagaagcttctttttggtttcttcaacaccgatggcaagtacatagagtcactgatgacagcaaccaagaggacagatgctgagggtaagatcactggcgccctttgctttcttcatgtggccagcccagagcttcaacatgctctgcaggtgcagaagatgtctgaacaagctgctatgaacagctttaaggaactgacatacatacgtcaagaattaaggaacccactcaatggcatgcaatttactcgaaatttgttggaaccttctgacttgactgaggagcagaggaaacttctagcatcaaatgtcctctgtcaagaacagctgaaaaagattttacatgacactgatctagaaagcattgaacagtggtgagtgccgtttgttccactgtagtctgacatatagatatttgccaacttttattctgagcccttccattgttcttgaaatcacgctttaatgatttttaaccatagcaaatttagatggtcttgcagattcagaactgaaatcaccactgtttcatgccttttctccaattatatagtctatatgtagaacaacatgatatgtaaaaaaggaaactttctatttagtggttggaattaacctatacacggaaaattccattggtaccataacagttccagcactacaaaataagttcatataaagctgtataatatgcctattccatttgcttttttcacgcacaagatctgatagaatacgtattggttactaactctgtgctcccacagctacacggagatgagcaccgtagatttcaacctggaggaagccctgaatacagtcctaatgcaagccatgccccagagcaaggagaaacaaatttccattgaccgtgattggcctgcagaagtatcatgtatgcacctctgcggggacaatttaaggcttcaacaagtcctagcagacttcctggcatgcatgcttcaatttacacagccagctgaagggcctattgtgctccaagtcatccccaggatggaaaatattggatctggaatgcagattgctcatctagagttcaggtaagccacccatttgccttgtggaacttatagtgatgtttcttgaactgcaagtacagctttactggtaatagaaccaacttaaactttgcatgcaatgacctaatttccattactccaactcaacttctctggggagaaatctgtttgttaacatgcgttcagtaagtactagaggcgcactattgagttccagacacctttattcctgcagcttgtgtttactgtccatcttatcaatagaggcaggacactcagtagtcacataaaaactgacggttcaaaataggccttccatattatctcaacataaacatagcataaacataaaatgcaatatcgtaacatctgagtaatgactatataaccaattcaatgatgcaacccttacaactatttaagataacggataacccggccgacaacccttaaaactgtgagtaaaaggagattgattagatgatgcgaagctttagattgttcgacgagcttgctggggcacaaccccacttaacagaagcgtaatctaacatctgcccaacggttggctccatgcaggcttgtccatccagctccgggcgttccagaggctctgatacaagagatgttccgccacagcccaggtgcatctcgagagggccttggcctttacataagccagaagctcgtgaagacgatgagcggcacggttcagtacctccgggaatcagagagctcgtcgttcatcgtcctggtagagttcccggtcgcccagctcagcaccaagaggtgcaaggcttccacgagtaaattctgaacttagggctatggccaaaattcttgtgggtgctgtattgttgttgttgctgctgctgctattagcagatcaggcagtctgaggagtacgttagctgaagatgtatcagatgtgtgtagcttgtgaaagtgaaggtagtggttggatagatgtatttgtcacgttgatgtctggagagctagtgagcgagctactaggtgttagtgtaatttaaccggcaaatgtatgaacgaattatgaataaaatcttcacttgtgttgtcatgaataaaatcttcacttgtgctgtcattatttccgaaattattcatcaaattcgaaaaaaaaagaagtgaactatttatatattttatcggacaaatacacaaaaatcttagaattatatcgagttgtgtgtgaattagattgcgaataggcccttggtaaaaatgaaaaaaaatatgggggttttcagtttttacaagcccatttggtcaatactgggctagccgttgttggcccgaccgccggaggctcactcgcagcggtcgatcatggcggggagggagaagaggcggcgggtggcggcgctcgacggcgaagagcggcggcggcggcaggaggaagcggcgaccctcctccacaggatcagaggtgcactccccctccctctcgtgatcaatcgcttaaaaaacttctgaatccttcatcaaccgaagtaaacactcgt

SEQ ID NO: 80291 - DNA, 8197 bp, Oryza sativa
ggaaatccgcgaataaactggaagaggtacggtcttgcacgtcggacttaaaatgacgcacccttcgccaacaggtaaatggtatgtatctgcatatttgttttccacaattgaaatttttgcatcaatacatgtttgaatttcaaaattgcatttaggatctttgaattttgaggaaattcttcaaatgaaattttcagagcaaaccaaaataaaattttcaatgaaaattgtttgtttcacgaccacactgaccgttggaacccaacgaccgaaagtggggccggttgggcccaccaggggatcggccgaaccccctggttcggccgaaccggccaggctaacggtcaggtgcctctttctttgaggcaacggctagtgagcccaacaggtcagtttatccgttgagggtgcactagttaagccaaccggccgggagagggaactccaccccatttcaacacatttacattccctctccaaagtttgctctcaagttcattcaagctttgatagtttccctcaaattcaaaaacttagttgcatatatacaagttgcttaggtgaaactaatcggcgggtgaaactcgtgctatttctaacccccgccgagttagtccgttcttgctccattgtgcagaatgaagaggcgactgtctcgtctgttcaaggggtccggctcttcgtcaagtcatcatgacgagtctagtgctcgttcatcagccgatgtctcgatggaggatgccgacgctccgcgacgtctcctgaacgacaccgacctcgaccttgtcgatgatcatgaaagacaagcttactacatgctgagtgaccgggagtatgctcacacgcgaaagtactcaccagagctgctgaaaaagataggtctgtatgttgattttcgtgctatttggaaagctgttggttggcagagatttgctgtggtagatgagcctggttctcgtttgcttactttgcaatttctgtgcactttgaaaaaaatagaagatggaatttcctttcgctttttccataaggaatacacacttacatggaaggattaagtactcttcttggttttcactattcctgtaaaatcgatctccagaaagaaatttctgggttcaagaaaaataggttttgggaagacatttctggtgctccaatatgcaagaaacctaggacgaatgatatccctaatcctacacttaggctcatgcacaaatggattgctatgactctgtttcctagaggtgatcttagacccattaggggggatgaattaattattatgtttgccatggttagaaagatcaaagtttctcctgtgaaatgtatgataagacaatggttagaaagtataagattttctgctcctgttgagtgcacttctctgattactcggatagcaaaagggctaggggtcgttagtaaccagattgctttcatctcaaccgctcgtccttgtattgatgagaaatatctagtgcaatggcacattcttaaacatggagtagatggatctttgatatactttttccccgattgtacaaatgaaatcccgttgccaaatgcggggtatcatttgtacaactatcatgaactaaccattcccctgcaaaccatagaagaatcttgtgcatgtggaacatacagggagacacacataatggcaaggaatgtacaaaatggcaaaatgattgaaccatgtacattttggttacttgtcattccattgaactttgtcaaattcttgtgacttgtgtagacacttctcatgccctatgatcaagattatacacccacatatatgcacgtgctaaactgctacactgggagctagcaatattccattccattccatttccatactaccacaaaaataaattctccatgctttcatgagctttcttctctaaaaaagaaaatcctttctgaaaaaaaaggaggaaaaggcatggttatgaaaatatatatatatatgaaggagggaaaggcatggttatgaaaaaaaggagggaaaggcatggttatgaaaacaaggagggaaaggcagttagaccgacggcatcgcgtcagtcagaccggcggcgactttagacggctgcagcttcttcggggcggttagaccggacgatctactccggttagaccaacgacttccaggtggtcagaccggctactctactttggtcagacctcgatccgtcaaattaaagggtaactttaatttcttctaaaagttttgtttttttggttacactaaccattcacccccctcttattggcttagttctttctagtcgatcctacaggacgtgctgataccggtagaggtgcttatcaagtatcaacgtgggaatacgaggaggcgatcaggttgttgtaacaaccctcccaccagaaccgcgcagcccagtccatctgatgggtgggcccacttacacattgcacctcacttgtagtttcatccttacttcgtgtaaaaagattaacccaggagtagtatggttgaagggacaaactcttataagttggttccatccttactaacccaacaatgtggtactccctccatctacttttgatagtcatatttccaaatctgaaaaatttatttttgataggcatatttcaatccaacaacctatcatcttaatgactttctcggatttaatgtgtaactcttcattcttctacacaagattggctacatgggcatcgagaaatgtaaatattaatgaatcgcttgtttacgagaaataactagtagcatatttaaatggatgataagtagaattacttatccttggtctatgtgccaagatgaaatatgactattaaaagtagatgaagggagtaataaacatgacacagcactcatgaaccacattaccacacacaggtcacgtcctaattggtctaggatgtcacagttgttatcgactacttcctctacaccgacatgcggctacgtcagactggtcttctctaactcttatttcactgcttagcacgtcggatggtgacgatccatgatcccttactcacatggttcctggtttacgtggtagaaaaattttgttttatgctattgtagcctacctgtaaccttataaaggctctacacactttgtctttacgtgctttagattttcaagcttagggcatattttgggaagctttagatttagagagaacctcatgagaatctagttggtaataatcttgataagccggaaaaccaacatgtagtttctagtttattttgcggattctacaactatagtttctcataatttggacgagactagactgcttgaccttgctccaagactctacaaggaatctacgccccggcgttgattttggtaattaaatacaagcgctaattgtggaccgctatttcatatttaatttaagtgagataatttgagttaggaatttcatattttatatcgatacaactgttgctcacatcatagctgaactgggagacatcaaaatcaagttgtccaagttttgaaattaaattcggtcacctgctacgttgctaacttcaaacaaccaccaaatatgcacacaagctcttggattacttgatggaaaactcttggagtcatctttccaacagatccaactttatcaccaaatgcctttatgcaaatagctacaaacctcccttgtctccctttgcatgattgcatcgttggtgtggcttgctgattatggtggttgtactcagccttactattattctccattttcaaaagttagtgcttttgagttgaaaacgaagttagaggactaaggtttatacccctgttgagttttacctgtggagtggagctgaagccccactagaatcgtctttttccgctgtgctttcttttcggtgtgaggaataagtgtctttttctgtaagtatttacgttttacttatgtttgaatctgtatattaattagtcgttttgtgtaccctgacttgatttatggtcaccaatttatacacaaaattgtctgaaaatttgggctaaattgttaggcgtgacatttggactcaaaaatcaaagagaaatgtattgagtaaaaacatacttaaaaaataatcattgcacaatgcactataagaacattggtcaagaggggagtggtatagagcttttggaagtgcgtgagtagtgaggaagagtgtgtagctcaaccactacgggaccatggaagcacgagcctaaccaagaagcaaatcatctacttccttcgtcctaaaatatagaaactttagattagattagacatatccttttactaggaatctgaaaactatatatgttcagatttgtactaactggtactagatcattatattctggaatgagtgatttgtaggatcgaatcacaataactaagccaattagagggggggtgaatggttggtatacccaaaaaccgaaaacttttagcggaaataaaagttaccctcgaattcgacggatcgcggtttgaccgaagtgtgtgcaccggtctgaccgcctggttgtcatcggtctgacggatgtagatcgatcggtcgaaccgccgtgatcagccgctgcttgctatcgccgtcgccggtctgaccgtcggtatatcgccggttagaccgccgaaacccagtgaaacagaaatcgaagaactcttaaagtagatgacgactttattgattctctctgtgtttacaaagtgcaccaacagcactccttacaaaaatttcgactaaactcgaaaccctaactcaaaactcaactcaattgctctcaaaagcgatatcaggaagcctcacgctccccctctatttatacccgaggtaggcagcctaaagccacgaaccaaactcatactagacgtcctaaacaccttacgaaaccctctagtacaagaaacaaactttacataaccaatcataccaaatttggactccttccaaattcaactccgcatcccatactcacacaatacctccatcgtatgccatatgaaatcttcaccaaccacgtgcatcaactctagcctaagtttccacatgatctctgaccaccacggacgtcgtcttaaccccaagccgactcccggtccatcaccgcaaatactctcccgaggcatcaagtcacctacacatgaaataaacaaagaaaccatattccgagaccaagctatcaccaacttgactcattagtagcaaacaacagtattacatacatatagtattcatctagaagccataaccatgaaacaatcacggatattcaaagaaacaacccgaaaccgaaaccgacacagcgtcggccggtcagaccgtgggctggccggtctgactgctaacacaagccggtctgaccggcaaccaccgcccggtctgaccggtattcatcacctgaaaatcaattatctctaaaacctcttgaacaataatctctaaatatcaaaaccaataattacaaatgccaattgttcatcacagaataagaatcaaaacacatattgatcttacatgattcaaatcctctaagaggtggattaggtggtaaagggtgcaactgtgcaagctatgtgcatcatttcgtggttgaccatacatccataccatgcctttttctgggatatgtactttgtgctcgtttcgtgtaactttttatgcaatagttactacactttgctagttttacctcctgtttgtgaattctttctatacgactatacctatacaaagaaaaagggatagattatctagcttttagccacttttaccgtactaaaatgttgacatgatgtttggtcgagcaaactgcttttgaaaagagaaaataatttaatgaacaacatgaagtctttgatttgtatgcatggatgaaaccaataagaaaatttaattgggtgctgatatttgaagcatggaccttgaaagcaataagtataattatctattcatatacccggcacgtgaagaaacaactgccagattacggaaccgtggatagcttggatgaggcctactggccttgcctcttgcgagttgcgacgcgatgcatacgtttagcaaaatcgtttgcagaaaacagcggacaagtgtcctcgcatccaaaggaacaggcaaaacaattcagatatcctagcaatgtcgttctcatgttttgtctgcaactaacaaaccattggcgcaagcagagtaatgagcatagccagcctacaagatacgaaaatagtgacaacgataggtccctcggacttatgacatgtttatttaaaaaacatacatccttcgtaaaaaaaaatcaactctaactatgtatatgtataaatgtctatcaagttcatagttagaaatacgtttttttaaagatggaggaagtaatcatgtgcgtagacctaacacttcctgaattatatgctctgagttgctcacttttcctgaagtccatggttttgagccaatctagtctgctactgaggtgatagcctacttagcgacaactctatgtttttgacattctgagaaaacaacacttacactaaataaactaagtgaactgggcaccagtttcaattattttctggcagtgttacatgtaattaaaaaaactctcagagacttcttaacacacaaaaattctcaaccatttggttgatgcagttggaagttatagaaaagtcaatcgcagtacaccccggcccccttagcattagtaaaaagttttccggtgtagcttttccttatcagtttccccttactcccttcggttttatattaattgacgttttaaacaaggttgaggtcaaacttttataactttaaccattaataactttaaaaatatttagtttaaaggaactagaacaacatatatagatttgtcttttaaagcactataatataactaaacatgcatttatttattatatatattatagtagaaaaataaggttaaagatatatcttgtagaccgtgtcattgtctaaaatatcaattaaaatgaaaccggagggagtggttctgttactctttatacgggttagtgaggttccaaattgccatggataaaatattattaatttttttcttttggggtaggtagttttgaagtttttacagctttgttatttattagtcaatttttatgatggcttcctaaaattacacaagtcatggcttaaatttgcacaaacagaaaaccgtaactttcgtacaaacttgcacatattaaagctaaggccccgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcttgaattagcttttatttatgtaattagttttgtaagtagtctatatttaatactctaaattagtgtctaaagacagggactaaagttaagttactgatctaaacaccacctaattcctttgtctggtaatgtcaacttaaaaactataaatgtctgcgggtgggcttgggtaaatagccatctaggttcaacgaacctaaatacgcactagtccatcgtacacgtcccaatcccctgaccattacagcggcacattgattggtagtccctgaataaaggcctgtttagtagtacctacaaacaaatatttattacgtgtcacatcggataaatgaatacataattaaagtattaaatatagtctaataataaaacaaattacatatttcaactgaaaattacgagatgaatttattaagcctaattaatccgtcatgagtaaatgtttattgtagcaccacattgtcaaatcatggcttaattaggattaaaagattcgtcttgtaatttatacgcaatctatgtaattctttttttctacatttaatactccatgcatgtgtcaaatattcgatgtgatagggtgaaaagtttttgtttgggaactaaacagggtctaagtagacactcaaaaataaattattacggaagaaaaataacacatatggctctcactactacacaaatcatcatttttctgtcaagggggcattaggttgcaggctggcc

SEQ ID NO: 80292 - DNA, 744 bp, Oryza sativa
gaaaagttgaaaatttgtgtgtaggaaagttttgatgtgatgaaaaagttaaaaatttaaaggaaaagttgagaactaaatcagaccttagcacactgaagttggtaatttgtcaacaaagcgatgtggcgagacagggagaaaaaaatgggatgcatgcagtgcagcagcatgctggcactagcgagcaaagcagtactgtacttggtgtgtttcctgcaagttttgcaagttgctgctgtgatcagtacactgtgtgcaatattgcagaaaaatgcaggctcgatcactttcggttactaaacagtgcacggttttaggtacatgtcggaaggcatttttactactactacctgtcaatggagaacttaatcttcaagaattattttaaatgaactactactagaaatttgcaacactggatagtagcacatatattttagtgagattttaaatgtactgtattattagtatgcatgttattatggcaatgtttagttcccttcaaacttccaaaaattccgtcacatcaaatgtttggacacatgcatggagcattaaatgtgaacgaaaaaaaacaattgcacaatttgcatgtaaattgcgagacgaatcttttgagccaattacgccatgatttgacaatgtgatgctacattaaacatttgctaatgacggattaattaggcttaataaattcgtctagcagtttacagatagaatctgtaatttattttgttatta

SEQ ID NO: 80293 - DNA, 3669 bp, Oryza sativa
tttttttccaaacagtgtgcacgcctcctaaactgttaaatggtgtcactgctaaaaaaaaaatttcttttgccggctagaattagtctttcctagtggttaggctaatcacctgtgactaaaggtcagagaaactctaaagtcttcacatgcgagacatcaaccgtcatcaataattgatttttgctgaaggctgtgttattggacggccatcgataatcgatatttgtcgacggctatgttaagccggccaccagtgataatcaatttagcggggaaattgaaaatacccacgtgcaatttccctctaaccacttacaaagattagttttgaaaaacaacaatgaaaatgaccacgtgcagctgcctgcattccaaaatcgacattcccaaattccaaatccacataacagagcacaaattccaaaaaattagtcatcacatcccgaatcaaaatccacatcacctctgtcgtcgtcgtggtttgttgggtcgaaagccttgctccctcctggatctgccctccacccgccgtgaatgaggccaccggtgtggtggacgagctcgcacgcccacgcgacttgccgacactgaatccatcacgacgcgactcgtcactggcaaatcttgcgttcagagggatgggagggcacgttgaggtcaacgagggagggaggatggactcggcgaggtagggcgtggccagccaacggcagaaccatcactcttgaggcccgctagagccgtatctgttctctcttgactcgccggcaccggatttgcttcctcgctactctccaccgtcccattccccgagccgctgctgccaagcgtcgctgtcgtccccgccccctttctccctctcgagcgccgctactgccgagcgctgccattgtgccttcccccgctctgctgccaccaagtgttcgccatgccccctcccccactccatcgtcgccgcccctttccctgtgccgctactgctaagcgtagtcgccgccgagctgagctgctacaccccatccatagctacggatctgggagagagatgataaaaggagggagagttgaggcaggggaaaaatgatttgattccaggttggtcaatgtgcacgtcttctaatccttccccatgatttttgcaagtgatgctctcaagaccccgcctaaaaaaatcaatttttactcaaatggccgtattttcgcaagcggtttttaggaccacatgttattgttgcaaggaaagctttttcaaattcaccgatgaaaataaaactcaaatgttatgaaaaaaatatttttctaagtagtgtgttcttttttaaaaaaaaatatgcatggaagttgctttcaaaaatcatagtattaatctattttttttaaaaaaagttaatatttaattaattatgtgctaataagtaacttctttttgcctgcacgagagattagttgccaactcattgagccgaacataacctaattgattacgcattagctattaaatacttaaaaatgagttttttttttcatatttagtgaaactatttgataaaaagtttgttcataagtagcaccgtttagtagtttgttaaaggtgcccgctataatctaaggcgatcgataccactttgtcggagctggttagtggcgcgtgcgatcaaatcattaaaataattaagttatagatattataaaatcggaaaaaaaatatttatttgattttttgaaatgaactttaatacgtacttcctccgtttcacaatgtaagtcattttaacattttctatatttatattgatgttaatgaatctagacatatttatattgatgttaatgaatctagatagatatatatgtctagattcattaacatcaagtgtgcatttagttccaaagtttttttttccaaacttccaactttccatcacatcaaacatttcatacacacacaacttttcagtcacatcttctccaatttcaaccaaattttaaactttgagccaatctaaagacacccaatataaatataggaaatgctaaaatgacttacattgtgaaacggagcgagtactatatatttgcacgatgcacactgttagttcgaaaacgatcgataaaagaggaattagccaagagctaggtgataagaagtcagcctaagcagttttattacatgcatgatgatagtaattaacagtgacaggggaagcgggtggaggagggagggtttagtatcatccataagacgacagcgtaggacaaaaggtagcgagctaggaaaccctaggccaccgccaccgccgccgcctacgaatggcgattccccgagtcgccaccgcgctgctcgccgggaggaggagggcggctgcggacatcgtgttcgccggcgtccgcgtgcaccaccaccaaggggcggcgaggctgctgcagcccggcaacctcgccgccgcccgcctctggccgccgccaaccgccttctcctacggcggcagagtcggctcgctcgggctcggcgccaggcgcgggatgtccggctctagcggcggaggtggtggccggagctcaggaggcggcatccccggaggcgacggcaagcgaagattggaggaatggaccaggtcggtggattcccagcttgaagagatccttaccgaactccaacaactaagtgctgctcaaatgaatgctgtcaaggtctccacttcctctttccaaagccttaagaggtaaaaaaaattccttccttttaatgcttgaccgatcttgtttctttgaggcttaattagttgggatgttcttgatttccgttctgtttttcttcttgttttttcatgttaattagatctatggagcgcactggaaaagtcacaacagctgtaatttcactcagtgttactgcatctgtgtatcttgtgctgttcgcgctctattgtgttggggttaaaatggcctatatcgttgacgccgacgaatttgccaaaaaattcgcacacagtgtcttagatgatgaggaattcaaggcaaagctagatcagacagcagatagacttggtgccatagcagtgtccgctccctttaggaaggctcaggagtggttttttggtaaagacagctcacctcaagatgatttggatttggaggcttcagacacttgggaagactgggcagtttccttttccttctttgctctgtcattgatcagaggaatgccagtttatgagagtgagtgagtcaattttgtccttttcaccgttaatgaagaaaccatgtaaccaaaatgttttttttttaagtacagatgaactgtggatgcgtttataccagcttggagttagacgcaacaaggaaaatgaagaacttctgaacattttggttgcagtagggtaatgaattatgctagtagctttaatatgatattattatttgcatgttaaaatcttatctaattttattgtcaggttgatatcaaagaagaaaaagggtaagcttactacctatgcccttgtcgaagagcaatacagggaatgcattgacgcaggattcaggccgaaaattgttccgatcctcaagaaggtatattttcctttttcctagatcctagtattttataatttaggtgctacattaggggtttataagtatattaatattgtgattaatatttttcag

SEQ ID NO: 80294 - DNA, 21654 bp, Oryza sativa
tcctgcagcccggagttatgtttctgttggagttgacggtgtgcgtggcgcgtttcactagaattgttcccatttgtgttgggtctgaattggaggcagttttgagtggagcttggcgtatgcaagaggtttcgtgtgctgaattacagggaaccaatttgaactccctaggttcagtttttccatgccagatttagggtttatgggattttatagtaatgaaagccactagtttgtgttgtggtgttgaggttttacaagtgcaaggacttccagttttgtcgtgccatattatggtttatgtggttttagtaatggaaaccactagttttttggtgtgttgttgaggttttacacttttactagtgcaaggactttcatctttgtagtggccggtgggttagttctgtggcagattggcatttgctgtgtccttgacatgtgaaaaatctgattttggtttgtgagctgacttttggtctggtgatttggtgtatatgtggaaacttatagaactaggacgtgtatgtaagtgctcgaggtatttgtttatgtggtagttttcgccttcaaagttcaaacgtgactacaagtacttcctccgtttcatattacaagactttctagcattgcccacatttatatagatgttaatgatatgggcaatgctagaaagtcttataatatgaaacggagggagtactttatatactatgtatattgttttgtcttgaagccaatttgttgagaataaaatttaactatttatcttgtcctaaaatttgacgttgcatgtgaactattcaaaatcagacaccagggaatacgacaaactttgcttatctggtaaactttaggtattgggtattagaaggcaggtgttctttttttttcaaaaaaaaaatcatattagggaattagggatcttcttgttggattttatggtttgagcttcgcacaatctgtgtgaatggtttgagcaattcagagttgacgatggtggtctgcactggtccctgtttaccctgaaattttgtctaaaggaattatttttgttgtctgcagagtcaacagctttggggaattccgaatgtacatatggtggacacttgttttggagagctttgaggttgccatgttgctcgacccatggattttggttgtctcaaacctggattttgtttgttttggggcaaactaatgaatcagtacgtttcgtttattttgggaagcaaactggagtaatttatcagtactacctgtatgtatgaactacttgtccgctggagcctggaatatcacatggggtaaacgactttgatttgttagttccattctgtcatcgatcactgttggatcgattggtaaaaggccttattgcagcaaacctagcgtttcagtttgtttgcattctgactgtcactggaatgatcccactgtctcatttatgtttatgttttgttcgtatggcttattaacaaatagacaataatttatgagtaaaacttttatatgtatatcttcagctattgaaaagcaaatgctataaaatgaaccacaaaacaaatttcaaaattaagttttggcttataagcacaagggaaaggatgggacggtcctgaatacctacctgaacgcctgatccacaatgcaatcaaatcagaagacgaaaaccctaaccagttggcgcttaaaagtattcatctatctattacttatattttcaggcttgtaacacatcctacatcatttcagcaacaaaattacagctccagttcagttattctttttcatttatctagggaggatgcagcaatggaactgcaaaatctagggacgaggaaagacgactgcaacttgaaataagagctaaagttgaagctgcaaggtgtaggaaacaacattagttgttcttacccagattactgaattagaaaaaaaaaaggtgtggaatgaccaagaacagccaaagaaacgcatcaagagagagaactttagttcagaatactgatcgagaagcttgcatagaaacgtatttttttcgtcaaactcaatagtaacaaataatttagctagtgttccggagaacttgcaccgaccaattacttaaaacaagcatggctgaatttttttaggtcaaccttacaataacatacaagcataaaatacgttgtccttcggtatcactacaaccacaggcagtttaaaatgacggcaacttggtcttacgtacataagaggtgcttagtttcaacacaaaatacggcacatacacaagcgttggcccttgcatacatatccaccacatcttcggcataaacagaagggggaactgaacaccccagggggtagtgcccaggctagttaggagtacgtggtgaatacttgttttccatctccaagccgacaacataatactccctgagggccttcctgtaactacgagtataccggacacaggagacacctgcaagacccaccccaaggacaacagaccccattatacaccttctgtggaacctgttgtaccttattatctccgctatttccttgctatcaaaacaaaacagagagaacagccatatgttactatcatgcctcaagaccatttgagttggtttaaaacaatgttagttccttcaccttgcagcttccattttagctacttcttcatgtagctgtcgaattgtctcgtccacattcttcacaaccttcatggaagacgcaagctctgtagtacttccattggtgtactttccctagatttaggtgttaaaagaaaacaagctgagatggcaatataatgtagaggtccaaacgaacaattcagagtactgagtaataataagtaaatctgaaaaagaaccagttcacgcttcaaagtattcatcgatagacatcaagtttccacctactatgtgaggttacccttagctgaagggctgagtacgtactaactagcttgtgttcaaggtgcaacaaacaacatgggcaacattagtatagcaccaaccaatacatctttgtgttatcagcaactaaattgcagctctagttcagtgattttttttgttgttgcagtaaatgcctagtgtggaattgtttgcgagatagaaatggtttgcatgatacacattacctttcatctgtatagaacaaagtatcttgaactgacaatggtaataagcaaacagagataactgcacccctaattttcgcaggaacccataccttaagctatagattctaccatcataagtttcttatgttataggatatcctatcagattttttttttgggctagccgccaaggtgaggtcgattcattggcagacgcggaacagatctggacacgaaccgatcttggtcgatcgaaacgaacgatctgggacgagtcgaggggcgagccgacctgggactgggaggcgttggcggagagggatcgagggcgacggagagcggcggcggcgggggcgggggcccgcagcttaccggcgaggtagcgcatcgccatagcagacggagattgatcggcggcggcgggctagggtttgctcaattggggacgaggcgaggcgacgatgcttgatgcttcctcgactcgaggggggttcacttctccgttggatccctttctatttatttattggaattacgggaaggaacacgactgtgggctgggccggtcgtcagaacggatccaatagctccaactccaacacggactagttgaccaacggatcaaaccggtccaactcctaaatttagctttctgtagtgaagttgtggagctgtctaaacctagctccacaactctagttcattttgtgagagagctccacctagctccactcccagttttagtggagctgaaacggtttggttgagctggagctggagttggagctgaagttgtgccaaacatgccccaacattttcttttcatttttcttatattataagtcatttgactttttatttctaaaccaaacatttttcagtttgatcaattttataagaaaaaaaattaacaacatcaaattaggttcattaaatcaacatttaatatattttgataatatatgtttcttttgctttgaaaatgttgcaatatttttgacatttttctaggtcgaacttttttagatttgactaagtctgtagaaaatttagcaatatttatcaatgttatagataaaatatacctaatatttttgtgttaggatctacagggcttaccatatattaagtcttctacggaatccagcctcatatatgaaaggtattccagataagaaaaacatgccgagttctacttgggcacggcaacgactactcggatcatatccatactcgattttcctagttttacttggatatgggacacccagagtataaatacaagaccccaaggaggagaggagacacgctaagacaaatgcgaaggcaagcaacatgtgagagctctacgccactatgctgacagagactaaaccaggtcattccaaatattatactcgtatgatactgatatatgtataaaggtaacaccgacttcaaccaaccacaaagtatggctattacctgtcagttaggggcctaaacatgtataaaaacaatctagcactctcatgctccaccacctgccaacctctattggttgtgctaacccaacaatcgtcggtagcacctcacgtccatggcggtcacgtctccacgcactgcaacagtctccaaccgtcaccgagccgcaccaccacaacgggctcgcctccacacactgtagcggtctccaatcgtcgccagccgggggaatttactatttgccactctctcaaaatgccagtgctcaaatgtcactctcccaaattttcattcccaaatgccacccggacccacatgtcagcctcactcatcatcgggtcccacatcacttttgtttgaatggagagtgaggctgacatgtgggcttgggtggatttgggagagtggcatttgagcactggcattttgagagagtggcaaatagtaaattctcccgtcaccggccgcgcctccacaccgtgctcgccttcccacgccgcgtcggcctcggccgctgccggccgtgccaccttttatatatatatatgcgtctagattcattaacatatatgtaaatgtgggcaacactagaaagtcttataatatgaaacggaggaagtagatagaattatagtacctctgtcatatcaatttgtcgtaccccattaaaatccttgatatgaatggatactcatatactctgtcctggacaagtatatatccagattcataattatgattggtttttttttgaacggaggggtatttaagagagatcaagataaaataacaactcagcacgtataagggatgagaaaaccgttagtggtgtatacatgattaattaatttttaattattataaacttaaaaactgacgtatttaatattgtaaggcaacttctatatataaattattttttaaaatagtttgaaaaacgtgacgacggaaattgagataagatgatacgtgtttacagaactccggtatgtaggagtaatgatgtaactttttgggcgaagtttataatttgatggtattttaattcatcaacatgagcgtggcgcccttgcctgtcgtccataaagttatgtataccatcatcatcataatcaacctgtaagaatagaatagcctcttttcatttttggccgtgtttagttccaaaatttttcttcaaacttttaatttttccatcataaactttcaactttttcgtcacattgttctaattttaaccaaacttttaattttagcatgaactaaacacacccaaaggggtacttagatcagggactaaactttactccatatcacatcactaaaacttacttcctgttacatcaaatatttagatactaatttagagtattaaatatagactaattataaaactaattatacggatgaaggctaatttgcaagtcaatgattagcacatatttactgtagcaatacattatcaaatcatgtattaattagatttaatagattcgtctcataaattactctccatctatataattagtattgtaattaatctatatttaatagtttaaattagtgtcaaatatccgatgtgaccggatccaaacacgaaccccagatgaactaccagtggagtatactgtatgggacagccattttaagctacagtattacatgatactactattactagtacgaccataaatcattatccactgttcgtatctggcattctgcgagtgttttttttaatcctccgtcccaaaataagtgtagttttgcactgtttatgtctcacttttgaccgttcgttttatttaaaaattttttacgattaatatttttattgttattagatgataaaatataaatagtactttatttgtgactaattttaattttctcataaatttttcaaataagatggacggtcaaatgttagacatggattttcaccgctgcacttattttgggacggaggtagtaaaatggagaagtactccaggagtatactccgtacgtggctgccttgtttttccgaatccttgtcaagtcccatctgtaggagtaggatagtggagtactactagtagactcctgtgaacaaaaacagtgtgcagcgcagactgggagcatcccatcgagagagagaggacacgtctcaacggcagaaagcgatgaatatcggatgcagcctgcagagggtacggtacaaacttttatacaccgtctgtcacgttgcatacactactcctttaatttcaaaccacataacaactttgggaagaaggaaccttaaacaatttcttggtacactactaactaaagtatatttaggtgttgtttggatacagagacttaactttagtccctgtatttagacacttatttagagtattaaatatagactacttacaaatctaattacatacttagagtagtaaatgaaagttaatttgtgagacaaattttttaagcctaattaatccataattagagaatgtttactgtagcatcacatagactaatcatggattaattaggctcaataaattcgtctcacgaattagtccaagattatggatgagttttattaatagtctacgtttaatatttataattagtgtccaaacatccgatatgatagggatttaaaagttttagttcatctagacagggtcttactagtactattttaaggattactaccaagtacgtactgtattccttaattgacgatcaagttgttttgttttttgtcagtcgtcaggcagcacacaagcgagaaaggtttgcaaacacccataaaataagaccatggctggctctcccgaagcgagaatagaaagaaaaaaaaaagcagttacgactagtcgtaaatacgtcattcattaactgtttaggagtatactactccagtaattaatagtactccagtagaagtgtagtggtagtggagtagtaactaacagaagagagaggatagctaagctaattaagctagcttaccatgcatggagtctaaccctaatcaccgcgcttagcttaccaacccactctcctcctccactcacagaaactcaaaatctccctcctcccactttgggaaagcaaaggggaaaaccctagccgccgccgccgccgccggccactggccatggcagcagctcgtctggcctccacggtgctcgccgggaggaggagggcggcctccgtcgtcatcgctgccggcccacgctacggcggcggcggcggcggcgtccacgtgcacccgtgggcggccttcccctccccgaccgccaccacgcgccacgccgtcgtcgctgccggcggtggcgtcccctgcctgctcccgagggcggccttcccctccccgacgctgccgcccaagccacgggccttctcctcatcaggcagcctgggtcgccgggatggtggtgcacccagaggcgggagcttcctcggatggaccaaaaccgtcgacttggatctctcccggatcctcaccaacatggagatgctcgtcaagaccaccggctcgcacaaggccctcctcgaagaatacgctcaaacacttgagaagctaaccatgtgagtttgaaatttctcttctttttttttcctcctcaatttgtttgctgtttgttgtttgttggtacaatttaaatttgtagatttgcatctttttttcctcatctcatgttttactcctgatctatacttatttgctccccttttcttttctcctgatagagcggtggagaaaaatgagaggagcaagggcagcctagcaacaacttccttatttctcatggcttcagtggtcactatttcttttggtgtctacttttttggggttttcactgggcgagtagatgttaatgggtttctcaagggtttcatcatcgatttccttgatgatcctaccatttccgtcaaaatgcacgattacgttgatgatttggccggcagtgcagtggagtccattaacccaatcaaaagatttgtccactggttgtctggacaacccaggcctgctcattatcagaagctcaatgaggaagtccttaactattataccgactggtcatctatccttgcatttgccgtcaactccattgccaaatcagaagggggcaaaatatctgaaagtaagttaaaattagtcttaaccagtccataaaaagctcttgtgttaataaccatactatgtgcttaatattttatttgatttttcagaggctttgtggcgctttttgatcaatgtgggggtgcaggaaactaaactgaacaaggcattgctgaaagtactagtgagagagaggtaagtgctcattactattagagtaaatttcactttggtcaacctttttacattggactagagttagacttatattttcacttaacaccatatattgttaccatcatttgcactttggaccgggtttcacaaattacacatagtataataattgtatatctgatctcatttcttttgtgttagaaaacttagaattcaacaatttgtactaacactacagtgttgggtattgtaaaacatataatatcttttctagaaaattagttcttaaactcaatatttctccaattttgtctctagtatgagggttgtgaatgttcatatgtagtagtaatgaagtcccattaatctgataggatatcctataacatgttacaatcgttgttcttgcgctaagcatatttgcatggcaaaaatttccatatcattgtttcttgtaaattgctaagcacctagacaacaactcgtgtaatggtaactataaaaccaggtccaaagtgcaaacaacggtaattatacgtggtgttaagtgaaaacatgagcctagccctagcccaatgtgaaattttggtcaataaagatgatccaaagtgaaatttactcttactatattatattgcttctttttatttttgctgttttgcttatttgtaacatcttatcttatatatgtttgctaggttcattttgagacaagagtacaaaggcgtcatcagttacaagatggtggagaatgaatacaaaaccaatttcaagggcaaaattcaggagaggattcggcctatcctgaaaagtgtaaggccgagtttagatccaaactttttttcaaacttccaacttttccatcacatcaaaactttcctacacacacaaacttccaacttttccgtcgcatcgttccaatttcaaccaaacttccaattttgacgtgaactaaacacaccctaagttcaagttttgttctcccaattcctatggctgcgaaggaactaatacaattgaaatctctgttttgcaggagtttgtgatgccagctgctgcacgtggtccaaaatctaagcccagccattaagatgtaccaaaagaagaatgaggctcatcgtgcacattgggttaagaagttcctagaatagcataactgagatcatctaactatttagctaaccattaaggagaggtgacagtggacaccatattttgtatttaatgatggttaaggtggtagtggacaccatttgtttttttgtaggctaaagctaagtgctgcttaattggtagtggacaccatatgttcttttggtaggatatatttggctatgtgatggttaaggcggtagtgggacaccaaattatgtatatttggctatgtgatggttaagggtggtagtgaacaccatattattgttgcatgatctttaccttatgataaatttcatccttttgcacttgctttacccttgttcatccactggtaatgacagatataaacttggtctagctatttgcacttgtcatttttcttgctgtgaaggatgcaactgatgaataatagtgctgatttgcgatgcgtaagaatggattgtgaattctgatatgtgctctttgtgatccatgtgaacagatttttgttcggcacttgttcttctttttctagctgtcagattgggaaagatggccactttgattttgttttcaaactggatgactatatgtacggtttatgttccacagcttcaaacagtactatcatagccatatgccatttttctgttagttgttagtgaaggatttttgtactgcagctgatggtgtactgaactagtgatgcacaccatgttgcaaactcattcatttttgcaaatctgaggcctactcttacctgtatcttttgacattggctggtaataacagatacatgtgcctgttattatgcttattttgcctgaaaatttgacaatgatgagttctgatgttgattttgcttcctacaacagcgttttcataagagcagatacactcttggcctattcttttgctgtagatgatagttactgataaaaacagattgactactatttttacctttggtattcctgatctgttttgcatcctaatcctaatttatttatttgtcactatttctcctgtagcacatgatggttaagtaatgcacattcttcaaaaaactgaggccatttttgcttttgattagttcttgcaaatctgaaataattttatgttttgcaatttgaggtcagctgaataattataatcagtttccaatcctcactacaacaatggtatgaacaggcgcttctcttctgttgcaaattgatttcttgaatctcaattccatgcctcgtgtggtaaccttaaattccaggcttgaattgatggataaccagaaacaagctgtagctaatttcatgaaggactaggagccctttgattggaccaaacagcttgattagatctgtaaatacagtcaccagaatatctgtaagaaaagcccgctggaaattgttcgataattttttgtacgaatcttgtactaacttgtcttgtattcatattaatcaagtctgtttcttctcttgatcttgaatgttgcctaaatctatgatttggaaatagacatcatattatacccggggtaccaatgttcatcaaatagaacaagaaagctatgaaatttggtgcttgattgcatcgaagctggtcaaagcttcctttctttcaatggttaatttgaagttgaaagtttggattttacgtatgagttattgcagtcttgtctagggttgacattataaaccgcaaaattatcaatactccaaagacagaatattctttggcacgtaatgaatcaatgcaatgcttacaatatttttttctatcagtgcttatgatgatatttaggctgtgtttagatccaaagtttggatccaaacttcaatacttttccattacatcaacctgtcatacatgtttagatccaaaatttgaatccaaacttcagtacttttccatcacatcaacctgtcatacacacacaacttttcagtcacatcatctccaatttcaactaaaatccaaactttggatccaactaaacacagccttaatgtatctcaatgtgcatcatcaatgaccatattttttttcttcaattgtatatatcgacgtgcatcatcaataaccatattttttttcttcaattatatatatcgaagtgccttgcacgtacacgctcactggtatatataatgaagatgatcaagagaggggaatgagctatcaacgaacatacaccggaccgagatgtactaatcttttatcagctagtgttcctgagacctacagccaaccacttgaacatgcatgcataactgtatctttcatctaacccatacaatagcagcaacttaacccagcataaatatgtcatagccacaagctgtttgtgaaaacgacttcatttggtcttacataagagttaattggtctaacataacacggcacaagcacatactgtaagctagagtgtgcgctagctagctcttgcaagcattaccccaaatcacatgccatacgccagagtcaaacattattacatggcaacaaaaggataagtgagctggatccccaacccaggctactcaggcgaagatgttgaatacggcggcatccaaacgatcgggttgtcaaaatgctccttgagggccttcctgtagctacgagtataccaggcacaagcgagacctccaaggccgaacccagcaaacacagacccaattaaacaccgcttgtggagcctgttgtaccttgttgtctcctcgatttccagtctatcgcagagaaaacaaatgtatgttagttactagtatcatgcattgggaccttttgagtttggtttagataaatataagaataaataatgttagttccttcaccttaacttttcaagtttagctatttcttcccgtacccaacccagatcaccatccatattcctcgcaacattctctgtagttgcattgctgcgtcctccctggatttagcagttaaagaaaacaagctgagatggcaatgtccaggtccaaacaaactattcagagtaagagtattagtaagacaggacacaggtacatctaacccttgtaaacaaaccgattcgcgcttcaaagtattcatctagttcgccacattttcatgtgccaactatgtgagctcactcttaactgaagctcttaggactaggtactccctacaagcatcttgcgttttcagcaaccaaatagtagctctagttcaatgacttcttttttcttagtaaatgactagtgtggatttgttggtgagatgtgtggcatcctagtggaaatggttgtgcatgatacacatactatcctttcatctgcatagaagatacttggtcgacaacgctaataagcaagcagagactgcacccctaattttcacaggggatcaagtcttaaagctacagattcttggcatcataagtttgtcccgtcatcatcagaaccaacaggaatgcaaatttgaccgctaaaaatacagtacagcatcatggaagtggtaccttttcagacaaataaagatatgagattttgaaccacccaatctaaactaacatcttttaagaaaattgacagtaagtctcaaaagtggtggatgaggaaaagaaaaaaactaatgaccaacttctacctccaccttaactaccccaggacacatcaagagaagccaataactaaagtatgccacataccgggagctaaatttgaaacgcgcgcaagctcaaagtttggtggttttttccccaaggaaacgaaaggtgggcatgaacacagaacagatctggacacgaatcgacctagcgagcgatgcatactagcagctcaattgcatggagatgcataacattcaacgatcaacacgaacaatttgcgacgagtcgaggggcgaaccgacctgggaggcgttggcggagagggatcgagggcgacggagagcggcggcggcgggggcgggggcccgcagcttaccggcgaggtagcgcatcgccatagtaggcagcagctaggagattgatcggcggcggcggctagggtttgctcaattggggacgaggcgaggcgacgatgcttctcgagaggtttcacttctcgatctctttttattatacaggaaggaagacaactgtgggatgggctgggctgggctgggccagtcgtcggaatggatccaacagctccaaaactcggaataagtcgacattttatccctcatctttacgtaagtgcccctaaaccgcaataccggaaatcttgaccccctaacttggattaaattaggtcccctagcagtatggatagctggtttcgctgacgtggcatcctagtcagcaaggaaaaaataaaaaaacttatagggcacacatgttagtggccatatcctatactttctgtctcttttctctttccctcatcttctccatgccaagacggcgtacccgcagcagcagcacagtgcgggcggctggctgcatgaggagtgcacgtcgaggtcatcgccgtcgttgcttatcgcgcagacttgctgatgtagctgctggaccacggttgactcgctgagttagcaggtgggatccacatatcagcgacttccacctcatagcatccatttttttttacctcctatctatctttcgtttatttaattttcatcctcctctctctctccctcacacacacacacgcacacacacacattccggcaacaacagaggcgacaaacggtggtagtgagctggctccgtgggtggtggcgacagcgaggaggaagggagagtaggctccggagacggcgacagaggcatcatggcagcagcaggtggcaactccggcggcaagagaggttgcaacaatggcgtcgaagcggaaatagcaggtagatgttgcagtgggattgcaggttgaggtagtggcggtcgaagcagcaggcggcgcctgcggcgataaggaagaggaggcaacagaagtagcaatagcagcaggccaactggcaagctccctccccagcgcgcagccagctggtgagctccctccccgtgtgtaaccctctaggagctcattcctacgtgcggctgaccggcgagctcctctactcatgtgtggccgaccggcgagctccctcccccacacgtggcccaccaagagctcctcccctgtgtgctgttggccggcgagctccctccccagcacgcgcccggacggcaagctccttcaccatgtgcggccggccgactcctcctcctggggcgtggcttcccggcgaactccttcccccgtgtgtggcaggcccgtgagctcctctccccgtgcacagtctcccagcaatattctccctggtgtgcggccagccaacaagttccctcactagtgtgcggccagccgacgactcccctcccatgagcggtggcggtgggggaggagggacagcggccggcgacagcggtggtggattggaatgggaaatgcggctaaggcaatgcgatagaggaagcgaaggcgatgcgtggggaacgcgtgcgacggcggtgggccacaccatttttatttttatccttgtcactgacatgtgggtcccacaagcgacaatgcgcctagaaggaggaggccgaggagcccaagctggtcagtgtccttccaaatggcctccattcttcctgattgcgccctttaccatgggagctagatctagtgggtgttgatatgcctcaaaagcatgagaaggaggagggccacgagatcgatgcctcccaccgcccttgttgccgatgtgcactcaggctagatctagcagtgaggagggcctaagcctctagatcccttttttggggacgtactacaccaccaccatgcctgcacagagaagctctctgtggaaaggatgagaggaggggggagaggaaaaaagaggggcgaaggaggagaggcggagaaggagaatggcgaaggctcaaggagagaaagagataggaggggaagggataagactggatggttatccacatatcccgtctccatgagatcctatagagtagtttttatgcatcagaaatgggcctctctaaggcctaactacccaagttacatgatattgcgattattcgtaaaaaaaaaaggtgaaggggggggtgaggggggagggatggtggtgttcaaactcaagttgcttgggcaagagttcgctgcctacacatttagactagttgtttgacactgatatgccatataaacatattgaattataggtttcctgctgtgcatttgaaccggggcgacccgacgaatggaccactagacctatgaactaggagttcgcccggttcgacatccggtctagtttaacccttttttcaaatatgattattaattgctttgtgttctccgggttagaatagtactctatcctaaagaaaaaaaaagttcaattcaatttatctctaataacatatattttatacccctcaatttataaaattaggtgaattgctcttaggtcgaattcatgtggtttttttatcatatgtggcacacgcatggaactcattttggccatgtgttcgtccaattagcaagactacataataaattgaaaataaaatttggccaatcctaagaaaggtatgttttctttgtaatttttgctctaagttagcttacaatgatatgtgtatccaggagaacataaaattgaattgttgtttcaggaattcgccatgaagccttccactgcggcgtaacctgtctactgtctaaacattttgatctggtgatgctactagctagctttttgacgtgtaccagttgaactttggtgatgtttcttagcttcaattataatttgaatctgcagaagagcagctagactcgatctgtcagtgtggccgctataccacgaactgcaactcgatctgttctatggttgtgcatgactttttgtaatgatcgatgttaattaatccgaacccttagcaactcgatctgttctatggttgtgcatgccttttgtaacgatgctaattactccgaacacttttttttttgagaaaattactccgaacacttaatggtgctcaacctgtcctatggctctgtatgcctttgttatgacgtaaagaccgacttaatgatgtactgtatctctatagttcctatatatgctagctacttttgctaacgtaaacatttggataaaattatacaatacaacgaggaatatttccatgccctatatatactcatgtaagcaaatatatatggcaccgttcctgtcaaatttgctaacatacactactacaccaaatattttcctggacactaaatctgtttgtttccaggcgggccataattgacaccgcatggaataatgaggggatcggtaccaggctgtggcccgcacgggaaaacacattatcccgtgcggggcaatttactcaaccgcacgcgaaaatgccgtgcgggcctccttactcgcgcacgcgaaatccacaatcccactccttaactctcccactcctctcctcccactccagtactccactccttctctcctcccggcctctcctctcctcacagcagcgacaacggtggcgccgggagacagcgcgcgcgcggcggcccctccctccctctaccttcggctcccctcccctcccctcccctcccttcccttgcagatccggcagaggggaggcatgggggcggcggatccggcggcgggcgcaggcgaaggcgacagctgcggcggcgggcgtaggcggaggcgacagcggcgacggcacggcccctccctcccctccccttcctcccctcgcaggcggaagggaggcatgggggcggcggtcgatgatggtggtgagcggcgcctccctctctctcccttcggctcccctcccctcccctccctatccttgcagatccggcagaggggagggatgggggcggcggatccggcggcgggcgacgacggtggcgagcggcccctccctccccttgcagatccggcggaggggagggaagggggcggcggatccggcggcaggccacgacggtagcgagcggcccctccctccccttgcagatccgtcagaggggagggatatatgggggcggcgggcgcaggcggaggcaacagtggcggcgacggttgacgacggtggcgcgcggccactccctcccctccccttgcagatccggcggaggggaggggtgtcttcggccggcgacgggagcgggcggcggatccggtgtgggaagcgggcgacggcgacagttagggttttggtttttttctttttttttcaattttttattttcctgtgcgggcgcccgcatgcgagctattttcacagacgcggggttccagacggtcgaaaccaccacacgcgaaaatgagtttccaccgcacgcgaaaatcgtgattgtagtagtgatactgtttttgctgcgttttgaaatactcacttgttaagattatttgcataaaatttttgaaaaagacgaatggtcaaacatgtgtgaaaaagtcaacgacgtcatctattaaaaaacggaggtagtacaatacaacgaggaaaatttccatgccctatatactcgtgtaagcaaatatgccgttcctgtcaaattaattaattaacatactggttttgctgcgttttgaaatatcacttgttaagattatttgctgcgttttgaaatatatttgcaatgttatcgttacctataaatcaataccacatcacaattcacaaacaaaaggggaactgaagcggacaccaccccagcctactcaggcgtacttggtgcatatgggctgatgacctcgaagccggtaacatgctccatgagggccttcctgtagctacgagcataccagacacaagagagacctccaaggccgaccccaactacaatagacgccatgatacaccttctgtggaattccctgttgtaccttatcgcctcctcgatgtcccggctatcaaaacaacacacacacagaaaacaaaatgtatgccactatcatgcgttgcaacctgttttgagctggtttagacaataagatactgctttagttctttcaccttaattcctcaagtttagctacttcttcctcaagtttaattcctcgcaacattcatggaagatgtaacctgatctgtagttgcattgctgcgtcctccctagatttagcagtgaaagaaaacaagctgagatggcaatgtacaggtccaaacaaactatttagagtaaaagaattattactaagacgtacagaacccaggtacatctaaaccttgtaaaaaagaaccggtttgcgcttcaaacatcaaagtattcatctagttttgtgagctcactgtgaacgactgaagctctaagtagtaagtactaggtactcccttcttttatatataaaacaaacgttatctgtatttttaaaaaggaggcagtcctatttgtgtgctccaggtgcaacaaagaacacatttaacaatacaccactacaagcatcttgcgttttcagcaaccaaaatgtatagtgtggaatgattttttttctccgtaaatgcatagtgtggaattgtttgtgagatatgtaggcatactagtggaaatggttgtgcatgatacacatactatcttttcatctacatagaagatacttgatcgacaatgctaataagcaaacagagacaactgacccctaattttcaaaggagatcctgtcttaagctacagattctgggcatcataagttcatcccgacatcgttagaactcagaaccaacaggtggacaataacagttacactctgctaacatgttttagacacggtcttaaaaaaataatgcaaatttgactgctaagggcacccacaatggttatctatagactctctataagagatccatatcagcatatttttctacttggaagatattaaatgaagagagagagagcaaagctatctactaacttaagatagtttatagagaaaaacgagacaatacatgagagagctatagatacccatgtagacatactattgaggtggtttactgagatgtacatgttttatagagagcactttactttaccattgcgggtgctctaaaaacacagtacagcatcatgggagtagtacctttttagacaaataaagatatgagattttgaagcacccaatctaaactaagtaactaacatattttcagaaaatgtctcgataatggtagatgaggaaaaaagaactaatcaccaacatctccctccacctttaattacccccatgatctcgagagaagccaagaactaaagtatgccacataccgtatagggagctcaaagtttggggttttttgaaaacgaaaggtgggcatgaacacagaacagatctggacacgaaatcgacctagcgagcgatgcatactagcagctcaattgcatggagatgcataaaactcatcgatcgacacgaacaatttgcgacgagtcgaggggcgaaccgacctgggaggcgttggcggagagggatcgagggcgacggagagcggcggcgggggcccgcagcttacaggcgaggtagcgcatcgccatagcagacagcagcaaggcgtcggctagggtttgctcaattggggacgtgtcttgcgcggagaaggggcggcggacgcgccggagggaggagcgaatttttcgtttctttttgtttttttcctttttttcgtttctgtttggttggtttttttctccggttttttcgtttctgtttggtttttttcctccggtttttttttcggtttgttttgtttccggtttctcttctactcggttttttttcttttttttttaaagattttataaataccaagtttgtattcgtacgtatagaacgtttgtatatgcgtatacaaactttctatacgtgatatattttctattttttttatttttagtgcgtatacaaactttgtgtgtgtatatttttttatgcattgaaatatattcataaaaatatatatatacacacatatgtatataagtatatacatatgatgtatatatgatgtatatagtacatatgagagaagaggggggtgcggctgaccccccgcgcgcgcagctgatcgcgtatgaaccacccccccttctcattgggttcacttctcaactgtgggctgggctgggccgggccggggcgggccggtgctcagatcaggtctcaaaaggccgaaagcttccttttgttcccgacgctcctggcgctggagatgcaggtgcgttccaagaaaggaaggactcatatatatgtatctgtgcatctctttttttggtggtgttagtgatcaaatctatggtaaaaatcatccataatcagtgcacgatgctagtgtttctttttaattaatttaatttggtcaggaatggctttaattgtttaactgcgagctcgtggcttctgcagcaaaagcgcaagcacgagagtattcatcacacgcttttttttaagaccgtatgtacagtcttaaaaagctatgtaattatcatttattttattgtcacttgatttatcatcaaatattctttaagtatggcataaatatttttatatttgcataaaaattttgaataagacgaatggtcaaacgttattcaaaaag

SEQ ID NO: 80295 - DNA, 5057 bp, Oryza sativa
catatatatatatgtatgcatatatatgtattgaaacatatatatgcatggtttatatatatatatatatatatatatatatatatatatatatatatatatatataaaccatgcagcaacaggggcatgaaaaaaaaaaaggtcagctctatctttagtcccggttggtgttaccaaccgggactaaagatagagctgacctttttttttttcatgcccctgttgctgcatggtttatatatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccacttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaaggatgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatacatgtatatatatatatatattgcatttcacgttaacgttcgtcctcgttcgt

SEQ ID NO: 80296 - DNA, 19199 bp, Oryza sativa
ccgggactaaagatgccggttaaaataaccgggagttaaaatgaatccttaccaactgggactaaagatgtagccaggcggcaggtttcttttttcctttttttattgtttttaacatcgaataatgatttcactccatccacaaatcaaccccaaatcaatcaacacagatcacagcacaaaagatatcaccaaatcctcaaatcaatcatcaccaaatacatcacaaagtgtaaaaaaattacataacaagttctacaaaaaatcatcacaaatacatcacatattcacatcacacaaatacatctcggatccaatcacaaattcttaaaaaacagaaaaaaaatcaaatacatcctcgatccgcgccggccggctcccctccgacagaggcgcaaccgccgcctgccgcgccggccgcctccgcgccagcgcctccgggccggccgccgcccctccgcgaggcctctccgccggccgctcctcgatctgctgccggagagagaagtagaagttgtagagaagggaaggataaggataacacatagagggaggtgaggagaaggagaggataaggataaggataaggataagagatagaagaagatgaggagttgggaggataagtcatagggattatatcctgcatacggaattttagtcccggttggtaataccatacaggactaaagatcgaaataatctttactcccggttggtattaccaaccggtactaaagtggtgatctttagtcctagtttgtgccaccaaccgggactaaaaatcctcggtcccctgacaagcccttggcagagaatgaaccgggactaaaaatcttctttagttccagttggtgttaattaccaaccgcacaccaaccaggactaaagatcaagatttttttaaccgggactaaaaatgattttttgtcccgatttttatagaaccaggactattgtagtttttggtcgaccctgcaaagatcagttttatagtaaaattaaagatcaattttacagttgatttatttaatttttttatctttcagtctttgcttccaaaccgtatgaacataagtacaaattagaagtctccccctttactacggagaactaaacagttggtaagtactccatcctcttcatattataataagtcgtttgactttttacctagtcaaacttcttcaaatttgaccaaatttatataaaaatatactaacattttcaatacacaagagcaaaattaccatttcacctatcgactagatgtatgttagcgaaggactaatgagaagagcaaaacaaatgataaaattcgataatgaatggtataagagggagggccgatttcacgtggaaaaatgaatgtatcaattaatggataaataaatatttttctcttatttttgaggctagaaaagaggtcatcaccagttaacacactactctgtcaatttgaatgggctttctcacctttacgactaacaagtggaggtggttgcatgatactctcatagctcgtttttctgatataaacaatgaaaatggtcagaagcaatataacattctttccatgggaataatcctcgggcggtcggtaactttttatattttaactgtccagtggtgatattgtaacataacacaaaaagatagttgaaaattaaagtttatgtatgactatagaactttatagtagtatcttctagatcagtaaaagggtccctatgctatagattggtgtagaatctcttctcctggtttcatccctttcttccatcgacgtgattggctttcgatgtgtttggcttggacgacagacttggaggtgccccgcctctgtttggatgtcgagaagaaaagtccctggtgacgacttgactcgtgaaggttgtcagggttggccgcggatcgcgccgatgctggaatagtcgctgcagatcgagttgaagcgacatcaccgagcgcacggtgcgacaacagcgacgacgcgacgcgatccgaagacatcactgcccgcggtaactgcctcccagaactggcctttcgcggcccactcgcaattcacaaagcggccctgtgggctatgcatataggaaaaggtccaatttgactccatcaaaatatagctcaaatctaatttatatctctcaattgtaaaactgaatatatcgactcctccaacactcaataccgtcgaaaacaacctcctcaactgttttgattgtggtttttgctaacgtgacaaccatgtggaggcctagtcatcatgatattaacagtagagtgaggcccacgtgtgattcctttccaatctccttccttctcttcccctctcccccttcctttgttttcaggcttcacgacagctagtggctacagggcggaggaggacctcgagggagctgggtggcagcgagttactccccaccttgcaacgagctcgagctccacatccatctccatcgaggaggataaggagtgaggagccaaggaggaggtgcttggggcgaccgtgcgtgagtgggagaagagctccgtcatcggggagaaaggcgctcaaggaggtgttgacacgccgtccctaagctggcccccatcacccctatctcctcttggcgccaactaggccgaggccatcatagatcccgcctgcgactgtcgcctagactacatgttcaccctgcacgtggactcggtggacgacctcccctgccgcgcttgataactccctgatctctgtccacttccaccgtcaaagaagacccggtcggatgggcaccatcccaattggaggggagtgctcgccgccaccgccgcttctcctcgccatttcgcctcctccgtcgctatggagaggagggactagtctctttcctccagggagggtcaactggccagggggaagaggaggagagagatacgaggaagaagggagggagagaaagggaggagaagaaagagaagagtcacgacaggtggacctcacatgctaattaaccaagttagattatgtcaacgtgcctcatcaacgaaaacatttaaaggagtcaactaaatcggttttaatagtatagcgtttcatactctagtattacggcagagggtatgaatcaaattgaagacgcattttagggacttaaagtggacttattccatatatacacagtctacaagcaatgaccgacgtatctgatgggctggtgaaaaagatgctccccgtggcccaaagcagtgaatgctgccgtcttcccgttgtcaaaagactctccgatacttcttctttttctttttttttcgaacttcaactctaacacagttaggcccatttggaatggaatgacagaattttctccgatacctatcaataaggcggtcacacacatcctatgacttggtatttcacaagtttctaaagaagaagtatgcttcccgcgttctatcagtcaacccaccctgtaccacctcatttacccgtcctataagtacatgtcaatcaattaagagttctctttgttcactactagtaaaaaacaattttcctgcaaaaggagctctttagatcgtagaaagagcgtttccgcgtgtgtctgtaaaaatcggcatcccattttcacgtgtagacctttaagaggcctgcacgtgaaaatcgattttcgcagacgtgcctcttaacggttcgcacgcaaaaataagcctattttcgcatgaggacccttaagaggctctcttaaaggcccgcctactagtctatcattcccttcttttcgctcctcaacactttaaaatttttcatccttatcctctcactcctctcactctctcacctctccctcactctcttaatctgtctcctctcttattctcctctcgcggtctagtgtgtgcggcgagtgcggccagcggagggcacagacggcggtgggcgcggacggcggcatcgagcggcttggcggtgggcgcggctggtggcaccgatcggctcggtgacgggcggatccgcctcggcaagcctcctgacggtggcgggcggcgtggtcgacggcgaaggcggtggctccctcgcgaagctccggcggcgatgacaatgaggaggcggccggtagcggcgctgatggccccacgcatacgtgcgctggctggatccacgctgccctcgccgccgacgacgaggaggcgatggcagccgggagcggtgccgccggcttcgcgcgcacgcgcgccgccgccaacggattctccggtttccattttttgaatttttattttattttttggaattttatttttctatgcaggcgacattacccgaccgcacgcgaaaatccgattatcccttgcgattgggccgtccacatgcgaaatatatattttcacagacatgggacctccacatggaaaaaaccctttttgaccgcacggaaaaatccttttttattagtggttggagctaattcttaaacatgatattatggttaagcatgatcacctaattttttatacggaattaatggaagagtaatggccggtgcctgatgaatccataggaccgcttaaactcgtgtgtggcgttgtagatggtgcagtagtggtataccatacatggtgttggtaattttttgacaagttgacaagcacgatcgtagcatcttaagtcttgtggtgatcctagagtcgccaaccacctcgatctagcaaaaagctaaacctagatgggttttgataactaaaccggctagcggagccgatttctagataactacccgtctcgtgggcaaacggaaggttttcaggacaaacctacaaagagatgtcgcactctcgcagcagcggcggacggtttacagcgcaaaccgacaaagatggacaaactaagagaaaactaaaagcaatatgaaaagaacgattcgattgattgatagtagattgattttacaatgaaccggccttgtcccttatacaggggttggtcttgccctctacaggccctcctccacgtccaactcggggtagaaaccaaaggaaacccaaaacatgccttcccgagcaaggaaacctcgagacccgacgaaacagggtcggactcggaccagccggtgtgcggccggtcacaccgccggtctgaccggccctcaaccggcggtctgaccgcccaacacaaggcctaccccagaggaaaccggtagacttccaaattttggcaatatttcctattttaatcctaggtgccaaatttaggtgtaaacatatgatactccctccgtttcacaatgtaagtcattctagtatttcctgcattcgtattaatgttaatgaatctagacatatatatctatctagattcatttgcatcaatattaatgtggaaaatgttagaatgacttccattgtgaaacggaggaattagtactacacatggtgtagtagtaaactcccagacttctcgagtagttatagccaaacgaggttctcagaaatctgaatgctattgtgttcttacacaatattgtcactccatttcgcagtggacataaagaaaaaaccctgaaaactagtgatcgaaggccaaaagaaaccaaaatctgcacactgttttgtccctttggacacaatttacaaacgcaaccattacaggcatctcaacaagaactgcatctctgaccatcaaggccccaactatctgcatatgattgaaatcaaacaaacaaaaccagcactccatgggggaaaaaatcaatcaacctatccctctctctatacaggaaacaacaaatcaatcatcatccagttaaaaacccaattccaccatcttgtacaagcaaacacaatattgatcaggtcatggctctttcagaacctcaataaccaaatccctagccctgtggaagcacttggcagagaatctctcgtacaccatctcgtacatctgcaggttcaaatacgcaaacctcatgtatctgtcaatgcattcctcatacttctggtacaatgcagggatggtcagaacagcaacaatacctgtcagcatgaggcaaagaaacagggcgtgcttacgatcaatcattccaatgccaaaccattgtacaagtggaactaaatgttggaaaattataccggtaataaaatgatgggagctgcttacttgtgtaacataaagtggtgaaatcagtcaggctgccaatgatagaaatgatccacaggctaaggaagacttgataaaatagcaccgagtctttcccgagtgcgatgtcatggaagacagagaagaccgtgttcatgccagaatgcagcagggctgccacttcattcacaacctgctgcgaaatgcgcatctctggaataggtggctctggcctgcaacctcatttgtttgcacaacacaaccagcatcgtttaaaatatttgccaaatgtccacagcgatgagcaattcactcatctgattgaagtaaaaaacagtaagctgtttgcaagacaaagcttatcattgtctacccttagcatttcagttaaaatagtttacagcacgtacctaatctgacatcagtatcacctggctggttgttagattgtcaattagcataaatttggtcaaagttcaaagcatccacctaatcctctaactgaagtaataatgattaaattgatggaggaatgtcaaaacaacagtgaaagctgtgatgatgataagaattaagtgcctggattgttccttccattggttaactatcaactgaaatctgtatcccaaaatggaaagtagagtccaacagaaattccattcctgtgcgaaatcgaaggctaagagtactatgttgatgtaatgagatggctaggattgaggagctgagatcccaatctcacctgttgaggaggcgggcggccttggcccagaggaagaggacggtgaggaggaggaggaggacgttggaggcgagggagaggaaggtgtagccgccggagccgaagagcagccagccggagacggtcgccgccagcaggcaggcgctcacgtcgccccgccgccacatcaccacgtccccaactgcaaccatcgaatcgatttaatcctcgatcaaacaaagctggaagcatacctacccatcatcggatcgagatgcctaccaaattctccgatcagagatgagacgccgccgccgccgccggggcagcaagaatcgtcacgacgatccatggacgacgaatcgaatcaatccgaacaagcagcgaatcagcaaccagctggctagaccgcggatcgaaggaggaaggggcaagtcaatgccttttcctacaaggagaagaatcggggatttcggaaactttccccaaatgagatttctcggtgcgctagctggactccactcaaccaccgatcaacagctcaactccctcccaggctcccagctcgatgtcgcagctcaccctgacaggtgggcccttggccgttgtacagcgtggaaagttgccacgtcggacgctcgtggccacgtcagcctcgcgtgcatggcgcaacggtaaggccattcacagtgcgtatacctgtactagttgagcactttctacgagttctcacgttaattatataccccatctgcccacgtcgccagcggacaaaggcgcatacattaattatataccccatctgcacacacgttaattatatatcccactttctacgagttttcacgttaattatataccccatctgcccacgtcgccaacggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccactttctacgagttttcacgttaattatataccccatctgcccacgtcgccagcggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccatctgtccacgtcgccagcggacaaaggcacacagccatggcaacccgtcgtcgtatgtggcggtccagcgtgcgcctcgacacatcatcatcctcttcagccgcttgttaaagtgcgcagcccggcccactaaccgtggctacccaggtcacattggggctgctccaccacaggctcaaccggagccacaactttaggttctgggcctacacaaccaaaagactagtctgatgggtgaggaccgcccccaccttttaagtcgtgctcctccatcatcaattaccgatgtgcgactaaacccaacaccgcacgtgctccagtaatctcggacccccggaatagagcttgtggatggttaacgtatatactttctctgttttacaatgtaagtcattctaacattcttacattgttaaacggagcggagggagtacctgctaacttatatacttgcatgcgttcttgcagttcgagtcctgcttgcagaggtacgtgtgggaggtcgacagagctatcgagccccaggtgaacaactcacgaacttgctgtcgacggatatctgcttagcttaatatgtcgtgtcctgcatgcatgcatatgactacattacatacaagaactacaaacccaaatatttcaatccactattaaaataatatttctacaataatctacacgataagaagaaagtttattagtatagttcactgttagctttaagcccatattaaaattgttttcaccttttcttttctctatctttctcccacttacgcatttaatttatttatttatgttgaagcatgtgtgtagttctaggttattcatgagagtgaataccctttatattttttctttttccaatccacgtgagttttacgtttatagctggcttatagcccactactatctttgctctaatccttctcatgcattcatgattgaattcatgaatgaaaatctatagcaaaggtaaggccccagttaaataaccaagattggtttctgatttggttgttcttttgttcacccagaaatcttttgcatgcttgcacctaataaaaagacagatccatataaaatagttgcatctgcagcccatttatacatgtgttctgtactttaacattttcttgatctatgattttgattaaataataaatcattttttttacttttccttatataatatgagtcgtttcacggataagttgaacagcaaaaaaacaccgtaatttactcaatgaaaattgagaattaatcataattttgaagcagtgaataattttgaaacagtgaacatatatatcgacccataattttttctgcatataaactagcaactaatgattaattttcccatgccctatctctgaataattaagtccataggcaatgtatgtactctacagcctacgtattactggccgttcgattttgatcctaatgttaatattttcatcacatgtaatacctatattaataataaatctgtcccgtacttcgtccaaatacatttcattgaatgacgatatatatataacttatcagccttatcagcctaatccatagttctttttaattttcaaagttggagtataacacaatcgcatgtctatggctaaaattattcaaattaagaaggaaacatggaaaggcaaggtcagagaaattagactaggggatgtggtaatccgaacaacaacctatggtcctatcactagtacagaatatgtcataggtgccggtttgcaagtgtctataggtgctggattttcacccggcaccaattagttggcaccagtagcaaaacccggcacctatacaaaaatagaaccagcacctataagttcacacgagccaaaaaaaaaaaaaggggaagagccggctcgaatcgagccgagctcaccaactgcgtcctcacgccctgccccacatggccacatcgattgctcccgacaaattcatccacaaattcacaaaaaaatcatccacaaccatacaaccatactccacaaattcacaaaaattcatccacaaccatacaaccatactccatgttcatcaccgccctactcgatccccttcatcaccgcctctctgatccgagatcaactccaacagcaaactactatattcatcaagaactagcaaatactacaaagatgaatgaactcatgcgggaactcaagaacactcaagaaccttcgtccttctcccttgggtcgcctccggcctccttccttgagatccgctgctgtggcacggccgctgccgccgctgtggtgtgccgcagctgcctcctccaggcagccgccggccacaggagctcgccgcctccccctccgccggatctagtggaggggagggcgcagcagccgccgccgccgcctcaggcagccaccggccgcgggagctcgccgcctcccttcccgctggatctggcggaggggagggcgcagccgccgccgccactgcctcaggcagtcgcccgccgcgggagctcgcccgctgcctcaggtgccggttttaactgaaccggcacagataaatgtgattctaggtctttttcagagattaaagataaacgaaaatgactctgatgatcctcttttagtaatgtgtagttggagaggagatggttgttggatttaagattgggtgaaaattaaataagaagtggtctgatggaggaagcagtactctaaaatctcttatatttatggataaattttgaacccaaatccattatatatgtttgtgcaaagaaggaatacttattagcctcgacatgatacttattcatttcacgcacggatattattaatatttattttgtttgttgcatgtcaccatgatatatggtacgcagtaaagactttttttgtccattaaggtggtcaagtgtacatgataacagacttgaaagtttcatctgtagcattttattgccaacttccaatgataattcagtcaacttcttaaacatttacattttcaagcattgagagtgtttccaaagaaagtatatttatgtggtaaggtgttggtttggagtttggaccattatttattggcaacaaaattgattgctatcatagtaaaagtttcttataaactttatattgacctcatccttttccttatgcagatatcgttgtcttaacatctcacttagctaggactgattgaagaaacacagtaaagtggtggaatgagaaatatccatgaaattatactctaaactgcgtaagtttaattaatatcatttaatccttataagtattgggagcagtttatttgaattttaagcatatgcatatatagttgaaacaattcgaatcacactatatatatggagtgacaagaaggggataaagttgggttttttttttaatcacgagcaagagtactgtttcatctattttactggaagaaataaatttctattcgtaccttgatttgtttatatatatctagatttaattttgcaatgcattgagtgatacacgatgacataatttatattctcaacatttttcaaaatcttcatggttatttagaaggcatgcaaataatcaataatctttgccccataatgcttcacgaccattttatgataatttgaagctaaactgcattacaaataatgaattgagtggaggaacatgccatgaaacttgcccataaataaattagggaatataagaaaattgccacatttgtcaaaatagcatgacattattttgacagtttatatatatcttaggtagatcgtactatcatcacaattaaatattaaatcatatccataattcatattaaataaaacaagaaaattcaaatatcatggattatgaatttgatatctgttaatttaacccaaaatcaataattgtacaatttagctaacatgttcccctataaaacgtgttagcttacattgacttttgtttatcctgagttatgtaatttgcaaattaacaagcatgtttagtctatgattaagattttactatttataaaagaatttgctatataacaaaatcctgtgcaatgcacgggttagcgactagttcttctaacaaatcaaggccgagcggcgtgggggagaacaacgcagatgcgttgtggaggtcgtggcctcgccggttcgtggctccacgcgagtgttcccctccccatcccccgagccggcgatggaggaagaggaagagatggcggtgaaggaggaataggaggcggcaaatctggtgcctaccttgatgacatccctcgagtcatgttgtcgcccatcgtcgtgcctcgcttcaagccgccggacccgtcgtcgtcctccgatttgcgccaccgctcgtcgtcatcacctgctccaagccacagtagcctcctcgacccctctgtagcctcgacggcggcctccatgacctgtccggtttgatgtgccaccgaggaggcagaagccgcgctgctgctcgtcctcgttgcccccaaccgcgggcgccaacgaggagagagaagggatttggtgccggcgatgagagaggagaagggatttggcatcggcccaagctactcaggtacgataacatggtctatcataggtgtgttgaactagtgggttgattgttcagaagctaacacgggactttgtgataaaacaagttccgtggtatggcttgcttgggaactatgacatgctatgtgctaaggacataccttgctggatcaagtgagtcatgccttctcgaaactagccgtgcgtccttctctgagaaggtcaacgacccatagtccatctggcttgccaggggaacccctcgaccgcccgagaagggctatcattgtgtgtccgccgacctaaggacgatggtgtcgcctgtgggtttcacgtcccagttgatgcagtgcatcagctgccgagcccatccatcgcattaatcatagattctcttcggcagtcacgttactatatttccaaagtcaggatttcacactgcctcttcataagttataggatgctgcaggtgggcttggcgtgacatcccacggtggtttttttcaacggcagatacacaggcgctggccttgaaggacataatgcaagctcatgattgtaaaacaatgttttatgtctctcagcagagtatgcatgacagaggtgatagggtataaaatcatggcggcaagtgcataggagagattatgagattcgcccaaagttatgtaccagacaacacatgacttgggctattatccagtaggaggcctgaacccgtatacttgttgtgcgtgtgtttgttctgtgcttctgagcagctcagagtacggcaagacgcctcagagcccctctagatcctaaaccgttgttccccacaactgccaagctcatctctctggtagcgggtgatggctagatgtagcccccaagtctagatttgcactagtaatgtcagcattgctcctggtcgcacatggtggtacgtggggagaagaaggctaccatggatgtattgtgctatgggatgctcccgtgcgatggccagtctgaattagggagggtggatcttttctctctcaccatcttcctccgcaacccttctcgcaatgctgggaagttgttaatgtttcaactgcttagaggcctttgtgggcggttcggtaatagccctttgcatgtttggcagcattagcgacagtcggttcagtgcgagttttgagcgtcgacatgtgggatgtgtgtttgtttctttttccttgtcgcaattatagtttacagtaatatataattttgtaaattttttctgctatatcaatatgaaacatcgaaatgtacaattcgtttggagaaaaaaatttttgttggaattaggaagcttggcattgttgaactaatttgtccaaaaacatattgttccaacatttaattagaaagttatttaagcagacgttttcaacactggagtagaaagtttcttcctactaagttttagagcaaaaagttataaatacaacattctaaaatcagggtccagtcttgcacccggcctcccgggttcaacggtaggcatgcgtcctatatgtgatccttcagcgtatccactggttgatcagttaaactattgatgactggtttgcccgtgacgcacggtatttctagtgtgcttccctataaaatagttgttcacttcttctagagttaaccgtaatcaattgtcttagtggtgaaagctagcgtgtacctatgtaccgcacatgcaatctgtccgtgcctttatcatgatttgtttccataatataatcaagtgtttagaggggacttcaatagtccatggcccttctcagggggtagaattaatattttggccagcggacatgttgtatcgttgtgcttttcgtgcatacacggttgttgcttcgaaaaatcctactagcctagtttcagcgtgtaaagttttagcgtggcatatcggatatacggatacacatttaaagtattaaacagaatctaataataaaataaattacagattcaacctgtaaactgtttggtgaatttattaagcctaattaatctgttattagcaaatctttaatatagcaccacattgtcaaatcatggcataattaggattaaaagattcgtctcgcaatttacacgtaatttgtctaattatttttttctatattaatactctgtacacgtgtcaaatatttgatctgacagggtaaaaagttccatgggaagtaaacaggacctaacttagtttgtttggacgagttgatgtcgttctcaaactactagttgactgactaggaattgactagagaaggtggcaccatttacgtgagaactacggtttatcttacctcgtgcattccaaagtcaaaggactaatccacacgtaaacctaccactggatttattaattagagtaaattgtattagtaacacacgaacttattacactggtggagaaaccctttgtagtcccggttcgtaacccccctttagtcccggtttccaaaccgggagtaccaatccgggactaaagatcgctatctttagtcccgggtgaaataaccgggagtaaagatcgatctaccaaccgggactaaagatagagctgacctttttttttttcatgcccctgttgctgcatggtttatatatatatatatatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgttagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccacttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatgggtaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttctgttatgatgtgccgaccctcaagcttcttcgctgcacctcgttgccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccct

SEQ ID NO: 80297 - DNA, 6560 bp, Oryza sativa
tcctgcagcccaccagaagtaacgaacacagccttagccatgatactcatgaggagatggagattcaaactcaagttgcttgggcgagagttcgctgtctagacctttagacctgcagctggttgacattgatatggcatataaacatattatattataggtttccggttctgcatttgaagcagacgacataacagttggaccactagacctatgagttaggagagttcgtccggttcaacatccggtctaggttttccaacatccgattctgcagtcaggaattataaggatatcatcgtgataatactggacacaaaatggcacatggtagacgcatgggaggtcttcgtgacagattttacaagtttggtcaatcagtcaatgtgtaaacgctggagaaatcgcgaagaaattcgatcggatgcgcatatggatcggcccgtccaagatcagcgtcggcccaggcggagatcggcctacgcggcagttggcaagcaggcccaacaagcagttggcagcccacagcccacgcggatcgtgtctcggtacagacaggacacgtgtcgatataagattggcgcgcacagggagagtccgattgggattttctggcgtggctacaggtttgatgagggaaagagagtgtctctcttggaaaactttactccctcggttttaatttacttgtccttgtagtaaatctcacactaaattaagactcatgacaaattacattggtagctttgttaattgtattctaattacatttgttaaagcaagcactaaaaaattccttccgagagtactattactaatttggctgcatgaatggatgaaaggtaggaagaaaaggagttcatcttcatgcaaaaaagttgatacgctttgaggagtttagtcaagttatgttccttttgttcttcggatgtcaaaacgacggcaggaggaaggtcagaccatgatttcatcgggttaattagtacactacgattttggggttctcttattttttaacaatgattcgatcatttggtttttcctagtatttatttttttttctgatatacttggtttatatattcgattcaatagaaatcttgtaaaaaaaatgaaacaaaatgcaaagtgtgtatcatagaaagagttggagaaaatttgatccatatagaaaaaaaaaccaataaaaaaaatctcatttccaacaaaagcacaaaccaccttttttttcttagatttgtaacactttgttgtttgggttaagtgtttacccgtgagttggaatggagaaagactaattcgcccttggtctccttcctctttggcgttcccatcctcgtctcaccccgcctctatcctcttcctcttcccaagacgactgtcgacgcccgatggcaccatgcgccggtagtctcaccgctcatgggccagtgaatagcgaccttgccccatctcctatcccgtccctcccccatgcatttggggttcaacacactggcggtacccaatccttccttgcgatacagctcttcacctaggcacattagctacagagtgccttggattcctcgccactattgcactccagcaccagcagcagccacgcccaaaggcccccttcttcctgggctatttcaatggcaccgatatgggtgtggcgcatccgttcctcacttcccctaggatctcctttctatcggcatatctcatcatctcccctcatcccttcctcttctccagcgattgagataacttgctaaatgtgtcgaggaactttcgacatagcagtgccgtggatcaaggcagcctgggcggcgaacttgttgccacggccattgcctcccctcggccggcgagccaaggatggagaccatgggtaaattggtctttcttcgtaagaactcacagctaaatacttaaccgggatgatagctatgacaaaagtgctacgaataaaaaaaaacggtggcatgtgcttctggttaaaagtagaaattttttgggctattttcttataccaacttgttttctatgttacatgtgtatgtgcttgcacaaggtcattgaccagcaaaaacttaacccgttcttcactaaagtttgagcctctattcgtggtttatatattagtcaggccggagaaagaaaatcaataatttatcaaaaagtgaccaaacaggcatcgaccatttccgctttccaattataaattgattgttcaatatcgatacacctttagggctgtgtttagatccaaactttggatctaaactttcaactttttccatcacatcaacctgtcatatagacacaacttttcagtcacatcgtaccaattttaacccaaacttctaattttagaaggaactaaacacagcctaggtcgaaagatgcacaaattttgggaatttgagttggatacgtagaactataacccttgcctgtaacttgacacaaggtaaaagcgtcctttctaaaattttctctccaactaaaagaatattgaaataatgattatattaagttttggcaaattaccaatgaatcgtgacaagttggagtggaagaggcgacattacttactccgacactgcacgaacaaaaccatataaataccagttgtagatgttgatctgtacaaggttcggcccaattacagcccacatcgatagactccataatctgggccttttctaattgtgctgttggggcccttggcaaggccacgagacataataagaggaacaattatattcttttttcagttttgcgagattcaggcttccactgaaacattataccactacaaaggtaacaaatgtctagaagagggaggaggagagacaaaaaaaattgcttatatatatttttacacaaggaacaaatgcttagaaatatataatagacactataaaaattatgttttctgtcgtcacccttttatttctattggcggactaacaaaacaaatgcttgtaaacatatattgcaagatttagagttatgagacgaaaaaaacgattttcactgacggacacataggaggcccgtcataaaaaataattctgtttttgaggcggacctcttaagtttccaccagcgacgctgatgataagtaaagatcaccgcttgcaaaaaaaaaaaaaaattcacgacaccgaccgaccaacagggccgtcgacgacggtgagttatatatttgaatgaaagtatatttcatttaaattagacatataatttttttctccaaaatttagggccccaatctatattttgtcaccatccaccaaaccctccgccctcctcgactccctctcatttcctccctccttacccttaccactagtccccctatgtgcttacctgttaccactccctctacatcctctcttcagcttctccacctccgccgcgccacacggtgctctaggtgacggtgacggcggctgtggcggtaacgaggggcaggtgggaggggatgaggccagtggaaacggcgatggcaagccgcggatctggcagtggcaattcctagacgctgtggatccgacagcggaatgggaggaggctagtggcgacatcggcaaactgcgaatctggcggcaatggtgcttggacgctgtggatccggcaatggaaggggaggaggctaatggcgatggcgacggaaagccaccgatccgttggcggcaatgactggaggccatggatctgttggtggcggtgacctaggggcgcaaatctggtggaggcaacaaatctcatggcatgggcacgggcgggcttcggcgaggctcctatggtggatcctcgtccacgatgctgacaaggagagctcgactatggcagcggcagacagagtggcggcggatgctatttcatttgcatgtgttgttgttttttgcatgctaaaaaatggagtgaaaatagatgtagtgctatctggatgtggatttgaatatggatatgatgtgtgtttgaattgatttgaatttggatccctggatgtcgatttgaaaatgcactagctcctctagatgttgattaattttttttggcaaaaaaacatttttttcttcttagtagtgccacctgcaaaaatccaattttcgcagttgttcctcttaagggtcagcctgcgaaaaatcaattttcacagcgcaccgcaactgccagcaaaaattgttgattttcactgaccttagcttgttggcggttgtgccaaccgcctatgaaaattattgttagtagtgagatatacatcaccacttaataaaaaaacttatgaaaagttctcgaaaaattactattagtagatattggagccatatcttctttctaatttgctctctatcgtttcttttttagcttatggagcgcacataaccaaaatttatattttaaaactcaattttaaagttaattatgatttttttcatcgtagtttattctcaacattaccgtttaagttggtaaggacacataatataaaagctttacttacaaactattattgtttttgtttagtagatattatgggttgtataattaatcagttatagttgaaacgttgggtcttgtgtcataaacttttttagataatgaaaatagattacattttcggcctctatccgtagacacacagccaaaaggttcagaagtaactgatagcttaaacaaactaaaacaaccttcacttaaacatagaaataacccagcctatatagcttaatcattttttaacccctactgctgaccaagcagccaatagggctccgaaacgtgtcctagccggaccaacgggaactggacaagtggcacctagccagcaaaaactgtgcccatacaacttggcacattagattacgcaggtacacaattacatggattagagtaatcgagctctagctagctaggccccggatcgatccatctgctgcctctctgatgatggattaaactatgattaactccctcatgccaactcgatcatcaatgcacgagcttagcttagctagctctctagggtcttaaacttaagcacagccttttaagcctcttttgattattaattatacttaattaggagtactaaactatgtctttgcttaattaattactcctgatcctctcgtctcatgcatggcactgtactatccgtcctctcggcctctcctccgccggcaacccccaccgcgtcaccggccacgtgtcgccaccgcccgccggcgaaccaactagccattctcgatgaccggtggatcggaggtgatgcacatggatgattaatttaacaatgttggaggcttggagagaatagtcattgataactattaaacggcagcgttcggggagattggagattagattgcacatcgttttccgcgtgcacgtttcccaaactattaaacggtgcgttttttgtaaaaaatttctataggaaagttgctttaaaaaatcatattagtccatttttgaaatttgaaataattaatactcaattaatcatgcactaatagctcacctcgttttgcgtatcttcccaatcttctctgtcttccctttctcaaacacagcctaagtggagttaacaagttaagtgtagatttgatgggggattagtttaatttatgcataggccccaatgctaattgcaccttaatccttgtggcataggtaaatgggagtacgagaatacgcatctccagcttttggatatcgttcttaattttcatcagggctatagccatgacccatcatctttaagtttttttttctggcctctcctgtgtacggtcagtgccacttgtcaaatttatttttctcctgccctgtgaaagaggcatgagatctttccacatttcctttttattcttttctctctttacatcagaggaggcaggggcaaagttgtcttttcacgcggtgtgatgtggatagagtaacccataatttacccacagcatcttgctttggtgtgggggctgtcatgctagctgcttcatcttttgaagcaatttggttaggtgtgcgcgatcgatggcctccacaccgcgtataaaattactgttgaatcttgacggggtcttcgcgatattagttattattatgtttcaactttagctggctataatgttctagcatatcttgaatatatttatccggaaactcttgtcgtgccgcggttgaatggttgatatattggtacaatgaatatgatggtaggacaataacacatgggaatcaatactcctggctcaaggaatatcgaaccaccgaaatggtaattaataacactttaatgtatcatattccaacaccataaggaatattacttctaactctataatagctgcaataaccagaatgaacatttcccgaattggcataaatggaaatccagctattagaacaatcatgcaaaattgtaattcagcattatttttgcttggattatattctttgctcgctctcacagtcttactccattcatctcattatccgttttatttgaaaaatttagaaaaaaataagtcacgcataaagtattatttatgttt

SEQ ID NO: 80298 - DNA, 9886 bp, Oryza sativa
tgcctggattagctaggattaattaggaggacattgcgtagtggcttagctatctctcaaaagcttaattgggagttgtgttcatatcccaattccgttaattaccgaactataataaattgattttactgtctatatatagtatatctatatatcttcttctgagttctgaccatatacaaacctttcatataatatatatgcaagcttttaggccattgtagcacttgcatctatatacttctccgtcctaaaatgtagtcctaaaatataggggattttagccggatgtgacatattctagtactacaaatttgaacaaacagtatattcatatttgtactattagaatatattacatccggttgaaattccttatattttagacggagagagtaaatactaactactatgaaagaagaggaatcaattaatactaaatttttaggcattgcattccattccatttgaaagatagctgcatctgcaagggaaagatgttcataaatgttgtctctcttggatataaagatgcaggggaaagaaccctaccaaccggcagtaaaagtaatgttgctaactgctatacactgtattaatcagattgacaagttgggtgtgtgttcgattcaccaacctgcatccagatagcttaactagatcgatccaaaaccttagatgataagttggtgaggtgttctcctttttggatgcattgcatttacagattgcccaaccaagattcgaattgaaagggctaattcgtgaatattcaccgtggtaagaactggcgcgaacgcccgacacacacttttatcttttctgttttcaccgtgtttttatgtttctggtaattaaatttgttccaagttcgatttggaatcgaaagtttatatgatctatttcaattcaaaatcaaagtttgttatgaataatgtttctctacaaaagcgcgcaataggaccgacgagtacgtacgcgaggaggaccgaatgcgcgatgcgaacattcacaagttagacctatccaacaccaaaatttgtttcataaaatttgtaaaaaaaaattgtttcatttaatttaatataatcactagcagtcgcaggtcaattagggagacatttccatcaactatagtatacgtgcatttgtgttttaatcaagaaaacaaacaattatttagcacaagtggcgtgtgtcatatatatggacaagtacaatggtcctgcttagtttccacacaaaaaattttatatcatgtcacatcaaacatttgaacacctacatgaaatattaaatataggcttaaaaataactaattgcatatattatgactaatttacaagatgaatcttttaagcctaattgctacatgatttgacaatgtggtgctacagtaaaacatttgctaatgatggattaattaggcttaataaattagtctcgtaattagtaaaacttatagattctgtaattagttttttatttggtgcctaaaaaccccatacgacacacacgtaatacccgatgtgacacgccaaaactttacacccaggatctaggccctgtttagttcgcaccaaacttctccccaacttccaacttttcatcacatcacatcacatccaaaactttcctacacacataaactcctaacttttttttttccaaactaccaactttccctaaacttctccccaatttcagaaactaaacacagccctaaacaccctggaatcgaattaggctgtgtttagattgacccaaagtttagaatttagttaaaattagaaacgatgtgactgaaaagttgtgtgtgtatgaaaggtttgatgtgatagaaagttaaaagtttaaaaaaaaactttggaactaaacacacccttaatcagctgaatgtagcacgtaaattccgtagacatctcgggaaaaaaaggccgtacgtgtgtacagttataaggttgtgtgtcaatacttgtttgtcgcccgtacatacggttggatggatcattaatggtttcttagacgcttttggatatgtttgtcgacttgtaataattctacttacagtacgtacttaaaaaggtaaacaatacgtacccattttatctgaaaaaaaaaattctacatccatagtattccttccgttacataaaaaaacaaacttatgactatgaatttgaacgtagaatacatctaggatttacgtctaaatgcatagttagaagtttgtttgttttgtacaggacggaggtagcagttgaaacatctgttgcaattcataagttgattcagaattttcataacgttagtcgcatgatattagccatttcatttaaaaacaaaaatcaaacggttaggacatactcatccaaaaaaaatcaacatagaagaagaatctggacaaaaggatcaaattcccttctaggtaaagtttttttttgggacggagagagtaagttctatctgttgatacactagttgtcgtcttttcgggtggctccttcatccctgtaaaaacatacttttttttagaattatatagtacaacgcatacactcacaacgcacgcgcactcatccctacgaacacagacacgcacgcaaaccctacccctataagcatcttcgaagattgtgccggcaaataatcctggagattgataaagtcaccaaagacgccttgctatcgacgggtatgtcacctaccactgaaagtataaagccgttgaattctaaaaaattcgcttttatagggagtcgaacccggtttagcgagagaagcacgtaaggtaacatgaatcatattagaatttgtgatgggagtgaaggtccaatggaattatgtaatcttttgtttgaacgaagctagctccgttcatgaaaggagaggggttgaggcaaagtgaattaggattgatgaatacgacgagtgacttggtttgaaccactttagcaaatgaatcgggtgtgtttagttcacgttaaaattagaagtttgtttgaaattagaacgatgtgatgaaaaagttggaagttacgtgtgtagaaaagttttaatgtgatgaaaaaaataaaagtttaaagaaatattttgaaactaaacacggcgcaagcggagaaaaatcttgtgaaaaacacggagtactagtctgagtcgtgttggattctgaccatttttggtcagtcaaggcgtatcatgtgtgacactgtaagtcaggccgtccggaacagcaatggaacagttgagctagccgactactactaccgctagtaacagcaactacgagctgtgtttttctcccacttcccaactcactatcttgttttctactccctccgttgtagaaaataaaaaaaaaagacaaaccctgagttttcgtgccaacgtttgactgtccgtcttatatgaaatttttttataattagtattttcattgttgttagatgataaaacatgattaatactttatgtgtgacttatgtttttaatttttttcataatttttcaaataagatggacggtcaaacgttggacatggaaaccaggtttatctttttttaggacggagggagtacgtaacaaagtgtattttcttttaaaaatactatatatataaattacttaaaaaatcatattgataagtttataaattttgtaagttaatatttaactaatacattaatagtgcgggaggtggaaggccccatcatttagctttttttctaataagccgaaagggaataaaaatcaatttatagataaaacttttatatatttgttattggtgacttaaaacctaatgctgaaaaagaaaccacgttgaaaatatctcaaaattaaatttaaaaacttaaaatttgtctttttctttagctgattaggctatcggatgggatccggagactccagaacagcagtaagggtatccacaatgtacttcaaaaccaatccatagccaataaaataatacattcagctatctaaccacattgtgaaagtagttcataggagagaaatagcaaaagtcatccataaacatatgggctgcccatatagaataaaatatgtcatttgtctctatttcctctctcctcctcatactacatagtactacccatatatattgtgaatgttgcaatagttaaagtccacaaatgtgggacatctatatggactactttagctatatacattagtgttgccctaagggcatcacaatgtattctaaaagtggtccataagcaatataatatttgtttcagccacctagcaacattgtggaactagtccatagagaaaaaattatattatttgtctctacctcttctctcattataatactatttgctatccatatacacggtgaatgttataatagttaaagttgttgatataagtagtccagtgtgaccgttgcagccaccatccctggcacgtctccacaacctttgaagttcacccgtgcgtgcaccgcggcgcacacactacaccaccatcccctccccccctaccgcctcgtttcgcacacctctcctcccccccatcccatcatcaattcttcaatcaatcatccctcttctcttctcttcccatttcaattttccttttcccctcataaaatcactctccctcttctctcttcctcttctccccccaaaaacctcgcctccgcccgatcgcctcgccgccttaacccccacccccgatctccttcctcaccgacgacgcgcgccccactccccccacctcaatgcgcgcttcctagggcatatgaccggtactacgacaaccatcacctctcgccgtcaccgtcatcgtcgggatggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgccgccgccatcgacaagctcccttcgcttgataccgcttccttccccaccaaccccgcctcctccgccgctgttgctgctgctgctgctcctcctcttccccatgccgaacgcgagcagcagcagcagctcaccaagtccggatgcagtagcacgtcggagaccagcaagggctccgtcctctccctctcccgctccgagagccgcgtcaaggccagggagcgcgccagggagcggagcagcgcggccgccgccgcggcatccaaggacgccggggacgacgccgccacccccaccgcgcccaccgccgcgcccgcctcctcgcaggcggcttccttcaccgagctactcaccgggatggccgcagccaacgcctcacccgctgaccacaagcagcagcaggcgtggcagccgatgaccgtcgccgcggccaccgccgactacatcggcttcgccgccgccgccgcgccgcatacgcagccgcggaaatccgccgcgggccatcactccgcgatgccgcacaccttcgcatcacccgctccccacctcgccaacatcacccccatcgccatggcgcccgcgcagcacttcaccctcacacccgccgccgccgagcaccacgcggagatgacgcactactcgttcgaccacttcatgcccgtccacgcggcagcagcggcggcggcggcggcctccaccccggccggcggcgactacaacctcaacttctccatgtcctcgggtcttgtgggtgtccacagtagggggacccttcagtccaattcgcagtctcacctctccagccatcaccaccaccatcaccagcaacagcagcagcagcagcagctgcagaggctgtctgctccgctggatgcgcccaacattccgttcctcttcagcccggccgccgcgcccaccgccgcggacacccagttcgccgccgcattgcagctctgggacgggttccggcacgccgacatcaaggagaagggcaagcactgatcagatcagcagccgcgggcatcgacggcgacgtctcttcttggatggtaaggggccatgaactgatctccactctcccccaattgcttcatgttcagctttgcttgctttttggcagcttgtgccttgggggaatttgtttaagcccccaattgcgaatttgatatggtttaatctccaacttttggtggctctcgaggtggccttgtgtccctcaatcgcacaaaacactcgggctgttcttgagcaattgacgagtgtctaagctttagggggagggagcattcagctcaacccttttacaacaggtgtcgatgcactactcaccgggctgggatcttgcttcttgttctgttcccccccaacaattatttcataggagacaggccaatcgcacggtttctgcttgcccggcattggatttttaatgccttaatttgttgtaaccacaccctccctacgttggggtagtattgctattgcatggatggaagggatgatgcatctgtattgtcaaatgcttgaactgcaaatacagaatggatggagaaaaataccctgtagtctaagctgtttcctagtgttcttttgataggcattggctttgttgagaagtggacgctaacccccaatgtctattgtctttagcaagaactagaaaattttcagaagagctcggagctgaatatgcagctcagcgtagccaaaacaagttcctgttcatgccattttaacaagtagtattttggttgttgtgcttgatgtttgtttctgctttactactagttactagcagttagcacacagagttgtgtgccaccaccaagtcaatgcattcaatgccttgcctgaaggatacaactagaactttttcttggattgcatagttttgtctagctagaaaatgtagcaagctcaaatcacttaggaagaaatacctcctaagcagtacagcttcatgaggtcattttcttttatcaggtcatatctttttctaagatagtttcatttattgttgggagtctagatgtttactgacttagttcgtcaatagtagagatggagaataaggcatgtgcaatatatgtgttgttgaactatcagtgctagactgctagtgatggagttaaggtgctaaagtcttgaggagttatcttaacatcttttcaatgaaaagagaaaactgcgaacgatgcgacttcacaaaaaagaaaagaaaatatcagaggaagctaatccatatgcatctaccgatgttgtaaaaaataagtgcacacgttttagcgctgttgctttaactgtgaagtgtttcctcaaaaaacatctaatggttgacacttaggccgagtatgggacatctatctctgtcaaactcaaaggtgccatggggccaagcaatcaaacatcagtctatatcaaattctaagggcaaaccatacatcaaagcatactattagcgataattgacaaatgactgtgatataagcatgctgttcaagatttggttgccctttaactggatgtgaacttccaaggacccatcagggagcactgaaaatcgtacatattatagtttctgagtagttatattcacttacatatcgcagtatcagtagataattcacaccatgttaagtcatctttacagggacttacatagtatttcatgatcagctctcgtaataacccttaagctagcgctcaatttggaaatttaggctgtgagatctgaatgttcatatagaactattctttcgttgaagtaattttatacatagctagttcccttttttattcaaagttaatagcagaaggaagttcttttcatggtccttcagacttaaaaagggacaaatcatacaaagtacaacagctatgcggttaaaagctgaattgcgtcgttgcagttaacacccagtggttatagttatgttaagatttgtgtaattctcttctggaaaaacatgttcttagatctgggttagcgaaaatcattctcagtagttaatccctcaagtattaatacattatggattatgttgataatcattagatagttgattgtcatggaagacattctcagaatttgcgtcatgttcctaggtgatattctaaaagacttcattgtcaggatcatgtttcctaaattttgccttaatctttatgtaactcagccctttctgttcctcaccaactaacatgtgctacatgtaccttttgtcatatttgataggaaaatgtgagaagtgccactgtgaagtagtatgttgtatcatgaaatggttgagattttcttttgtgtagaagagtgctcaatattatgctttcctttattgatgctttctagcgctaaataaaactaaacccgtatcccgtatgccatattgaattttaagtgcttcgtatttcaggaaagttatctcagctggaatactgtgtacatgactacaaagctgagattttaaacagtatactaccttaagactagtttatcacaaagataagcaccagagtagccaaaaggtgcctttttttattgttttgtagcttagctataactttggtctaactactgcttttccatgtaagttgtatatattaagataagcttgaaatacatcaacatgcttgtgaattgactattgagtttacaaaaaataacttttagtacttagacccagtaatcaaactaatacaataagcctaagttagcacaatcttgttcatgggccattattacaaagcttgaatgaatgtctctagcacttcctaccttttactgcccaagaactgtcatatgtttgacatgatttctttgtttgtcaaataaaatgatttggatccttgcgttatagttgctaggattagaatctgttgtctcaaaggtctttagtacatgtggtttactatgttcttctagagtcctggaatataaatctactcaatagaccaggaaaaaaaagcattatgattaacatcaatccgacaggtgagatgaagctggggttttattgtcttctctgatagaatcattccagaaggatcagttaactcaccaatatagtaggcaacttatgctgctactgtgattaataatatgaaagtgcttcatcaagaaaactagaatgaccaaaaggtgctctgctaaaacagtttggtccagctgtccattttttttaaagcaaaagtttataggctggcctactatatgtctatatctcagcctctgtccatctgtcagcaatgccacactattggagtgacagatctgggaatatatagacacagtattacccattgtttcgtaacatcagtttaaagattgcgcgctaccttttaaggttaagtttagtagaatttgcacatagtttgacaagtaacttgtatttcttctgatggagattttcattctgattatttacaggaagtgaaaacatcaaaacgttgcaagccattcctgtgagcaacatccacagcttgaagctgccataagtgaatgctggatgcattctcggaagtagagcatcaactgcacatctaccttggtcacgggaggacctcatcatcgctattcagatgatcttgtgctttctctgcctgttgttgtattcattttgttgagttgagaatttgggagcattactcgccggagtgccctgaggaggggacgcccttgtaatcctttctgttgtaaactatgtcaatggatgcatgcggctctgg

SEQ ID NO: 80299 - DNA, 6461 bp, Oryza sativa
agaagcacagcttaaaaagctattagtattttttaattccctccgatcggttattatttgaaatgccctccgatccttaggtttaagcaggtggacgatctgcctatacaaaatgccaagtgggcccatatgtgaaaattcattttcatatatggatggcttaagagatcacatgctccgtttaaatggtgctattacacaaattaatcagtaagtaatgtaaattgatctcgtccatgagcaacatctaattaatcttcaagatcttgatcaaaatttcagtcccggccggcaacataattattttgtgacgtcgcagagatcgatcgatcagattaattgatcatagagacatggctagcagcagctactacctaacatggcacatgcatttgggagggatgtatctatttgtatctgcacatggtgacaaggtgtctgcacagatatgtgatgaaagtaggtgataaacttttgaaataaaatggcacgcttttcaaactgctaaacagtgtgttccgtgcgaaaactttctatatgaaagttgttctaaaatatcatattaatccatttttcaagtttgtaataattaaaacttaattaatcacacgttattaactccacgttttacgtgaaatgcttaatgttcatcttcaggatattcaatcaccaccttaatctgcaaacctttgcgtgacgaactacgctgcatcgtcgtcttccaaaaatgtggcgacacgttttgtttggtacattcgatacgatgatatctgtactatgcgtttttgcacatgagaatactgaaaccctacgaaattcagtgaatgaatgcagatatctgttcagctgatatcgagctgttttatagctgcaaatggctagacagcgaagatatgcgatgccttgtagacaaatttatttggttctccatataggttgatttgatttcgacaggggcccaatttgcaccaaaagtgatcgaagaaggacagattttattttgtcttcttatatactccctccgtccctaaatatttgacgccgttgacttttataattaaacatgtttgaccgttcatcttattcagaaaaatttaagtgattattaattattttcctatcatttgatttattgttaaatatacttttatgtatatatatagttttacatatttcacaaaagtttttgaataaaacgaaatgtaaaacatatttaaaaaaaagttaacggcgtcaaagagagcgagtacaattgttacgatcaagctgcataagaaagaaaccttttgcttttgcttttgcacgatgaaatgatagtcaagatatatagcctctgttgaactctcgagagcccatggatcaaaacttcggttggctcgatagttcagcccaatcggcccattgttgcatgcttccagtttgggccaatttttcatttctgtgtcacaattggaacttccgttttgatatcgctccttaagaaaatactccagagttttgcagaggtccatttgaatcacaaatcagactttctaattagaaattttacagtacttaagaaaatacatgagatacctaaattttacactaaaagatttggtacctcgagatacctagcacgtaaaggtatgaaattttatactttaaaatatggtatttccctgcactttctaaaggatgataaaattacccttctaatcaacttagctcgatcattttctgtaaaaaagttagctttatcattaattatttagctcaacacaacctattgctctccatataaagtatattctctgcgttcaaaaataattaaatgacgttagttttcttttactatttttaggtgcaaatttaatcatgacttttttggaataaactcataaaatctaataatcttatgagattacgaaaatacttgtaagtctatatcttttatgttttcaaactaaaaggatataaaaggatatgttgatagtcaaactttgaaagtttcgcctcaaataaaaaattcaaaaagagttatttttacctggatggagtatactccttccttttttaaaatatatgagattctttgaacacgatgtttgatcatttatcttacttaaaaatttagtacaagcatgaaaaactgaatgcttaaagtgcttttaataataaaataagctatatgaataaccaaacatcgtatcaaaatgtcaacacaacactatatatttaaaaatagaggtagtataacgaaggattaattaaacctcgtcctctgcataataaaaatgtaatataatcattttttttctttcaaaagaacagaggatcttgaaatgctcttttaagaaatggaagaatcccagagtccagatacataaacatttcatttattcacagtatatatgacatcatgcacaaatttgctagatcaatttacacagtacaagcacatccttattcctttgtacatatgtgcaatataccaccaaagcatcatgttcattccatcactctaattaagctagctagtgctgttccagcacacacaaacacacactggatcatgcagattctgaagcttgctttgctcctgcaggtggctggtgctactactccctttggagatctggaccatgcacacctcacatgcattcttccatgttatttctttttttttaaaaaaaaaaacgaaacaaaccggcacttagacagtacgaaatttcattgaatatatatcaggaagaatgattctaagttcaatcttccatgttattgatcttatttatacgcactatgatgatcatgatatgatatgatatgatatgcaggctaactaacctcttgttgattgagcatttgaccacctaaatttaatcaacctgcacggtggcgacgcggcgccgatcgcagcagcggcgacaccagctggtgggcggcactcgccggcggcgacggcgcgtagcaccaccggccggagtcgccgccgtgcagctggtcgtcgacgacggtgacgaagaagaagcttctcagagtgacctgcctgctgcttgccttgttcctgtactccactatggccttgtacaccaatggtatcagcccttccatttcttaatcaattaacaatctaataatatatatacccttggatagcttaatcagcaacactgacactgcaagtgagtgagcgaagcttgagctaagctagagcagcaagtgagcctgaaggatgctataaaaaggaggcagttcgagctgaagaaaacgaagggcattttctacctttttttctacctgcaaaaacgtaaacgtctcaccaaatccaccaagtctgaatttttctttcttcttcttttcaagtggcattcggtggaaccgatcagtgcggcatgcttatctgaatacacattttttcagctctgatcatgtgtcacattttgcatcacaggtgatgaggtgatcaaatcacgatggtttgatgtggaattgtggagtggagggaaggaggcgtgagctgaaaatctctgaattattttgcaggtggcgggtgactttcagcaggcaacaccactacaggaaaattgtaaatgtgacgacgatgagctaagctattatccatggagaacttgcgattcaagatgaatcatgaatgtcagattttgcatgttagtggagaagattctgtgctatgcattctgctgatggattaattcccgatcgacattgaattgaagagcttctgctggaagataattttgctcttttttcagttttttggagacttgttcagaggatagttattcttcagaaccgtgcattatattaattctagttttataggcatgtttagtggaatgatttatgtagataacatgtgcctggaatttgcctggcacactggtcttgtccttgatacttaataaactaatcaaagcacagaactctgttcttatgaatttgaaatgtaaaactgaggcaatgaacagggatgaataatttggtgattgcccttgagtcgatcaaatgacaccgacaactctgccgtgaaacacttgacaattggaatttgatggctttacacttttaatgcatgccttccattactcaaaagacaaaggttagctatagctgcagcttaattggggacactgtccactgaggtgtcctctttgatgtgttcatctcaccaaatttcagtagccaagaagccaaaaccactacctctctgcatatgtcttgacatctttatctcctgctgttatgagcagtgataattggtttggatatctttgtctcaaacttaatggagaagacttattagtgctacttaattggaattatttaatagaagcaacgcagctgtacatgcaagatgctgctgcatggttgtaagttgcaagtacatctgcagcacaacgactgcatacctgcagcaacagaatgaatacaacaagtgcaaagatactgtcaaagtttcagttcaggtgctgggtacatatcacacgaccagaaactgattcagaacgttcttaaggtagcttaatcttgcagcaacaatgccaagttaagggaccaattgcatggtaatgaggggcttaacattaaaggaaaaattgaaaaataccatcgcaaatattcacgagttgtgaaattccaatcgtttgttaattagaatgacatgttgatgacacaaaaaaatgtattttttttaaaactccgtggttttgagataatactaagaaaattggccctaacattaattgtacatgaacagtcttgggtgcaaaagcagactgaggtgagaaccggaattcagaattgagatgggccgtggatgccatctggcccaaattgaaagactaggcccaactcgtattgtgagaatgtgggcctcaagttcgtaatggactgcatctgatcggaataattaaattccgaaatattagcactgtgcttgactgaaatgttttagttaccagttgatgattaatagcccgtttacttggtcatttcgggccaaatcgttgcacaagaattatagtgtgacagatttccttattatgtccaaaactcactctcggggaatcaatcaatcattaaccttactagttgaaatcccgcgcattgctgcgggattttatatcaatactttgaagaaatgaaaataccatataaaaagagagagaatgatatgatggttgatacttacaaatattgagcaaacacttgtaagtaaaacttcaaccgaaccaatatagtcgaaaaataaaatagggcatgcaacattaggaactgaattgcagcgtcttcgttattcttcaaaagaaatagtcatctagttatttaatcctaaaaaatgttgcatatttactgtgaatcatgagttcagaggatggtggaaggtatttgtggtctgttatgaatgttgaagggatgttaattaagaggctcatgaagggatgctaagaggctcgttaaagctccttgtggcctaattaattgtgttagttttcctgtaatttctcaagcagaaacggaaaggagaggaaatggacaggggcaaggtgatgtgatggcaatatatgccatcaataatcaatcctatggtgagaaaagaaatcgatgacgtggtttcttctaagcacagttaatggtcttaactttctagaaaagaagggattactaaactacaaccaaaaccaattaatgaattagggcttgttaggtcgagtgtcaactttatcacatttgtaccagacaagtttgatcaaccgagctaggctaaccttttgtccttttggtacatactttaactgtggcatgccacatcaacgacggattcccttctctctgtcacaagttgctacaagtgtggctaataaattttagccacaaaatatatgacatgcatataccacgcattgcaaaaaataattggttatagtactaaggaggaacttagcatccaaaaataatatagaagaaatagattagataatctaaatccataaggattcaaactttaggcaacacatcgctcctagtagcaccctgccagctgagctaactgccgttctcttaaatttggttggactactgaggagaaacttaatgcctaaaaatgatagaaaagaaataggtgagataatctgggtccatgaggattcggacccgaactagcatgtctctcttggtagcacccatacattgcaaaagaaataatgtggaaaaatgtggatatcatctaaccagccatacccttaatcaatggtggttctagagattttgagggtggtcttgaatcaccctccaattttggtataaaagtacccccatcattcatccaacgaaaattgtgataaaatagacataattttgacattatacaatttcaaactatggaataggatatcacccaactaaaattctgaagccaccattgcctttgttaccgaacaatgcatatgcaacaa

SEQ ID NO: 80300 - DNA, 12178 bp, Oryza sativa
gcaaattgttgatattttcactaaatctttggattctaatcgctttgcttttcttcgtggtgaattgggcataattcatccttttggcatggtttgagggggagtttgtacctcatggttttatcaagcaataatatgacaatgagaaaaattgagaaaagagagctttatttatgcatatggtattttcttgtgcatgctagcaatactttgaaggtttatttgtctctagcatagcttgtatgtattctagtcttttcatgagatctagattttgcttttaagtgagatgatgcatgacacttaaattctatacttgaattaagaaaatatgcaatgtcgatgctagcatatggtttgatctataaatgctctatatatatgctttattgacttgttattcctcaaatagctttaattgctcattgtgaaaaagagaataaaaaatatgaaaaaaatgaatatcgaatccttggaaacagtcttgacgacaaggacgtattcaatatgagcaaaataattggtgccgaatccctggaaacagtcttgacgacagggacgtacccggaataaaagagaaaaatatgagcaaaaaggctcaagaaaagaaaaagttaaaaaattctcttggttattatgtgctaaagtttatttgagaaagagtgataaatgcaataggtatatgtgtttagtgtttattcttcaacctatgtgcttgttaagatgttccattataaatcgtatgaaatcatgaattttgattgttgattcaggcttaattgtaaaatctttggttcatggttatactttaatgcatgcttgttatattatagataggtttatcttctttttattgcaacacatgacttgatatgctatatgtatgctaagctcttgaacattaatgaacataattcctatgcttgatgaaatcattgtcaaaatggggagaagtaatgtgaaattttttggacttttgggagaagcaagatgaatttttggagttgatgagaagagcatgttgtttttgggttcaattgggaatttctttcttttaaaaagggggagaagttttcttttggatttttgagcacgatgtgtatgtttgtacgaagtatgctttttaccacttttgtttttatttttccaaacaccaaaatatttttatgagtttgccaatgtgttcatcaacggggagattgtaaaatcaaaggtgtttttgattattattctgtgatgaacaattgggtattggagattattggttttgttatttggaatttattcacgaagtggttttggagatgattggaatttacaggtgaatttataggataatgctgttatttcatgtgaccggtcagaccgggcagtgtgtgccggttagaccggcggtgatcgcgtggtcggaccggccagctcgcggtcttaccggccgacgctgtgtcggttttggtttcgggttgtttgtttggatatccgtgattatttcatgattatgacttctagatggatactatacgtatgtaatactgttgtttgctactaatgagtcaagttggagatagtttggtctcggaatatggtttctttgtttatttcatgtgtaggtgactcgatgtctcgggagagtatttgcggtgatggaccaggagtcggcttggggataagacgacgtccgtggtggtcagagatcatgcgggatactaaggctagagttgatgcacgtggttgatggagattccatatggcatacgatggaggtattttgtacgtatgggatgcggagtcgaatttggaaggagtccaaatttggtacgattggttatgtaaagtttctttcttgtatcctgaggtgtttaggactcttagtatgagtttcgttcatggctttaggctacctatctcgggtataaatagaggtggagcgtgaggcttcccggtatcgcttttgagagaaattgagttgagttttgagtttcgagtttagtcaaaatttttgtaaggagtgctgttggtgcactttgtaaacacagagagaatcaataaagtcgttatccactttaagagttcttcgatttgtgtttcaccgggttttggcggtctaaccagcgatataccggcggtcagactggcggcaagcggcaatcagaccggcggcatacgggcggtctgactggcggcggcgacaggcgcggcaggcatctcggtggttcgaccgatcgatctacatcagtcagaccggcgaaatccacttggtcagaccggcagattaatctcggtcagaccgcgatccgtcgaattcgagggtaacttttatttccgctaaaagttttcggtttttgggtataccaaccattcaccccttctctggttggcttagttattgtgattcgatcctacaccaagaagatgtaaatccagtacgaacccaacaatagatacaaaggaaaaatctgtacagcaaaacttctgactttttggaagatacaaaggaaaatataaactcagtacaacctcaataattgatcatatgttagctcttgaaaagtacaagtacaaggaaaatcagaggaataaaaaccctcttggaattcagaagttatactcatatatcctgtaaaatcaaagtgttttttgattcttattctgtaataaacaattggcatctatgattattggttttgatatttggagattattggtgaagtggttttggagatgattggttttgcaggtgaataggaactgctgctggagttttgattcggtcagaccgggcaagggttgccggtcagaccgtgttaacgaccaaatttggtaatccaaggattggagatgaagaagaaattgagatggagttcaagatggagatcgtcccggaaacagagtaaagatcggctggaatccgaatcggctgcgaccgggatcggcagagttcgagttggacagggttagccgatcgagccgaatctgacaatatgacaaggcatatgttgtcgggttaggttgatgtacttcatgatgattgccacgcatggatagagtcctgagaaggcaattgtatctattaattaggatattttatgtaatttccatagagatatgtttgggcaaaagtctgccgcaaagacttatggtatcttagagtttgttagagataagagtcgtgtccgatatggacataatttataatctcgggtataaatagactccgagccccatgtaatcaaactaacacatgctcaatacaatcttggcgcatcgccacctttttactttcattttgtttcgacgagttcttgctttcgggttgagctgcatcggtttcgatcttcaacaagaggtaaaacttgttatggctgcttgcgttctcgggattagtgcttccatctttatgatactctaatcttgtttatgtaattcgtcgagttatcatatatcttatataatctttggcaatatcgctatctaacctttaatcggctaacatctgttgctagaaggcagccgattaggttatatatcgacgttgatttagattatataggatatccaccactctatgaaacatccaacggcttgattgtctagatattgtccttttcatatttatagctgcatcagttgagtttgatcttatgagtcgtgattagaatctcaatctctagcctgtctttggttgccgattagggtagtatcggggtttcagccgatattacctgatttaactacatttatcttatatgcttgattgacatgttaaatcttccctttatgttaagatcttgtcgcatttaagtatattgggcttttgtttggtatattctacttgctttaatatcttaatatagagtagtatcggagtattaacgatacatgctagatctatctgatcggctatgctatgaacatatatagtcttgttgttactatatatttcgatctaagtgatttatattgtctcggcatggtgaccgatctatcccaattacttgatttaagtatatatcgacataaggattacatattgttaatatctacagccaaccgaatagatttagttctttcttacttattcatgattgccgatcgatccacatatgacataggctcaaagataaatgatatgtcatcagcaactagctgatcggctatggtttatggatttaaccacggtttctttgtctttgtttcttgttgattgcaggatcaaatcaactggcacgctcgtacagccagaggcaagttttggacctgcactggagttaagcagatctcacaggcctcgtgtttttacatcaatagaccggcgctatgcgagcagtcagaccggccagccgtggtctgaccggccgattttgtgtcggtttcggtttcgggttgtttgattggatatccgtgattaatatgtgtttatggcttctagatggatactatatgtatgtaatactgttgtttgctaacaatgagtcaagttggagatagcttggtcttggaatatggtttctttatttgattcatgtgtagatgtcttgacgactcacgagagtattgctagtgatggatcgggagtcgacttggagataaggcaatgttcggaggtcagatatcatgcgggatacttaggctaatcttctccgtacgtgtggaatttttaatcttcttccttcttgagcattggcctgtagcatttggtagttgaaaacacaatctgaaaacaagtgaccatgattttccttttttgttgagtgacttgagcattggcctgtcgcatttggtttgagtgattttcgctgatgtggtttctgatctcatagatgggattgcattttgggggaggaggaacaggggcaatgaggaatccgacgacgtctcctccaacaatgaggatcatgaatccaaagctacggtgaggaacacctgcaaactaatgggatctttcagtttatgagtcatttagttgcaagcaatgactttggtggttaggaatgaggacatatggcaacgtgtttgcttcagagtaaataacttttgcttcctcaccggcaaacaactctggtatttgttcacgttatctccgtttccattgttttgtattgctctgtgggctcttgggggctggggcatggcctctggagtggttgcacggactatggtaattagaaaggcatttatagatataagatcgtttatttctacgcaacattccaacttaagaagtaagtactatggttgtgtcagtttgacttggccagctggaaggaaatagtcatattttgtaagagtgatacaaatgttattgtggcaattttttttggctccgaatgttttctcattatagattgtagaaactttgtttataacaaaatatgcctgctttctgttcgatgaaataactaactgtgcttggcaagcttataacctatgtttgtgtatgggtttaatttgtcctagagcagagctgctggatcgtgcagttcaccctggtaaatatgaaactttatttgcagatgtatttactctatgaacattgttaaagatttatctcaattatatataacaagctgctttcaattttatcatgagttacaaggttaacgtgctgggatattttttttcaaactacaggtcagcatgtctcagcagatgcaaagacaatggaatatatttatttggtcagtgttaagttcccttcacattcattatgcataagttaaaggttttgatagagtttttgtttgtttgtcaaatcctgttcactgagcaagaagaatagtagcgtttattcagtgccatgcaccaaaatgtagatttagctctattagttatttggctgttcttttgacctttcatcacgctttagttctcccatggctttgtagcatagttattaaaactggaccggaccggcgttcggaccggaaaaaaccggaacctctgccgggggaccgacggtcggaccagaaaaaaccggaacctccaccggtttggttcagttaaaagaccggatatgcaatcaagcccgtataaaccggttagaccggccggttttcatgaaaaaccgctatagaaccggagaaaaaaccatggttgaaccggcctctgcctgctatgtgcgcgggagtaggtgagcagtggggggaaaatgatggaaaaataggctttgggggtattcgaacacaggacctcgcgggagaaaggaagtgcagctaccatgtgttagaatgaaatgggtaatatatttaataactattgaaccgggttagaccactggttcaaccgattgaaccactgaaccatcgaaccaatagcctcactggttcaattactggtccggtctcaataactatgttttgtagcattaacattttgaaactacctatattttagtccaattcactatatcatggggcagcgttgaggaaaacaacagcaggtacattgatttctgcccatgctccccgactgcttcataaaatgattcaatttactgctacttactcattggtacttgtaatactgcaatgaaagaccaagaatcctgatcgtttttattttctgatacagtttaaatgatttctactaaattccatgtgttccttttgatactggattgacactatttcttttaactcagatccatggaaaggcagctagaaggtctatgacccttgtgtggcctatgagcacctttccgtggcttttttttaatattagaattgtacaaaccaaaatgaatgttctttttatctatactaattcgagtgtaccatttagtcaaaatgttatcactatagtactctctggttgccgttgtattcatcatattgtagtatcgaaattcttagtggtctcgaggggcataatatttgtggaatgtgaactcttcacaagacaatggaaacagtatttgttcatcccagttcgcactctggtaggtgttcacactaactcgatcaaacgaatgtattagtactacaacaaattagcttttcaatctctggatgttgctagggctgtagcctagacaggttcaaatataactagggctgtattttaaattatgtataaaaagatcagattgtatgaagatagccaccgtgctattattaaagatgtcaattcaaatataatttctctggaatttttactatgctgaatgaattatttggaattagatccagagtcttggagcaagaagcacaaggttttcttctccagcagtgcactccatcttatattggcactctaggaatacactgtgctgttttttttatagacctatacaaattgtcatcctaccatggtctatgaaactctatttttatctgtataatttgtatggagtgcactgcatagaaaatatctcatttattgttctattttcatatatatatatatatgtatatatattgcgaaaacgtgccttgcacgtgcacgataactagtatcctgtaaaataaaagtgttttttgattcttattctgtgatgaacaattgacatctatgattattggttttgatatttggagattattggtgaagtggttttggagttgattgattttgcaggtgaataggaactgatgctggagttttggtccggtcagaccgggtaagggttgccggtcaaaccggcgctatgcgagcggtcagaccggccagcccgcggtctaaccggccgattctgtgtcggtttcggtttcgggttgtttgattggatatctgtgattaatatgtgtttatggcttctagatggatactatacgtatgtaatattgttgtttgctaacaatgagtcaagttggagatagcttggtctcgaaatatggtttctttgtttgattcatgtgtaggtgtcttgatgcctcgcgatagtattgccggtgatggatcgggagtcgacttggaggaaatttgatgtccggacgatcagatatcatgcgggatacttaggctaatctactccgtacgtgtggaaattttaatcttcttccttcttgagcattggcctgtagcatttggtagttgaaaacacgatctgaaaataaatgaccatgattttccttttttgttgagtgacttgagcattggcctgtagcatttggtttgagtgattttgacttatgtggtttctgatctcatagatgggattgcattttgggggaggaggaacagcggcaatgaggaatccgacgacgtctcctccaacaatgaggaccattcaccctcccctctggttggcttagttcttgctatttgattctacaagtggtatcagagccttgttttcttctttggattttaaccgatatagagctttagccatagctaacaagtttactactacgccccatgttttcgatggttcggattttgcttattgatgtgataagatgcaatcatacattatggctgaggattatgatgtttggaaaaaagttgcacagccatatgtgattcctgaacagattgacactattgctttgaaaacttattttaataacaattgcaaagctcgcaatattcttttgagtgaaattttttgtacggatttttatcgtgtttcgcatcttaaaactgccaatgaaatttggagtgctttgaaaaactttcgtcaaggaactaccaacattaaagaacttcgtcgagatcttttcaaaaaggagtacataaaatgtgagatgaaacctggagaagctttggatgattatcttggtagatttaataagattttgagtgatctttgatatgttgattttgcttaggatattaactatacacaatctgaggattttcgccactttttgaatggtcttgatatgtctatttgggagataaaagtcacatctattcaagagtctgttgatatgtctactttgactttggattcgctttacacaaactcaaaacacatgagatgaatattctttctcataaagttgattctaagtctagcgctttggtttcttcatcgacttctttggatgtaggtgcttcttcatcaaattctattgtccttgctttgattcatgccatgtccgatgagcaactcgaacagttcgaggacgaggacttggctttggctgctaataagatttctcaagctatgaacaatgttaggtacaggaaaaaatatggtccagctcattgctttgaatgtggtggtcttgatcacattcattcgcattgtcctaagcttgggagaggcaagaaggaagacaatggtgaagagaagaccaaggacaacaaacccaagagcatgtttgttggtatttcttacgaccacagataaatccgcaagcgcacggaatactgctgtagcgcttaaccttcgggtgaccccaaaaggacatcgaactcaaggaacgtgtgtaatctacctaaggttaagactatccaaggacaacaactgatggtaggcaggctaggctagagaggactttctatgtgttttaattatctaagctaagttaacggtaatttcctctctgttgcttcaggcaccgacccctgctggtctgctagcgtggttccggctataggtctatgatatatccgaacgtggaggattactaggacgggattcagggctgtcaccacctgccgtctacctctgacaaatccgtgggatacacaacaaacaaaggtaatctctaacctagacaccacatctaagttattaattactactctaatacttgtacaggaacttccttctctatccggagtcctagtactagagcacttagtatgaatactaaacaatgaacccgcaaagatagaaatatatcttactcagactaagtaattaaataacataagaaaggagcagagtgtaccgacagctctgctactcctccagaattcctgctaggaagctacactcatcgaggtagaagtcggatgagcgccaaactttcgggcactcctccagagcttcctctcactctctaccttattctaatgtacacaagatacaatagagcctcttgtaattcagctcaaagttgtgtgttggaaatgagagtgagctcgtccttttataggcaggtatgacggttacagcctttgtgaaataaccaaaccacctcggaaccgccatcaggaagtaatcagggccgtccacgtcgaatctcgcgatcaatgacctcaaaagtggttcggctgaacccgggagggctccattcggcccgtttttcctcgtggacactaattttgaggccctcagcccattggcatgatggttgggcccatttggagttgtctaattgacttatggggcctccaatccatgtaaatgtatcctgaatgcgtggaggtgcagtttgtcgcttgacggatgtgttttcttctcaaaatacatgcatacatgtatttcaccaacactagtggaaatgattagtaataatccgtaccactaagttggatactatgttttagttcataatatgcaggtattgacggtcaaatattatgattttaggaccatcgacagtgttcaaagggaagaagactaaggagaatctcaagaagatgtttgatcaagtctatgccgcttttgagccattaagtgatgtagatggtgagagtgaagatgaagagaagggaaagaacatctccggtgtttgctttatggcacgtggtgaatcggattcagagtgtgaagacaatgaggtgcgttcttttgatgaagttattcttatttgaagtgcaaaaaataagaagtgtgagaagatgtatagaaaacaggaatttattattgaatctcttaattctgaaatttctagactaaaatatcttattcctaatgatgatgagtgcaaaaattatgagcttttaatgcatgaaatttcaaaaattagagatgtcattgttacacatgatttcaaaaatagatctgctcttgctcttggatttgtcttgcatacacgcactttgaatgagttgtttttgattaaaaagttgttgaaaaaatatcaaattgcttttcatgctagtttgatgtttaacatgatttgtgccaaaaaagttaaaataagaacatggtgttttggattgctcaacatgcacactaaacaagatgaagctaaaagatgcattaggtcatgttaagtacatggaggatattgtgaagacccatgaagtgctttcttgccccaaatgtcgtaaaagcaaaggtgtcatgggtgattgtgaaaattatgttattttgcaaaggtttcttatttgaaaagttctttgaaaagattttttttgatggtaagaaacaacttaacatgattttggatcaatctaaagtgactagctacaataggggtgttggttttgatgttcatgattgtttcaccaaaaatcaaccaaatgttttgagtgtgactgaacatggtgaaattttgacaaaatcaagtgctaagaaaacaatttttaagtctgctggaatgatgccctctctttctacaacactaaaagaaacaaaaacaaatctttcaaaaccatctacttctagagaaaagtatacttgttctttttgtggtaaagatggacatcttgttggtttttgtttcagattagctcgtaaacagaaaaaggagagagaaattgcttttgcaaattcaaagtggcaaaaatctagttttctctcaaggaatccggtcaaatcgtagttggtcccgcggtcaaaccggtggctgtgcttcggtcagaccgggcatcggtcagaccggcccccggtcaaaccggctactgtactttggacagaccgaccttggagagatttttctaaaaattctcaaactattctcaaactaccggtcgtgtgtctcaatactggattcctaaatttttgttatctaaccccagtactgaggcttcgacatcttcttgtgtgtatgctttggtggcgacgaaggagaacgtgtggatcgtggattccggttgttcgcggaacatggccggtgaatcgattatctttggtgatgcttttactagtgctgttcttgctacaggtttggttaaggtaaatgataagtttgaattgaaaaatgtagctttggttgaggacttaaagtataatttgctttcagtttcataaattgttgatgaaaattttgaggttcactttaagaaaactggaagtaaagtatttgattcttgtggagactctgtgttgaat

SEQ ID NO: 80301 - DNA, 19824 bp, Oryza sativa
ggaatcggccggcgaagtggggcgccgacgtggggtggtggaggggttaaccggcgccgattttcgcggggagagtgggggaaatggtggagggcgtggaggggatcgtgcccacgtcgttggatgcgagctcgggtgcgggagggcgccggattttgcggcgacgtggacggctatggcggttggggtcggccggcgagaggtaggaggaggagctgacgggtgggaccgccggtcccacctgtcggcgaagggagagaaggagggacgcaaaacagacttttgcgagcgggccaagtgagaggggagccgacccgagagagggagaaggcgcgcgggccgcgggagaggaaagaagacttgggccgaaaatggcccaaagagaggaagggggaaattttatttgttttctttttattttaattgatgcaatgatctttgtgttattaaaattatttcttgagctccgaaaattcacggaaaattccggagagtattttagggcacaaagaatattgcaaaatattcccggccaatgatttttaagggaaaattttaattctcccattatttcacttgattaaattgatttaacttttatttaatttctagaaaatgcattatttaatgatttttaaacccgaacgaaaatcggggcgttacaaatctaccccccttacaggaatctcgtcccgagattctgggatggctagaaagaaagccggtgctggtgggctgtctgtctgatctgcaccttgaactgccacattctgcttcgaactgattgattgactggttgatcaaacctgcacgattgaactggctggaatcaacctttctgctcctttgctttgccaaaactggaccgactcgttctgcttgaactgacctaggccagaactgcggatactcctgaaacttacttatcttggactgaactgttgaggttggcaattttggtaacctgagaattcaccacgctggctataagaggatgaaaatggaatctggcatttgtaaatcatttaccctatgtccgcttcgactggtcccaattcaaatgacaagtaattccaggaaaacctgcttgacctgtctttcgtctgaactgcaaccgtccctgatgctgcttctcaaagctgagctattgacctggcctcaccggtgtacctcagaattcaatcagataacttgagatcggtgtaactctgctgacaccctgtaactggctacttcaagtactacccggattgttgcactgggttgaaccttcaactaaaacagtgatgaggtgagccaaaactcgtctccgagacctatcccccttacagggagtagtcttactttcgcctgactgggaacaattggactattgtccttgaaaaaaaaaataaccaacacttctctgacttacaaagaccctcactttgaaaactgaaacttcgtcgattcatcaaaatagagcaatgacgactcactttcatcccagcaagatttggaacttaaccctcagttgctgataggaaattccacataaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgagtagagctgttgtcttgatgacgctaacgccttgccgttgaacaaccttgcaagaactgaccttgtaaaccataaccactatagatagcacttgttgcctcagggattggtggtgaccttgctatgctggtctactgaagacttggtggcgtactgtcggaggttgcaggtgcttgctcttggaaaacaaactgactttcgctctgatcctgattccggcttgcatctgagcttgtacttgttgttggagacattgtcgttgcatctgctgctttggactctacggttgcggtatcaacatctgacacatccatcattagatcttggctagccaggatctgaccagagcgaggtgctcctactcagctggtagcttgttgtcttgaactgatccactgactctgactgcaacacactactgctagagttgcttccgctacattcgaccttgcatcgagctttgcatctcctgcatcaatacacccatctactgatcctggataccaaatgttgatcacgagcaggggttcttctggcatcgggagtacctggtagctttcgactgatccattgttctgtgactttcatacaccgttgttgttgctcttctctttgatactgaccatctgctgccagaacggaagagaggtggaagagaggggttgctaaagataaggtactaaaccacttgcctattgatctgttgtgagtggattttatgattcaagttgtttaagcaaacaacctagtatggtcgcatccccaccaatgacgcaaaccatacccctacacacaagcaaacaacacacgatctagaagctaacgaaactactcttcgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgtactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagatccttcgcataaccctcccctaaccatccacaccacgctaaggtttcacccccacccctcaaaaggcagtgggcagtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtgacaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacatgagctagtcgatttatcacccaaggttgacaaaggatagatatcaagtaaacatggcacaagcgagcagataggtaaaccctgatcccatgtaattagcaaaacatgcatatttatttgcaaacggtaaaacatttataaattaggatcaacatgctcaagggggaatgtgcgacttgccttgcttcttcactttgatcttccgaactcttttccttgcgaccgcggacctccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattattcacgaattattgcgcaattattatttattttctcaaaggaaatgacaagtgctgacgtcaacaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgattggacggccacgaggcagcgtggctggggcacgggcacggcatgaagccggctcggccgagacatgacgcggcggcggcaagggggaggcggcaagggggaggcggcaaccggctgcagcagccggcgacgtggaacggcggcgggcggccggaggacagcggcgcgcacggggacggcgacgcaccccaagaggcggcggtcggcaagaaaggggacgggaaaaaaggaagggaggagagatcctcaccggaagcggcggccgacgtggaggaagaggacggcgacgacgattgcccaatggcggcttgcgaggacggagggcggacggggtcgcccttgaccttcaggaggagaagagggagttagggaggggaggaccgatgcggggtgactggaaacgaagaccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggaggcggtgaaaggggcggcggcctcgggtgtgcggtgggagtggtgctcgaggggtggagagggggaaataagaggcggccggacttccccttgcggtggcgaagctggcggtggcggtggctcggcgcggcgacggctgtggcggcgggaaacggcgaccggagctcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggagggcgtggaggggatcgtgcccacgtcgttggatgcgagctcgggtgcgggagggcgccggattttgcggcgacgtggacggctatggcggttggggtcggccggcgagaggtaggaggaggagctgctgtcggcgaagggagagaaggagggacgcaaaacagacttttgcgagcgggccaagtgagaggggagccggcccgagagagggagaaggcgcgcgggccgcgggagaggaaagaagacttgggccgaaaatggcccaaagagaggaagggggaaattttatttgttttctttttattttaattgatgcaatgatctttgtgttattaaaattatttcttgagctccgaaaattcacggaaaattccggagagtattttagggcacaaagaatattgcaaaatattcccggccaatgatttttaagggaaaattttaattctcccattatttcacttgattaaattaatttaacttttatttaatttctagaaaatgcattatttaatgatttttaaacccgaacgaaaatcggggcgttacacaaactagcagatctacgttgttaccgatatctacaatacgcacttctaaattagtacaactaaaaccataaaaatataatgcatttattcaaacaaattttttaaaaatacacactatttaactcaatagtcacatataggatctgcgaatattacctgaaatcggcgtctgaatccggcagggcttcgccccttcttctcttctcctaccctctcttcttttttttcactggagttgagaggtgagaaatgagggctggggctgggcggcaggccttttataggtagcgaggcctgccgcccggccagtgggcggcaaggggccgcctgcaaaatggctggccccctgcggctcttttgcattcggaccccttgccgccccaccaaagggcggcaagggttttcatgcaaaatacccaccctccgtcacagcccgttcctcccccgtttgccacgtcagcttgctgcccaccattggggcggcagggtctatttttgcaaattttctcgccaatagattatttatgtaaatattaaaaaaaaatctaaaaacgaaaaaaattcccctacttacctcccaaacggctgcctaggtgaatatgtttcctctagattctagtcccatcccatcgttttagcgtggttctaattcgtgatatttcctacagtttcatatatgcacttaccgtataggctagttctttcttctctcataaagccgtacatattgaatttgattattatcacaaggtttatatagaacgcgatgatattgttgagtccgtggtatagtttgaacactgagatcaacacgaaaatccttgatattttggaacgaattttgtttatattttaggacagatgggttatttgggaagtgctatacccagaaaccatcatgcagtggcggagccaacgtgggggtgggaggggggggggctcgagcccccactaccccgctggactcctagaagttgtgagagaggagaagggggaaaagagggagaggaagaagaaggggggggagggggctggaggaggaagaagaaggctgagcccccctctcctccaaacctagctcggccactgccatcatgcaagtagcgctttttcacatgattgtaattaaatatgttcctgcaaagtactaatacatcgtcaaaaagttgtaaatacttgccaggattacaaagacgtcattactagtaaatacatctccataatgttgtaaatgcatcctcgtgtaactttaatcggcgaggaagcgatagcacccaagagcttactatatatctacctatcattctgtattgtttatttaatatatatttgtgtcttcttttcttcggagttcaattcatatgccaaaaaaaatgctaaattgctaacttttttcattataaatttcttctattcatgcaataatttccctatatgtaattatttgtgtagatattgatgaatgcaaagaaccgaagaaatacccttgttatggaaactgcaaaaatataccagggcatttcgactgtacatgccctaagggtacccgaggaaatgcctttgttgaaggagcatgccaaaaaatcatcttaacatccggagtacgaatagcaattggtacgcacctataccaactctatctcatcacgtacatatactttcaatatagttgaggcttccaacgtcttgaattccattgcaatataactagtttttgtttgacttctgatgtgtttcgtgtggaaatgtaaacaaaactcttgatctacttgatttggttatggcttacataaacgtaaaacaatactgatgttaacatacttgcttagaccataaattgattacaacttccaatttgttcgttcaggagttgttgcgggtgcattggttggcctctttggtttccttggatggggggtgatcaagtacaaacagagaataaaaaaacaagctctattaagacaggctgatgagttttttcaacaacacggaggtcagctccttctagaaatgatgaaggtagagggcaatgcggggttcaccctctatgagagagagcggatcaagattgcaacaaataacttcaacaaggcacacattattggggaaggaggacagggaactgtttacagagcagtgatagatggcactaccatggcaataaagaggtgcaaggagattaatgagagcaaaaaaatggactttgtgcaggaattggtcatcctttgtcgcgtcaaccataccaacatcgtcaggctgttgggttgttgccttcagtttgaggcacctatgcttgtctatgagtttgtgcaaaacaaaacactacaagagctgttggatctccagaggagcaagaggtttcatgtcacactaggaacacgtctaaggatcgctgcagaatccgcagatgcatttgcacatctctactcgctgccacgtccaatactccacggcgatgtgaagccagccaacattcttctcgcagagggattggttgcgaaggtgtccgactttggttgttcaacaatcgatgagaaaacccaagttgtgccaaaaggtacaccaggctatattgatccggactatctactcgagtaccagctcacagccagcaacgatgtatatagctttggagtcattcttctcgagcttctcactagtaggaggccattttcaaaagaaaggaagagcttaacatcaatgtttcaggaagctatggcaaatggcacacttgtcgagctccttgatagcgacatagttgatgaagctagcatgcgagtgatccaacaagccgcggttctagctaatcaatgcttggttgttccaggtacaaccaggtccacaatgatgctagtggccacagagctctgacggctagcattagcagatgaagtgcagcagtacccacaaccgccattggtgcttgaggacctaagctttacggggatagggagaacatcgatgtctacatggtacggtgggagcaaaacaaatggggtttatggcctctcgaagaaagctgtgccgagcatagagtttgcgagatgattgatagacatcatttcttatgttgtcgtttgtaggtgtgtgagagattgagttttcatccagagtggaggagctggtcagttgtgtatgaccatgcctatgcattgtgaggaataagagtacaagaacgtacatgtaaacccgtgaagcataattgtattgtgagactgattagcgaatcctaagaaaataactagttgtgggagttgtataggtgaaacaattatatatcagttggaaccatactacttcaataatctacttaattatttttaaagaaaactctcaatttgctctcgaaagtgattgattccctcatttgctcacgtaaaattggttctccctgatctaatgctcctcattcccagcttttatcctttatttgacatttcggttagttttatatatcaacctagtaaaatgatagttttctaaacctagtggcatgatagttttgcccttaacttttcctgtgcgtggttagcaattttcgtaaacctacatgttattttagcaaagaagtgttatggaaaattatttaaatttagtatattgcatgaaattaattgccatggttgcttgttaatttgtaagctgtaccatacttttaattttagaacttccactaccggggaaaggctcttccggtttgtaactctttttactcctgagtttcaaaccaggatgcccaatccgggactaaagatgccggttaaaataaccgggagttaaaatgaatccttaccaactgggactaaagatgtagccaggcggcaggtttcttttttcctttttttattgtttttaacatcgaataatgatttcactccatccacaaatcaaccccaaatcaatcaacacagatcacagcacaaaagatatcaccaaatcctcaaatcaatcatcaccaaatacatcacaaagtgtaaaaaaattacataacaagttctacaaaaaatcatcacaaatacatcacatattcacatcacacaaatacatctcggatccaatcacaaattcttaaaaaacagaaaaaaaatcaaatacatcctcgatccgcgccggccggctcccctccgacagaggcgcaaccgccgcctgccgcgccggccgcctccgcgccagcgcctccgggccggccgccgcccctccgcgaggcctctccgccggccgctcctcgatctgctgccggagagagaagtagaagttgtagagaagggaaggataaggataacacatagagggaggtgaggagaaggagaggataaggataaggataaggataagagatagaagaagatgaggagttgggaggataagtcatagggattatatcctgcatacggaattttagtcccggttggtaataccatacaggactaaagatcgaaataatctttactcccggttggtattaccaaccggtactaaagtggtgatctttagtcctagtttgtgccaccaaccgggactaaaaatcctcggtcccctgacaagcccttggcagagaatgaaccgggactaaaaatcttctttagttccagttggtgttaattaccaaccgcacaccaaccaggactaaagatcaagatttttttaaccgggactaaaaatgattttttgtcccgatttttatagaaccaggactattgtagtttttggtcgaccctgcaaagatcagttttatagtaaaattaaagatcaattttacagttgatttatttaatttttttatctttcagtctttgcttccaaaccgtatgaacataagtacaaattagaagtctccccctttactacggagaactaaacagttggtaagtactccatcctcttcatattataataagtcgtttgactttttacctagtcaaacttcttcaaatttgaccaaatttatataaaaatatactaacattttcaatacacaagagcaaaattaccatttcacctatcgactagatgtatgttagcgaaggactaatgagaagagcaaaacaaatgataaaattcgataatgaatggtataagagggagggccgatttcacgtggaaaaatgaatgtatcaattaatggataaataaatatttttctcttatttttgaggctagaaaagaggtcatcaccagttaacacactactctgtcaatttgaatgggctttctcacctttacgactaacaagtggaggtggttgcatgatactctcatagctcgtttttctgatataaacaatgaaaatggtcagaagcaatataacattctttccatgggaataatcctcgggcggtcggtaactttttatattttaactgtccagtggtgatattgtaacataacacaaaaagatagttgaaaattaaagtttatgtatgactatagaactttatagtagtatcttctagatcagtaaaagggtccctatgctatagattggtgtagaatctcttctcctggtttcatccctttcttccatcgacgtgattggctttcgatgtgtttggcttggacgacagacttggaggtgccccgcctctgtttggatgtcgagaagaaaagtccctggtgacgacttgactcgtgaaggttgtcagggttggccgcggatcgcgccgatgctggaatagtcgctgcagatcgagttgaagcgacatcaccgagcgcacggtgcgacaacagcgacgacgcgacgcgatccgaagacatcactgcccgcggtaactgcctcccagaactggcctttcgcggcccactcgcaattcacaaagcggccctgtgggctatgcatataggaaaaggtccaatttgactccatcaaaatatagctcaaatctaatttatatctctcaattgtaaaactgaatatatcgactcctccaacactcaataccgtcgaaaacaacctcctcaactgttttgattgtggtttttgctaacgtgacaaccatgtggaggcctagtcatcatgatattaacagtagagtgaggcccacgtgtgattcctttccaatctccttccttctcttcccctctcccccttcctttgttttcaggcttcacgacagctagtggctacagggcggaggaggacctcgagggagctgggtggcagcgagttactccccaccttgcaacgagctcgagctccacatccatctccatcgaggaggataaggagtgaggagccaaggaggaggtgcttggggcgaccgtgcgtgagtgggagaagagctccgtcatcggggagaaaggcgctcaaggaggtgttgacacgccgtccctaagctggcccccatcacccctatctcctcttggcgccaactaggccgaggccatcatagatcccgcctgcgactgtcgcctagactacatgttcaccctgcacgtggactcggtggacgacctcccctgccgcgcttgataactccctgatctctgtccacttccaccgtcaaagaagacccggtcggatgggcaccatcccaattggaggggagtgctcgccgccaccgccgcttctcctcgccatttcgcctcctccgtcgctatggagaggagggactagtctctttcctccagggagggtcaactggccagggggaagaggaggagagagatacgaggaagaagggagggagagaaagggaggagaagaaagagaagagtcacgacaggtggacctcacatgctaattaaccaagttagattatgtcaacgtgcctcatcaacgaaaacatttaaaggagtcaactaaatcggttttaatagtatagcgtttcatactctagtattacggcagagggtatgaatcaaattgaagacgcattttagggacttaaagtggacttattccatatatacacagtctacaagcaatgaccgacgtatctgatgggctggtgaaaaagatgctccccgtggcccaaagcagtgaatgctgccgtcttcccgttgtcaaaagactctccgatacttcttctttttctttttttttcgaacttcaactctaacacagttaggcccatttggaatggaatgacagaattttctccgatacctatcaataaggcggtcacacacatcctatgacttggtatttcacaagtttctaaagaagaagtatgcttcccgcgttctatcagtcaacccaccctgtaccacctcatttacccgtcctataagtacatgtcaatcaattaagagttctctttgttcactactagtaaaaaacaattttcctgcaaaaggagctctttagatcgtagaaagagcgtttccgcgtgtgtctgtaaaaatcggcatcccattttcacgtgtagacctttaagaggcctgcacgtgaaaatcgattttcgcagacgtgcctcttaacggttcgcacgcaaaaataagcctattttcgcatgaggacccttaagaggctctcttaaaggcccgcctactagtctatcattcccttcttttcgctcctcaacactttaaaatttttcatccttatcctctcactcctctcactctctcacctctccctcactctcttaatctgtctcctctcttattctcctctcgcggtctagtgtgtgcggcgagtgcggccagcggagggcacagacggcggtgggcgcggacggcggcatcgagcggcttggcggtgggcgcggctggtggcaccgatcggctcggtgacgggcggatccgcctcggcaagcctcctgacggtggcgggcggcgtggtcgacggcgaaggcggtggctccctcgcgaagctccggcggcgatgacaatgaggaggcggccggtagcggcgctgatggccccacgcatacgtgcgctggctggatccacgctgccctcgccgccgacgacgaggaggcgatggcagccgggagcggtgccgccggcttcgcgcgcacgcgcgccgccgccaacggattctccggtttccattttttgaatttttattttattttttggaattttatttttctatgcaggcgacattacccgaccgcacgcgaaaatccgattatcccttgcgattgggccgtccacatgcgaaatatatattttcacagacatgggacctccacatggaaaaaaccctttttgaccgcacggaaaaatccttttttattagtggttggagctaattcttaaacatgatattatggttaagcatgatcacctaattttttatacggaattaatggaagagtaatggccggtgcctgatgaatccataggaccgcttaaactcgtgtgtggcgttgtagatggtgcagtagtggtataccatacatggtgttggtaattttttgacaagttgacaagcacgatcgtagcatcttaagtcttgtggtgatcctagagtcgccaaccacctcgatctagcaaaaagctaaacctagatgggttttgataactaaaccggctagcggagccgatttctagataactacccgtctcgtgggcaaacggaaggttttcaggacaaacctacaaagagatgtcgcactctcgcagcagcggcggacggtttacagcgcaaaccgacaaagatggacaaactaagagaaaactaaaagcaatatgaaaagaacgattcgattgattgatagtagattgattttacaatgaaccggccttgtcccttatacaggggttggtcttgccctctacaggccctcctccacgtccaactcggggtagaaaccaaaggaaacccaaaacatgccttcccgagcaaggaaacctcgagacccgacgaaacagggtcggactcggaccagccggtgtgcggccggtcacaccgccggtctgaccggccctcaaccggcggtctgaccgcccaacacaaggcctaccccagaggaaaccggtagacttccaaattttggcaatatttcctattttaatctaggtgccaaatttaggtgtaaacatatgatactccctccgtttcacaatgtaagtcattctagtatttcctgcattcgtattaatgttaatgaatctagacatatatatctatctagattcatttgcatcaatattaatgtggaaaatgttagaatgacttccattgtgaaacggaggaattagtactacacatggtgtagtagtaaactcccagacttctcgagtagttatagccaaacgaggttctcagaaatctgaatgctattgtgttcttacacaatattgtcactccatttcgcagtggacataaagaaaaaaccctgaaaactagtgatcgaaggccaaaagaaaccaaaatctgcacactgttttgtccctttggacacaatttacaaacgcaaccattacaggcatctcaacaagaactgcatctctgaccatcaaggccccaactatctgcatatgattgaaatcaaacaaacaaaaccagcactccatgggggaaaaaatcaatcaacctatccctctctctatacaggaaacaacaaatcaatcatcatccagttaaaaacccaattccaccatcttgtacaagcaaacacaatattgatcaggtcatggctctttcagaacctcaataaccaaatccctagccctgtggaagcacttggcagagaatctctcgtacaccatctcgtacatctgcaggttcaaatacgcaaacctcatgtatctgtcaatgcattcctcatacttctggtacaatgcagggatggtcagaacagcaacaatacctgtcagcatgaggcaaagaaacagggcgtgcttacgatcaatcattccaatgccaaaccattgtacaagtggaactaaatgttggaaaattataccggtaataaaatgatgggagctgcttacttgtgtaacataaagtggtgaaatcagtcaggctgccaatgatagaaatgatccacaggctaaggaagacttgataaaatagcaccgagtctttcccgagtgcgatgtcatggaagacagagaagaccgtgttcatgccagaatgcagcagggctgccacttcattcacaacctgctgcgaaatgcgcatctctggaataggtggctctggcctgcaacctcatttgtttgcacaacacaaccagcatcgtttaaaatatttgccaaatgtccacagcgatgagcaattcactcatctgattgaagtaaaaaacagtaagctgtttgcaagacaaagcttatcattgtctacccttagcatttcagttaaaatagtttacagcacgtacctaatctgacatcagtatcacctggctggttgttagattgtcaattagcataaatttggtcaaagttcaaagcatccacctaatcctctaactgaagtaataatgattaaattgatggaggaatgtcaaaacaacagtgaaagctgtgatgatgataagaattaagtgcctggattgttccttccattggttaactatcaactgaaatctgtatcccaaaatggatagtagagttcaacacaaattccgttcctgtgcgaaatcgatggctaagagtactatgttgatgtaatgagatggctaggattgaggagctgagatcccaatctcacctgttgaggaggcgggcggccttggcccagaggaagaggacggtgaggaggaggaggaggacgttggaggcgagggagaggaaggtgtagccgccggagccgaagagcagccagccggagacggtcgccgccagcaggcaggcgctcacgtcgccccgccgccacatcaccacgtccccaactgcaaccatcgaatcgatttaatcctcgatcaaacaaagctggaagcatacctacccatcatcggatcgagatgcctaccaaattctccgatcagagatgagacgccgccgccgccgccggggcagcaagaatcgtcacgacgatccatggacgacgaatcgaatcaatccgaacaagcagcgaatcagcaaccagctggctagaccgcggatcgaaggaggaaggggcaagtcaatgccttttcctacaaggagaagaatcggggatttcggaaactttccccaaatgagatttctcggtgcgctagctggactccactcaaccaccgatcaacagctcaactccctcccaggctcccagctcgatgtcgcagctcaccctgacaggtgggcccttggccgttgtacagcgtggaaagttgccacgtcggacgctcgtggccacgtcagcctcgcgtgcatggcgcaacggtaaggccattcacagtgcgtatacctgtactagttgagcactttctacgagttctcacgttaattatataccccatctgcccacgtcgccagcggacaaaggcgcacacattaattatataccccatctgcacacacgttaattatatatcccactttctacgagttttcacgttaattatataccccatctgcccacgtcgccagcggacaaaggcgcacacattaattatataccccatctgcacacacgttaattatatatcccactttctacgagttctcacgttaattatataccccatctgcccacgtcgccagcggacaaaggcgcacacattaattatataccccatctgcacacacgttaattatatatcccatctgtccacgtcgccagcggacaaaggcacacagccatggcaacccgtcgtcgtatgtggcggtccagcgtgcgcctcgacacatcatcatcctctccagccgcttgttagagtgcgcagcccggcccactaaccgtgggctacccaggtcacattggggctgctccaccacaggctcaaccggagccacaactttaggttctgggcctacacaaccaaaagactagtctgatgggtgaggaccgcccccaccttttaagtcgtgctcctccatcatcaattaccgatgtgcgactaaacccaacaccgcacgtgctccagtaatctcggacccccggaatagagcttgtggatggttaacgtatatactttctctgttttacaatgtaagtcattctaacattcttacattgttaaacggagcggagggagtacctgctaacttatatacttgcatgcgttcttgcagttcgagtcctgcttgcagaggtacgtgtgggaggtcgacagagctatcgagccccaggtgaacaactcacgaacttgctgtcgacggatatctgcttagcttaatatgtcgtgtcctgcatgcatgcatatgactacattacatacaagaactacaaacccaaatatttcaatccactattaaaataatatttctacaataatctacacgataagaagaaagtttattagtatagttcactgttagctttaagcccatattaaaattgttttcaccttttcttttctctatctttctcccacttacgcatttaatttatttatttatgttgaagcatgtgtgtagttctaggttattcatgagagtgaataccctttatattttttctttttccaatccacgtgagttttacgtttatagctggcttatagcccactactatctttgctctaatccttctcatgcattcatgattgaattcatgaatgaaaatctatagcaaaggtaaggccccagttaaataaccaagattggtttctgatttggttgttcttttgttcacccagaaatcttttgcatgcttgcacctaataaaaagacagatccatataaaatagttgcatctgcagcccatttatacatgtgttctgtactttaacattttcttgatctatgattttgattaaataataaatcattttttttacttttccttatataatatgagtcgtttcacggataagttgaacagcaaaaaaacaccgtaatttactcaatgaaaattgagaattaatcatatttttgaagcagtgaataattttgaaacagtgaacatatatatcgacccataattttttctgcatataaactagcaactaatgattaattttcccatgccctatctctgaataattaagtccataggcaatgtatgtactctacagcctacgtattactggccgttcgattttgatcctaatgttaatattttcatcacatgtaatacctatattaataataaatctgtcccgtacttcgtccaaatacatttcattgaatgacgatatatatataacttatcagccttatcagcctaatccatagttctttttaattttcaaagttggagtataacacaatcgcatgtctatggctaaaattattcaaattaagaaggaaacatggaaaggcaaggtcagagaaattagactaggggatgtggtaatccgaacaacaacctatggtcctatcactagtagagatatgtcataggtgccggtttgcaagtgtctataggtgctggattttcacccggcaccaattagttggcaccagtagcaaaacccggcacctatacaaaaatagaaccagcacctataagttcacacgagccaaaaaaaaaaaaaggggaagagccggctcgaatcgagccgagctcaccaa

SEQ ID NO: 80302 - DNA, 114267 bp, Oryza sativa
cacgtggctatcgtgtacttgttttggaaactaacaaaattgttgagacttgcgaagttacttttgatgaggctagtccaagtactagaccagaaattgcaggtacgttatcactggtttagggggaggatggtcgtatttttgaagacgggagcgacgacgatgacgaggttggctcgtccggtcagaccgggcgccaagccagttagaccgccggcacacctccagtcagactggctcaggacgagcggttagaccggccagggtcattggcatcaggttctgttgacgctgatcgagatggtcctctagaggctacaactttgactagtgagggtacataacgtgaaacaacttcagaagtcgctcctccttagcatattcaacgacgacatccaccggaacaaatcattggtaatctaggtgagcggactacaaggtctaaggtaacgactcatgatatttgtgcaagttctgcatttgttgcttcttttgaactcaaagatgttactcatgcattaactgatgaatcgtggattaacgccatgcatgaagaacttgaaaattttgagagaaaaaaagtttggactttagttgaaccaccttctggacataataaacaagtgggttttaaaaaataaaaaaaatgaggatggtttgattgtgagaaataaagctagacttgttgctaaatgttttacccaggtggagggtttggattttggtgaatcttttgctcctgttgctagaattgaggcaattagacttttgttggcttttgctgctttaaaaggctttaaattgtatcaaatggatgtgaaaagtgcttttctaaatggttttatacaggaggaagtttatgtcaatcaaccaccaggtttcgaaaatcctgattttcccaaccatgtttttaagttgtctaaatctttgtatggcttgaaacaagcacctagataggtttaagaactttttgcttgcgaaaggttttcaaatgggaaaggttgacaaaacactttttgtttttaagcatggtgataatcaactgtttgttcagatttatgtgaatgatatcatctttggttgtccaactcacgctttggttgtggagtttggtgagactatgcgcagggaattggagatgagcatgatgggtgagttatcgtactttttgggattgcaaattaagcaaacacctcaaggtacatttctgtatcaaaccgagaataccgatctctttcacatggtgacatagaagatgcgtcattatattgaagaatgacggtggaaatatcaactcaaagctgacaaggcattgcaccacgtccccctgaagggctgctaaactgtctggattgatgatcttctacgaaattgcgttcatgaaagcacatagctttgttattgttgcctggacattatcaggaaggataccacaaattataacggaaagcaattgtgtcatcaacatgtggtagtcatgagacttttggtttgtgaacttcttttccttcatgcttatcattcactttatattcgaggagtatctagacggtaccttgatgctctacaggcattgaaacatactttccttcttttccttgctcagggtgtagctcgctggactaaagtaatggcttcctttcaccttcggttttggatgaaggccctcgagttgttccatatgtttgagatcattacatgctttgagtgtatctttggactacccatatacatctaagaagcccagcaggttgacgcaaaggttcttagtgaggtgcatcacgtcgattgcgcggagaacgtccaagccttcctaatagggtaattcccagaaaatagagttcttcttccacatcgccacgtgaccatcttcgctttctataggttggctgttaggcccctttctaaatataactttcagatctttcaccatagcgaacacggctttttcgttgcgatgtttaggcttagtacggtggtttgccttctattcgaagtgcttgcctttcttccatacaaggtggtttgcaacaaggaatcaatgatggcccatgtacacaaccttcctgcaatgcttcagttacgtacttttagtttcatccatatagtgagtgcaagccttgtatcccttgtttgaccgtccatataggttactaagtgcaggccaacagttaatggcaacgaacagcaacgctcgtagattacattgctcctgtttatcctcatcccacacagggatgccttctttcctccacagcacttttagatctccaaccaatggttttaggtacacatcaatgtcgttaccaggttgcttcgggccttgaataatgatcggcatcaagatgtgcttccgcttcatgcatagccaaggaggaggttgtagatgcacatggtgacagaccacgtgctatggccgctgctcatctctccaaatggatccattccatccatacttaaactgaaccttacattcggtgcatactctccgaagtctttaaatgctctgtcgatatttcgtcactgcgacccgtcagcggggtgtctcagcatcctgtcttgttgaagttcttctgcgtgccaccacatcattctagcatgcgatttgttcctgaaataaatgtttcagccgtggtattatagggaaataccacatcaccttagcatgaactctcttcttcaaaggttgtccgtcaacatcacctggattatctcgtctaatcttgtattgtagtgctttgcaaaacgggcatgcttctaggtttcgtactcctcaccgcgatagaggatacaatcgttcggacatgcgtatatcttctgtacttctagtcatagagggcagactgctttcttagcttcgtacgttgtttcgtgcaattcattcccctctagaagaatgttctttacgagttacaataactcgccaaatgccttgtcactcacaccatttttggccttccattgcaagaactccaacgtggtactcaactttttgtggccctgttcgcaacctgggtacaacgatgttttgtagcccgctaacatgcgctctagtttctgcacctccttttcattcgcagtcctcctttacgtcccgcaacatctgaccaagatcatctacaccgtcattatcttcaacagccccgtccgcctcgcccgttgtgttttcttcaaatccaccgtactaagcccagtctagaatgttatcgtcttctactttatcttcttccactgcaacccctagctctccgtgcgaggtccaacaattatagctacgcatgaacccccactgaaacaggtgggcatgaatagttcatactatggaatactccttctagtttttgcacttgtcgcatgaacaagacataaaaccgttatgcttgttagtattggccacattcaaaaaataatgcacgccgttaataaactgtttcgaccgcctgtctgcgtacatccattgctgatccatcaacctgaaatgcatataaatcgtaaaaataaaatctacaaaagtaaactaaataaataatcatacaataatttaaaacatcatccttaaactcaaaaccgacgttacatattttaaatgaatttgggatgacatggaagaaggcgcctatcgcaagagcgacaaagatggcgccgagacggaagactatattgtacttatttctaactattctaacgatttttaaattaacttaggtttgtattctttcatcttaattttctatattagttttttcctttgtcatttttaatttaatgtacttatttatagctatttaactatttttcaattaacttagtttcccattcttttatacaaataatcataaaataattatacaaaaatcgcacatattattcattttttcattatttttaaatttctaaccataccttcaatgtattgtacttttctctaaccatttattaaattaactaagtttttactattattttaacttagttttcctcggccttttcctttgccatctcttttacaacatatttatccacattcttttaacctaattttccctcaacaaatttttctctctcatcattttccaccataaaccttgttggagactatattgtataccaacaaagctataaatgtaatatgctaagcatacatcattagtgtcacgcccggaatttctatccaaaattccaaacacttatatgtgcgtttaaccctcgtccaagaatcagccgaggcacacaataacaaattgataatagagtactatcaaacagctaattaatattcgcaaaataaattattacagaggtggatagttcctctcatagaataaaattctaagcggcggaaaataaaacaaagactgaacagctatggtgactccactccacaagcaacttgacctgaacaacgcctaatcctccagatcatcaccttcattgatatactcctcctctgatgaatgaatattgcaagaatgagcatatgacatactcaacaagccacacagcaaatatgcaagtgcacaggataacaaagaatggcataggaaagctcatttgcataaacagcatttaataaacattttaaagaataataaaacagttgaataattaatcagtattaaataaacactatacaacacacccgtgttgcataggcccaacctcatctgaacaaccaaccccggttgtacaaatcaaatctccataccaggaatataccattccaaaccaggagtcaaattaattaacacaatattatcattaatgagaagtgtgagactaatcacgaaaaacattgttaaactcacccataaccgcgggcacgactattcgaatagttttactctgatcagagatgtaccactgtacccacaagacacaactccacaacatgtcaccatgcgcctcagtaccaccacagtaccttggaaaggaactgtgacaatacctctcacacaacacaactcaccacagtgcaccgttcctggatcataatctccccctcaaaaccagaggcaatggactccccagcgacccccacggacttctcgccgcttcacagtctggcaccccatagtgaatcatgctatacaaaaggtaaagctgttgcccacgctggcttgtggttggcacggtaaatgtttcacaacagtagctcgcgaaccggtccttaattgtcatgagcacgaccttcaaaaccatgtactcacaacccacctttaatcaggtttatgtgttaattaattaacataacatgattaaccatcatgagctaccattaaataaccataaataataatgtaatttgattaatcccattaatgagctaatgtttctaagcatggctaagcaattatacctatatatagcctttagctgaaccaaaccaatatataagctccaagctaattcaatttattacccataggaaaataaattcatcattggccattaattaatagggaaaagctcaccacccgatgatattcgaaaataatgcataagttgaaataaaacattagctttaaatagcttcaacatgctcaaagggttgtttgggatctttgtgacttgccttgagcttcttcaaacgcttccgatccttcctcaacaaaaacgctctcctccggaacgtcggaaactaaagcaaataaacaaaatcaacaaaacagtacaaaaacaagcataaacagtacatgtggatatttttaacatgtagatcttgattttagatgaatttagcaacttgaaccacccgaatcggagttacgacgatttagttatgaatttccgaagttttaatcgattttcatctaatccagaaaattattacgaattaaataaaagatttatgacgtcacgatgacgtcatcgccgacctagcactggacgacgcggccaccggcgatagagagctcggccgggctcaccgaggacaccaacgcgaagaggacgacgtcacgaactcaccggtgcgaaaaacaacgacggacgacgacgaacgacggccagcgatgaggttcgacggcggctcggctcggttccccgacggcaacggcgctccggtggtcttcggcggctgcgaagggatggccggggttctcctcctccgtgcgcacccgacggtggcgacgggaggcggcggcgacggctaaagcggcggcgtggcgcgactggagaggcggcggcggctagggcaacgcggtggcgatgctacggacgacgagggagcttgggacttgaggcaaacggaagaggacgactaggggatgctatttataggcggtgattagagagatcggactccaaacgagaggaatcgagctgggaaaatctaaagttagtttggagagataaactcaaaacgaactcgatttggtttatccgggcaaaattgattctcgaaaccttaggggaaaggaagaggataaggaggagatgctttcccctcaaacaatcggactcggggcgaccggatagggcgaatttggaggagggaggcggcgctcgggctcggccggctcggctggaggttgaagacaacctcgacatgtgggccccacatgtcggtggccgggaggaggagggtggggcggctcggcttgcgcgaggagagagggatgttgggccgaaaaccggcccaacggcttaggggaggatttttaaaactttttcaattaaaataattcgtgaaatgatgtttcatttattaaaaatacttcccttgctcaaataattcctagaaaaatctaaaaaatagataaacaagcaaagtatttaataaaattttatctagctcaattttatgttgaaatttttcatagattattagagtttaacttgtaagcttttaaattaatttctaaaaatgatttaaaagatgaattattaaattaggcgattttcaggacgtgacaattagagaatggagttgctaaccttatcgatcccttcaatttgtatattatcaccaaaaccatttcaccaaaaattttggtagcacctccgtccctcacacctccaatttgcatcaatgacttgggctggaggaggaagaagtataaaaaggtgggtaactttagtcccacttgaccgagactaaagatcaccactttagatctttagtccggattggtgttaacaaccaagactaaagatccccggccctctgacaggaccctaacaggccctgtcaggaggcgaaccgggcggttagtcccgttggagttattaaccgggactaaaaaagtagttttagtcttttttttggaaccttgctattgtggttttcaaccgatccagcaaagatcagttctccggtatcatagtaacactagtacagatcctttcatctgtgacggcccataacaagactggaatttgcgggccgtcacaaggaagtaatctcaatcgggccggaggccgacagcaaagcaattcatgaacccccaccgatgaagaagagcaggaaggcacactcttcccctcagagaattactctcgataaacccgaagcaaaggggagaggaaggggagaaaaggtgcaggcctcgcttctagctccgaggaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacttatactacatggagaaatctaacgtcaggaagccgaataaagctaccgatatccttggagagcacgatggaaagccattccttggttcaacaaattatatcatggtctactttaaggatcttttcgaccactacaggctccgagcggtggacacaagcctccttaagtgctacttcttgtaagtactgtagcccaactcaatctggtaataacaatcggtttaacttgcttacaagatcatttatcctgtgtgtaggtaaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgcgcctataatcaatagtaagtgtgttaactaaatatacacaacagcatgacacattccttaagtacttaatcaactttcactatattaatgccgcagtgcccattggatccttctggtcataacacctaagtggagtacatgtcaccacctgaactccagaattgataagaacgcatttgattggaccccaattcaactagcgatagatgaagcgtgggcccaatatgtgcaaagaggaggcctcaggaagacaggacatgacaccctcatccacaaaaaaagacttcccggtaaagtaacaaataggtgaccagtgcggattccatgtgtgccacaacatgcgccttctgtatagagaaaaggtgaagactttggctgagtttgaggtcggtggtctcaattgtgatagactaactacattttagtacttatatatgatcgatcaactaatctggaattatgacaatatagggcacaataaccaagtctctgcctaccagctttgaggaggttcgcgaggagatagccagcttcatcctccgcgaaataattaaccccaaaggaatgtttaggcttaaactaaaatgatgaacaatgttgaacttttatgtttaggcaatgatgaacacttattatgcaactgtgatgatgtaactgtgatgtttatatttatgtatatatttcatatgtttatgttaagacttgctaaataaatatttgatccaactaacttggttttgcaggtgaaatatgataaatatttgaatggatgtgaaatatgtgaatggatgtgaaatatgagatggctgtgaatgtgtggttgtgtgaaatatgttgatgtttgtgtatgtgaatgcatatgtatatgaatgggtgatgctggagagctggggatattagatatctgtgtttgtttttgtcatttttgtagccggcatggctagcaaagaagacctgaggctagccaaaaaaaaaaatttattttttttggattatagtcatctgtgacgggccataactaaatgcccgattgagatgacggtcatctgtgacgggctttagtttaggcccgattgaggtcaggagtcatctgtgacgggctctagtttaggcccgattgaggtcagtaatcatctgtgacgggctctattttaggcccgattgaggtcagcagtcatctgtgacgggctctagtttaggcccgattgagatgagtatcatctgtgacgggctctagtttaggcccgataaaggttagtagtcatctgtgacgggcgctagttgtggcccgattgagataggtcatctgtaacgggctatagtttgactgggcgtctgggtcaaagctatcggtgacgggctttacttagggcccgattgagatagattcatccgtaacggccgtttgcccgattgggataacttttcacatcagtgacttctagcctgtgacggacgctgtgcccgattgagatggggcttaccgcccgattgagatgagggtatccgttctagtgtaacgatattcatgtacgttgcataattttttgatagttgtcgacattttaaatagaaatgcgtagggaccaaattatgccacgtaatatacagtagagccgcagatgatttgaaaagtcggaatgaagttctctacgtacgctaggcggccggcttgccgagttgctcgcacgcgcgaagaccttgacctaatcctactcgcggggaagacttatactagtccaagtatgacttaattatgagttattatatttcatgactggcatatgtgtatcatatcgcacgtaactttaatttagacatcaagcacgggctactgtcgatctacatctctcaaagggaatacaccatatatatatacaagactcgagatcactcgaagatagtgcagttgttgcagcattcgctgataaaggctaactcgaacagcacaaatgagtagtgaaacatcgcccgtgccatctccccgcgggataactagagctcttctatggcttgctgtggcaacggtggcatgcctgcccgccgttgcatcttcctgccgtagaagttgcggcgacgtagcgatcccttatccgttcgggatgaaagacgatcagccaggctgcgccattcctggctttgaggtgagctgcaaacgggacggcctgctgctcaagccgtttctctcggatgacgtggaggtgcgcggcatcttgctagcagaatctcaggttcggataaagatggatatatcctggtcgtgctataacacgattaacagaacaatggactccataaattggtttctgtccttcagggatacaccatacagattatctgatactggcaacaagttcacggtcatcggatgccgaacacttgcttacatcaccatcacaaagccgcaacagctggaaagcagtagtttaaccaccggatgcgtggccacatgtaatagccagggcgaccttgcaagtctctccgatggaacctgctctgggataggctgctgtcagaccaccatcccaaaggggcttcagaactatgggatctggttcgatgaccgctttaacacagcgaagatctataacatgagccgttgcagctacgcagcactcgtggaagcatcaaacttcaccttttccacgagctatgcgatgtcatcagcgttcaatgacacatacgccgggcaggcgccgttgcttctggattgggccattgggaaccaaacgtgcgaggcagcgcggcggaatcccaatcccgatcccaaatacgcgtgcatcagtaacaacagtgactgtttcaactcgtctaatggaccaggctatatctgcaaatgcaaggaaggatttcatggaaatccttacctggatgatccagagcttggatgcaaaggtacgaaatgaacgatttctctgtgttgaccgtatcagtatatgccgcgtcaaccccttgcctacttaatttatataggatgctccttattctaacttcagtcttctgctttcctattatcagtctgtctgatattttcttatccgtcattcaagctaacttgcacaagacatttactacagttacatatacaagccatttgctaaacttgcacagttgaaaaactgcaaattcggtaaaaatgaagtgcgactttagtttggtttctttctagatgaattattatacttgtataaatcattatttctagctagtttccattctgctaaggagttagacgaaagcataatactttaccttttaggttacaacattaatatttgcttcaccacagggagaaaaatataaaggtactgatgtagtgtttgaaagtgattgatagacaagaataaacttagtcacgttacaaataagataggtccttttagcttttgtaatcatatttgcacgtgctcagatagcctcatcttttcgcgtatgcttattagccaaaatttaaattttcaaccttaaatttgaagttgattttggggtttttttcatcgaaatttatttttcagccattgtttttagaccgctaagaacacgtatatgaaagttttatttataaattatttttcgtttgcaaaatatgccgtttcgcttattccctcatatttttaaacatgtatttggttgcagatatcaacgagtgcactgattggtcgaagtacccgtgtgctgtgcctggaacttgcgttaacactcccggtgcattcaagtgcgtgtgccctccgggttatccgaaaggcaacgcccaaaatgggacatgcgagagagatcaactaccactcagttctggggcaaaaatcgctattggtactatcatgcttccgtctcatgctacatgtttggactgtttattttatttcccgtacataacgagtagtaatattgttcatttttttttcgcgagcatataatagcattcattctttatagtgtcttcaattcacgctactacatcttcggagtcactatgagataaagtatttttgaaggcggacaaaacatgttttcacaagcgaccgactagcaatgccgcctgtaccacagtcccgcctgtaccacaatccctgtagaaatcatgattttcctaggcaggcaactggtccaccagcgaagagattttgcagtgaagagattttgctcagcgtttctagcccttactcgaacatcgttctacctttcgctgattgttccatgtaccattgatggaatcggtacatttgcgtggagagattctgcacctgatcaggcttgacgagaggtttacccagcttaaattggtatttcacctcagccactgggatctctgcgtcgttggactccctcaactggtccaaggatagaccggtttctttcatgaatagtttgatctgtcgttttttaggtgtaagaaacgcgtcaccgggatccagctcgggctgtggttgatctccaagctgagggacttctttggactgtcttttggacttttcgtcagccttcttcactgttcgcttgtagtccttcagccctacctttgcctcgaccggtgctatcatcaacacgtgacagtcatgagactctagattcgtgaacttcttatcattcctgcttattattctctttatattagaggagtacccagacggtaccttgatgctctccaagcattcaaatatactttccttctctgccttgctaagagtgtagctggctgggcttaagtactggctttctttctcctttggttccgggtggaggtcctcacgttgtttcatatctttgagatcattgcgtgcttcaagtgtatctttcgacttcccgtacacacctaggaagcccagcaagttgacgcagaggttcttggtgaggtgcatcacgtcgattgcgtggcggacgtccaagattttccaatagggtaactcccaaaaaatagacttcttcttccacatcgccgcgtgaccatcttcgctggctacgggttggctgccaggtcactttccaaacactactttcagatctttcaccatatcgaacacggttttaccgttgcgaaatatatgcttcttacggtggtccgccttctgatcaaaatgcttgcctttcttctggacaagatgggtcgcagcaagaaattgacgatggcccatgtagacaacctttttacaatgcttcaaatacatactttcagtttcttgcaaacagtgggtgcaagccttgtaccccttgtttgactgtctggataggttgctaagggcaggccaatcgttgatggttacgaacagcggcgcttataggttaaattcctcctgtttgtcctcatcccacacatggacgccttctttcttccacaacagttatagatcttcaaccagtggtcttaggtacacatcaatatcgttaccagattactttgggccttgaataataatcggcattatgatgtacttcctcttcatgcatagccaggagggaggttgtagatacacatcataagaggccaagtgctatggccgctgctcatctctccgaatggatttatccatccgtacttaaaccgaaccttacattccgtgcatcctttctaaagtctttaaacttttctatcgatgttttgtcactacgacccatcggcgaggtgtcttagcatcccgtcctgttgacgttcttttgcgtgccatcgcatcattcttgcatgctctttgttcctgaacaaacgtataagttgtggtattaggggaaaataccacatcaccttcgcaggaactcttttcttcgagggctgtccgtcaacttcacttggatcgtctcttctaatcttgtaccgtagtgcattatagaccgggcatgcttctaggttctcgtactcctcaccgcgatagaggatacaatcattcggacatgcgtgtatcttcttgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaaaatgaatcatagcaatccttaaaataaatagaggacttatttaccttagcttaggttgcagctcagacagcccgagaatacaaccgacgacacggacgaggcgaacaccaacaacggcagcagcagcggaaccaacggtctaacacccaacaccacaggcgacggctgggaaccaggacgaaaccctaatcttcacttcacctcatcttcaacttcagggcggagaaactatatatatttatatagagcaagggtgagtactttcgtactcagcaagtcacgggaacttaggtgtttaatgcaagcttggaagagaggcaaggttgttttacaaatcttttatttgaagacattttgaaatcactaagtgatttatttctttctaagtttggggcgaaaagagacttgcgtctcgattcgactttaagagatgcttttcaacagctcatttagtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccaaatcacacagattcgtttctgaccactcaggttgtccatctgccacataggctgattcaggttacgattcccacacaacaacaacttttcacaaagcacaggcaaacaaatctacgcaacgggaaccacctcacatccgcccatgaccgtgggcacggctgtttgaacagttagttaacctctgcagaggggtacactttacccacaagatacgaacttattccgaacacccgtcgatatcggaggttcgcaacaaagcctttcccaagctgacccagggttacctcatgccacatagaaggatcaaatcctcacataaatataggccattttagttttcacaaatcaaactccaaccacctcgatcggtaatctggcaagcttcgcgttctggccttaccaggaacccgggttggctccaatcgaccccgccccggcgttccccaactattggcatgcgaggtttccctgaaccgactagttacttagctagggtgtcccattccaccttgtggttgcactttgattatgtttgatgagtttcccacaggaatcggtccttatatgcgaatacgggacagtgccacataggcacaacccccgcatcgcgagttttcacaattcattttattttcaaacacaccgacaccgcatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacagaaattagtgcgactactgggtaggtccgtcggtttggcacgcaaaccgaggccaagcaagttaagtgtgtgattctaataatgcatgttgcaaacaaaataataatgacttttcaattataggggcaattgatcaaagggtgacttgccttgctcaaggtcttcatgaagcttcacgaatcttcgagaaaacccgcgatcgacgaaaatccgataaccgcaactatacgcaaacaatcgaaaacctaaacaaaggaccaaaagaaagatcctatttagactaattagtagtgccattaaatagatctcaattttacggaattactggaagttgaacggagtcaatcggatgagcggtttggaatatatggattttcgaagtttattggatttactaaccaaaggaaaaaggatttaataatttattaaaccctttttggaaagaaattgaaggagggatgggatttagacttctttgggcggctcgggctcgacccaagggtcatgcgcagcgcggtcaggccattgggccggcgcgggcgcgggtggtcggcccattaggggcgcggggagagagaggccgacgcgggtggacgcggtccaccgcgcgggacccacctggcggtggttgggttcacggtggggagggcgcgggctttataggcgaggaggagaggtcggtttggaggagggaaaccgacattggcggtcaagggagctcggctggtgttcacgggcggctgcggcggtttcgtgggcagcgcgaaggcagcgacggtgtggatgcgttgggcggcgaaggcggtggatcgaacggcggaaaatcgaaccgcgggagcgggaggattagcgcgggctggcgcagtcaaggtgggggcggcgagctggcgctggcatctgcgtctctgcctccaagcgctagcggccaaggagtggaggcgtggcgtcgttgcttgggagggaaaaagagaaaggaggacggtgggaagggggggctttaccatgccggtttgggaaaaaggaggtgggagagggagtgctctgcctctgggatttggatggacgcgggtggagcggcttgggcacgcgctgcagagcttgcggcaggcagcggggccgagcggcagcacgacgcaggcgctaacggcggcggcgaccgggcggttgcgcggcgcaggcgcggcagggctgacggcggcaacgaccggccggtcggccacgcgcaagcgcgggaaagagcgaaggcggtggcgggttttgggcggcgacggcgggaagcggcgtcggcgcgagagagagaaagagagagagagagagagagggagaaacagcgagagcgagagagacagagagagcgagcgacggctctctctctctcggctcgcatgcgtgcaacgcacgtgcgagggggggagatgatgggctgggaggggagatgggccgggggaggagaatcggtccatccaaaaacacagggtggtaaagtagacttttacagagaaaactgatttggatagaattggagagatttagggtttggattcgaattcaaatttgatattcaaactcgagggtttagggatgtatcaagggaaactcaaggagaagtcatggaaaagattcaaaaggaatacttgggtatttgttctcgggaacatagggtggagtcaaggaaaggattcgaggcgggatttgaataattctggattcgtagaagtatttggcgaggattcaaaggaaggatttgaatttcggaatttgattttggagacttaaattggaagaggaaatttcgatgaggatgattttgatggcgacgagagggatcaaggacggatttaaactgagatccacggcacgacttagactcgcacacaaagaacgaaaattttcgcaattaggattttgccgaattagtttttaacgcctcacgaaaagtggagcgttacagatccaccccccttacaagaatctcgaccccgagattcgacggtggaccacacacacgaaaccaaaaagggatcttcagacttcttcacagcttcagactctgctagtctttcttcaacttattgttgcatacttgccacaaaacggtctggtaacttgattcacttagcattcttcatcttactgtggctttgctcttgcctgtggaacctgttcttctcctgctccttcaacttgctcgagattcacaactttttcatttgtttctacttgcacatggttcagacgaccttgtccaacgggcggtgaggtcaacgaggcagaaccactatttggtggctttgaactttttggtccagatacgttaggaaggcttgttgttggttggactcgttttgacttgactttctgagggcagtaccatgaatagtgtcccatctcatggcagatgaaacattcgactcctgccttataaccacgtctttttgaaggtgtagggcatggtacggagttgcttcctttatggctattattgttgatcattgtggcttgctgaccaggttctgacatagtcgaacgagacgtagaaccggaaccatttgaatgctgagatgctttctgatagtattgtgctggcgagtttgtttttcgacacaaaccttcttttgcttgaatctctagggacattactttgcgtctcttgtattcttgcatctcttgttctgcatcttctagtaacaaggacttatcgaccatttgccgaaacgtcggaaagtcgtgagccaaaagtttcactcgcagtttcgcatccattccttttaaaaatcttctgatcttctttttatcagtgtctacacttctgaaccgccagtcctagagggcagactatcttcttagcttcgtatgttgtttctggcaacttgttttcctccggaagaatgttcttcactagtttcaataactcgccaaatgccttgtcactgacaccatttttggcattccattgcaagaattccagagttgtacctaactttttgtgcccctgttcgcaacctgggtacaacggcgtcttgtgatcagctaacatacactctaatttctgagcccccttttcacttttgcagtcctccttgacgtcctgcaacatttgaccaagatcatctgcagcatcgttatcttcaacagcaccttctacctcgcccgttgtatttccttcaaatccactgtactgagccagtccggaatgttctcgtcttctacttcatcatcttcatttgaaccccttgctccccgtgcgaggtccaaacattatatctcggcatgaaacccgtccgagacaagtgaatctgaatagttcttactacataatactccctctggtttttgtacttagtgcatggacaacggataaaaccattattctgctttttagcctcggccactcttagaaaataatgcacgccgtcaataaactctttcgaccgtcagtccgcgcgcatccattgccgatccacgaaagtcaaaccaattaaacatcatacaatagttacatataattaatcgtacaatcattataaaataataacaaaaaatattcatgttttcataccacattaaagttttaaacaaatattgaatgtgtcagggttacggataaggtataccctctatccttggatatacgttgtatactgatacggtatacccgcgcgtatacggatagttcctgtatacattaaggaaatctatcacgtgatagaaacagaatccacagatgcagggagtcctactcgaacaagactaggtcgttaccatatcgtgaggggtccgatattttcgagtcctacttggagatcaactgacccgcggtataaaagggaccacctgggcaggacctaacgcatcgaatctgaccgccgacacatccaccacagcctatgaagtcagagcctacaggagccaagtcgccgggagatctagtcggaccaactcgactacggtctcgccggtatcatcgagttctgttattccctttgtaatctgtagtttccatcatataatcccataccaactggatcagggctattacctaccaaggggtctgaaccagtataatgcttgtcttttgtttgcttgatgtcatactacatagatcctcgtaccagcgtaccccaataccctttatatccggtctactgtcacgcccggaatttctatccaaaattccaaacgcttacatgtgtgtgaaccctcgtccaggaatcagccgaggcacacaataacaaattgataatagagtacaattattactctaattaataagcgaatataatgtcattacagaggtagatagttcctctcaatcaataaagatctaagcagcggaaaattaagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaagaatggcataatagggtttcatttgcaaaagcagcatttagcaaacatttgagaatttaataaaacagttaagtattaattaaacaatattaatccaacgctatacaacataccctgttgtataggcccaaccattctgaacaaccaacccggctgcacagttctatctctaaaccaggaatataccattccaaaccaggagctaatcaaattattaccaattatagcaccatttaatatggtgaaaagtgtgagactaatcacgaaagacattgttagacccgcctataaccgcgggcacctattcgaatagttttactctgatcagaggtgtaccactgtacccacaagacacagccccacatcatgtcaccatgtgcctcaataccaccacggtacctcggaaaggagttgtgacaataccccttgcataacacaatccattacagcgcacctttcctggatcataatcacccccttataaacaaggcatggactccccagcgacccccgtggacttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccacaattatcaggttttagttggcacattaattaattaaccaatcacgattgaccatcgtgaactatcattaagccatcattaaataatagtgagtcataagttatcccaatagtgtgctaatgtttctaagcttgggtaagcaattatgtctaatatctagttgaaccagtaaatataaagctcaactagtcaagttttaataacccaaggtatcaaggaataaagtaatcaagaacaaaagggctatagcaaacaatagattaattccacccaatgacattcgaaaataaatgcattagttgaatagaaacaatagctttaaacgggatcaacatgctcaaagggttgtttgggatctgtgtgacttgccttgctggccttggaactcttcaaattcttcttctgcaaaaacggactctccggaaacgacggaatctaaacagaaagaagcaaaatcaccaaaacagcacataaacaagcatgaacagtacatgtggatatttttaacatgtagatctcaattttagaaaaacttagatacttgaaccaactaaatccgagctaagatgaattagttatgaatttttgaagattaaatcggattaaaacacttatattgattttaattgaattatgacgcaataatgaattatttttgaaaaggaaaaaaggatttattgcgtcagcggctagggtttcggtggaccgggcgcacggcggcggttcacacgaacggacggcagagatcgactcatccaaaacggacggccgagatcgatcggtctatgaccggctcacgggagagggcaacgatgacgtcggcgatgacgtcaccaccggcggcggcggctcggacggcgcacgctcgccggcgaacggcggcgcttcggcacgaacggaggacaccaacgggtagagcgcgacgcggcgaactcaccggtgaccaaaggagcggcggaagaccaacggacggcgacggtgacggcgacgaggttgaaacggcggcggagatcgggtcgacggcggcgacggtgctccggtgatcttcggcgacggcgaaggggcggacgaggacggcggcgacttggcgaccacgacggcggtcttcccgagcgatgacgatgaccggaacggcggcggcgcacgcctggagcgacggcggcgacggcggcgctagggcacacggcgctagggcgtttccgacgacgagaggcgaaggcgagggtggcggcgggtagaggagacaccggggagccttttaaaggggctaggaggcagcggcgaaggcccacggcggccggcgacgggaaggaaacttcggggttcggaggaaagaggccgatccgaatcgaactcgattccacgaacttccaaaacgaattagccgatgtttccaaaagagaaaaggaagaggagatcgagaagatcatttcccctctatcaattcggccggagaaggaaaggagcggccggatttggaaggaaacggcggcggcggcgcgctagggtttcgggcggcgacggcgcgacgaagacgacgaccctgacaggtggggcccaccagtcagcgggagagagagaggagagcggccggcggactgggccgacttgggccgaggagagagagagggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggctttttaaaaattatttctaaaaattccatttaaacaacaatttatatattttgaatttttagggtgtgacatctacgggtatctcccctggacaaaatgtgttgtacttaatttaatttaaattgacttagttttctattcttttagattaatcttctatattttacttcctcatctcttttatcacaagatttttttcaaattctaaataaactaatttgattataaattaataccacatattattcatgttttaattaacaaatatttaatgtattgtaattatttttgattttaaattaacttagttttctatcaaattaaacaagcatacaacagttatatataattattcgaacaataattataataataatagcacaaattaatcatgttttaattccacattaaagttgtaaacaaataattaatgtgttttacttaatttaaattaacttaattaagttttatattcttttagattaattttctacattacttcatccttacacaaactttctctctcatcatcacccaatccaaatttctagaggcaaaatagtatacaaaatatatctctaaatccaaatgctaacaacaaaagagaggaggatgaagttgctaacctttttgacacctccaagttgtatattatcaccaaaacaaaaaaccaaaaattttggtagcacctcccctcaaaactcaagaaaattttgatgccttctcgggctagaggaagaagaagatgacatatatggagggtaattttagtcccagttgttgttaccaaccgggtctaaaaatggccaagatttttagtcccggttggtaacacaaactgaaactaaatatcccatcttttgtccaggttggtgttaccaaccgggattaaagatccgggggacctgacacatcctgacaatcggcaaaccatctttagtcccgattggtagtaaagatcaattcttcccgttgcatttttaaaccgggagtaaaaatggtttttagtcccggttttttgttgaaccgggacaaatgtggtttttgcccgacccggcaaagatcacttctccagtagcgtattttctacttattaaattttaatcaaaataaaagtatttcttcatataccttttatatcaaccaataacaaacatccccaatttaatttcatcatctactttattttcttagccaattacaactttctcccaatcatctttaataacttttttattacccatgcttaacttacaaaatgtgtacattttactgctagccttctccgacattgcacatacaacatcacccactagattggacaggaagactcttcagatgcttttaatgggcaatttgcacattgaaacaacatgttagttcttttttttttttgcacattagcacttgtttaagcttcttccaatgtactactccctccattttctaatagataacgccgttgactttttctcacatgtttgaccattcgtcttatttaaaaaaattatgtaattataatttattttgttatgagttgttttatcactaatagtactttaagtgtgatttatactttatacatttgcataaaatttttgaataagacgaatggtcaaatatgtgagaaaaagtcaacagcgtcatctattaaaaaacggaggtagtagtattttaagcttcttccaatgtttacttttcctactacctctgtctaaaatgacttcatctctaactatgtatattggataattctcccaatagactttatttctagttatgcgtatcacatagctagtccaggtgaaatgatgaagctactactagctttttcgcagtgcgacagctagcttttttttcttcagtcttggagagcgtaacgttatttttagtacaaactacacccttcgtctcgaaatataaacataacatttttagcatagtggtaagtcaaccatttttaactttaactattaataataaagaaattaaaaatatcaatcatatagaattgatgttactagatttattattaaacaaattatcataatatgcaacactttttatttaaaacatgctatttttataaatattgttggtcaaagtagtatctcgaagactgtgtcgaagtctaaaaatacttatattttaggacgaagggagtagtaagaaacaataatgtacgagttagcagtaccatggtactagtaacgcgcatacatacatacattggtagcgctacacggcgcgacacacgggcgcagcgcgccagggaccaaaatggagcgacacacagcgggaatgtccccccactggtgcaaccaaccgaactcagagttaaaaattaacttacatacagttggtgatggattacgatgccattcgtgatgagttaaagtttaacttagatttagctagtattagtaaacgtttaagttttatacacatgggtggtcggttgtgaaggcattgttgtggagttaatgtttaacttgatacagttgggatgtggactatggtgtcgaggatattgagttaaaaaataacttggagtttttgtaccttgcaaaaatcgatagatcttttaatttctatatagaaataggggcctgctaatgtgtgtgattagaccgagccacgtatctcggatattacatatacacatgctaactaatgtttaattcatcggatagaaatcaaccccaagtcatagtaactgggaggttaaaaatgaaaatcgtaatggtccaaaaactacatgatcctagcgtgtattgattcggcattaatttgataagtggttagaggaggcccggaataaacggtattttgtactgatatttttatttcaccaaataaaattggtagtaaaaaatttcaacaatcacaacgtggataataattattttacgatgcatattattacaatcgatcatcacaacggacatcgacggtggcaagtcgtgtaggtgcccgccgctgctcctccatggatgccggaggacaagctcaccgccgcgaaggttgacaccgtacgcgtggtggcggagcagcggacggatcctccgccgtctcgcttgcagcccgccgtcgtcacctgtgcaggatccacgcccacaactgcgctggatctgcactgctgtagccggaaccacgcgcgtgggacgcggagtggcggctggatccgccgatgtgctcgttgccgctgcgcctccgcgcctcccgcctgtagtcgcccgtcatcgccacacccgtagtcacgccggatccgccccatcttggccgggtccgcgcgcatggggtgcagagcggcggccggatccgccgccacctcacctcccatccgcagccgcccgtggccacctcgcccgtcgacgctgcacctgtccacgcacctcggcgccaccaaatccgtcgctccttcccctcatcactcctcctgatccccgaacggccaccgccgctcctcctcatccccgaaccgccgccgctgctgccgctcctcctcgttgccaacccatcaccggaaccgcctcgccgccactcctcatcccttaaccgccgtcgtcgttcctcttctctccacgaggaaccgcacgccgtcgcagatccgtaaaatgtggagaaggagagtaatgagtgggtggacggtttcttcgatgggaattcgtaatatatataccagataaagtcagtatgtcgagttaaaaaataactcaatgtggaaacaccgttggatcacaagacacacattgactatctcactaaccgttaaaaaaactggcttcgtatttaacaattcattgtatggttaagttaaaaaatagctcaatgtacgaacaccgttggatcacaaagacacacattggataacatcaagtaaaaaaattacccggattatgggagtgggggaggggcgcaggggtgggattgagattggtcgtcggtgagttaaattttaacagcatgctatggatttagtgggggcagggtggggagtgtgtgagggtggggctgggggctgtatcagtaccatttagtacgtagcaccttgtcgtgccatatagtagagagtgtgtgtgttaatactgacttaatttcgtctgccatcttctccttttctaataagagcatataatcctcttgtttgtcgtcccaatacgttagggaaaagggtctgggtcattttgatctagtcaacagggactgttcgattcatcaatgtcaaagtgactgcttatttaaattctcgtacatactaacaactaattaatcttcacatcgacaggaatctctgcttttgttttccttgccctagctagcttcctcataagagaagtgatccagcataaaagaagtatcagaaggcaaaatttacaaagacaaactgatgagtattttcagcagcatggaggccagctcctgttagaaatgatgaaagtagagggcaatgtcgggttcactctcttcgacagagtgcaaattgagactgccacgggtaatttcagcaagacacacatcataggggaaggaggacagggaacagtttacaaggcagatttagacggagttgctgttgcgataaaacaatgcaaggaaattgacgagagcatgaagagggactttgtccaggagttggttatactttgtcgtgtcaaccatcccaacatagtaaagttgcttggctgttgcctgcagttcaaggggcccatgatcgtatatgagtttgtgcaaaacaaaacattgcaagagctgcttgacctccagagaagcaggaggttccatgtcacactaggaactcggttgaggattgccgcggaatccgctgaagcacttgcgcatctccattgcctaccgcatcctatactacatggcgatgtgaagccagctaatatcctacttgccgagggattgatcgcaaaggtgtctgactttgggtgctcaacaattgatgaggaaaatcaggctgtgcccaaaggcactccggggtatattgatccggactatctactcgagtaccagctcacatccaagaatgacgtatatagctttggagttatccttcttgagcttctaacaggtaagaagccactatcaaaagaaaggaggagcttgacatcaatgtttcaggaggctatagcacatgatacactccgtgagctccttgacattgacatagttgatgaagctagcatgagggtgatctatcgtgcagcgatgctagcgagtcaatgcttagttgttccaggtacaacaagaccagcaatgacggtcgtggcggaggagcttcggcggcttgccctagcagatgaagtgcagcgatgcccacagtcgccattagttcttgaggatctgagctttacggatacaggaggaagcacagtgtccatttggtacaatgggagccagaccagcggggtttacaacctcgagaaaaaggccgttctgagtacaggattcgccagatgatcgatagatcatatgctatattgttggcttccttgtgtcatttgtaggtttatgatatatttagtgttcttccacactttagaggcattcattgtgaggaataagagtacactaacatgtaaaataatgtagcattaagtgtaccgcaaaattaatgactgaaatttaattatctagtttaacttcatgcatggtagatcttctactccgatatgttgggagttaaacgtatcgtcaaggaaatccatggcggtctcttgttattccccattttgacaccaaggagggtttctgagaagtcggagctgctacgtcgagtatttgatgagcttggcaacgatgaattgaacctttcgcttggtttcaggcagggtttggttgttgtcttctagtgaagtcggagttgctgcgcttttgtgaaatcgggaacaataacccatgccaggcggaggccgagcatgcagaggagcgcggcaagctctagcttggtgagactcccatcgacatcgagcttgaatcggaggaagatcctgcgcagccactcgcgctcatagccagccagagcgggggccttccccttctccttcccatcgacaatgtcatcaccgcttgcatctgcaaggcaggcacgaagctggggttcaagaggcagggaaggaagcggcagcggagaaggcatgaatggtgggtcgatgaggggaggagaagacgtcatcatgtggggaagggtccggtgcggtggtcagaggactcttttcaatggatgtcggcggaggcaccttgggtgttgctctccatgtgcttgaagtcatcgtcaagggagacggaggcgaaggcgtggcgggaggaattagtgttgccaaagacaccggggaatggggaggcggaggcttggccgtacatgtcaaagaaaggattaggtggaagaaatgttaaccatattgtttaactaacacatgggtccacaatttttgttttaatattaaactattaaattttgcttcatgtaccacgtcaatgccacgttagatgaagaccaattcaaattagccacgtgggtgccacgacagctaaaaaccgtcatccaaactgtcctgggaccaatattgcaccggttttaatagttgaggaacccgttgtatctagtattgcggtttaagtatgaaaatcatactcactgtcacagagttggcaaagaaaaatcctcccactaggcccaaagcccttcggccgcataaaaagctgaagcgcatgtatagaccttattaggccctcttctaagggaaacgttcactttggatccattaactgttggtcgagtatcatacgttgcccctcaactataaaatcagatataaaatgtccaataactattaaagcttgtacaaactaagtctttgagacaaaaaaaaaatccttctgatcagccttcctaagtataatagtatcatcagcatactgaattattggaaagtcactttcttcatcaggctgaataggcttagaaattaaaactctattgaagcaactcagcccctagaacaaacaaaagtggagacaacgggtccccttgtctgacccttcttttgcatttgaaggatattccaggtacaccatttaaaagaactgaagtatttgctgagttaaaaatcatttctacctagtttaagcatttagcaggaaaacctatatgtctcaatatcatcaagattgcttcatgctcaattgagtcaaaagatttctcaaaatcaaggtttataataacaatttctctctttgattgctgacattgatgaatttattcaaaagcccatgctaaacaatcttgtattgttctgcctttaataaaaccatattgattttggtgaattaaatcagtgatcactccttgtaatctatcagctaaagccttagttagaagtttgagacttatattcttaaggaaatgggtctaaaattattagctgattctgggtttatcttctttggtactaaagaaatgaaagaagaatttatagactataaaaatcttgggcaacaatgggccaacatttaattcttcaagaaatacccattaaaaccatcagggtcaggagctttatcaacaggcgtccactttaccaaatcatctatctcttgagaagaaaaaggatccaccaaataggacaaatcaattgttctttgaggaaatcactcagattgaatgccatgcttgttcccagagtagagttcgacttttactctatttttatgtctagtgcaactataagttttaaactgcaaccgattttgtacctatattcggcacaaactctaacaatcttcatgttcttctcccccactatcgaaatgtgcatatgattatcattgacaattatatcaacttatttatgaaaacatcaaggggaaattggatgattgtttctaatccaatgagaaaacttgcaaagctcctaactacttgtcgaagtgtcatgtgattttatagattttatagtttgtactgaactgtaacgttgacaggttggtagaacgtggaattaattcttctgtacagatttttcgtcattttccgttagtacatttttcaaaatactaaataatatattttatgtaaaaactttatacataaaaattgttttaaaatattagataaatctatttttcaatttgtaataattaaaacttaattaatcacaggttaatatctttcttgttttgcgtgccccctttttaatcttggtctttaggagggcctatgtgtcaatttgcatttgtgtgtgatgaaacagatgttctgtggacaatggacacactctgcctctaactaactcgggaaaaaaggaagcagtattccaagcataaaagaactttgcaagaatgattatcttgggacataggccctcctaattggtttgccattgatcgatcttgggataaatggatggacttttcgttgaaaaaaaaggggaaaagcgatgaagcattcagaacaaaaaactccaggtgccaaactctgtcagactacgtgcacactgcgacacccagagattaactcgcacctgctgaggatgcgacgccgacttgccgtgggccgggagacccagcgagctcggcggtggccggacatacggcggcttgccgtgcgacgtgagcccctgcaccagcatccttcacgagttcgccatggctctacaccacgttgcctaggaacacccccgtgcagctccgcccgagcgccacctggtctaggcgccacacgttcatggtggagaagacgacacccgcgacgccgagcaggcttctcgccggagcaactaccgccttgtcctcttcaggcaactataattttgctccaatccaacagggttcagcgtgacggccatgacaagtaggcccagacatctgccacgacaagcgtaaacatgaaaatttttgggtctatactatcgtgtgaccaagttacatggttttatatagtttacagattgagatttctgctattggcgccgataagcaagcaggcagaggcgcgctcggcgcagggcgcagctacgggctgctgccatcggcaggcaaagccgcagcggcaggagcaagttgcaaaggaagcctaggagcaaggcagaaaaaaccagaaaatggaaagaatgaggaagagaatggtcttggcattgattgtttttatgattgtcacaatgaacaacatgattgtcacaatgttatgtcctacaatatcgtgcagcgtgattgtttttctcctttattattgttctgtgctagctcttgccatgagccacatctattttttttcctctgccgctgagtggcgcatatgtgtgagggagatggtgaaagtggtcgagagatgtatcggcaaaaaatgaactgtagcacaaaagcaagagctgagaactggcagctcggtggcgacggaagggtcaaccctgttggattggagcaaaattatagttgtctgaattcccttttcctctgtattaatcgtgttggttcctgacaaacatcatacattgaaaactatttattggcagaaaacatgttgcattattgtttcttacaagatagcttgtgtgttagtaatacctgatgatgtaaagcttggcacagcaatagctatcggaaaacagcgttatcaaggcctctagccaccaacctctcatttttcacaagcatgtgaacgtgcgttacaaatatgctaaaaatcaaacagcattacagcgcacaggctaacgctacatagctcgatcggaagacaatttcttatttcccatcacacgtatttgacatatccgatctgaaaaatcaagtttcaaatattttgttccagatgcaacacatagctaaacataaaggtcttttagagacagaatgaggtagcaggcgacaaccaagctagttagctagaagatgcagtacacagtataaagaagctgaaaattaagcaggatacaacaacagcgaagtagcgaacagaggacaagagctagtaaagttgggcgtccgtgcgagtgtacaccccgagcgcatcgaggtaacaccccgcgcgggcgaagaagccgacaatgcacccgtcgctctcccccggagccgtgaatggagtccctccgcctccggcgccttgcccaaacggcccgtagctgaggcattggttcgtggagaacgtgagcgaggtaatgacgactgtgtcaggtgacgctgcatccaagggaccgaacgttccggtgatcccctgaagtgattccagaggcatcagttcaatctgcgagagacaatgcaatggggtacgttacattctaccccaagataaatgtatatactctctctatccctcgacgccgttgactatttaaacatgtttaaccgtttttcttattcagaaacttttgaataagatttaataaacatgtttaaaaaaatcaacgacgtcaaatatctaggaacagagagagtatatatcgatgacagaccgattgaaaaaatatatatattcgtccactaaccttatacgcattgccaccaggaccaccccatggaccaacaacttgctcacttccgtcatggtcggcatatgagaactcaatagaatcgatgacgtcaccactacggatagtcacactcactagacgatgtggctccggtgcatcgacgtagtgggactcacctccacttctaccccatggcccaatcctggtaagcccagtctaatttaccaaaaatgaagaaaaacgaaggattagtgtgtgagcacagaggaatgagatagataggaacagcaaaattttacgctacttatatctctaggtatcacatgcattgctatattaacggccgtttggttggagagaatttttaggagggattgggagtttagagggatgagactattaagtgttttgtttggttgggagacatgggaattttgatgggatggagattgggaattgagaaaggaactccctccttttcaatacctgggtaggggcaggtaattgggagggaattcctcctttactttttctaagcaaatctcatccatccgtttttaataatgacttaatcttcaactaaactccctattaatttccatcacctctaccaaacaagatattgggattaagaatcaaattcacatcttaatctcatcatcaattccctcgtgtaaactcccaatccccttccctcgagttaccaaacaagttataagtttaatactgaaaattgtgacactccttctatttttctaaagaataatggtaaaaatagctatgttcagaatgtcaaattgtagtgctagtcatgcctatacttcttgttattgatggccaaataggctgtctggccccgcccagccaatgcacgaccaggctctgacccgagatcagttgggccagcacaatctgacctaaacatcagtctaggcccaccaacggctcagacacgacccaataagactcgggttgtaccgggccggcacgaatgcacagaagactgcagtgctcctcggtataaatctattttctccctcatctctttgggccgtatcttatatacctggaataagtatattcttgcatcctttatatcttcgggccgtgccttataaggctaaaataagtctattttgggctgtgccgtgccgagccagctcagcatgccgagacagaggcctagtcacggcctaacaatctgaccgggccggcatgaggctttggacaccagtcgagccgtgccatatctagactgaaccaaaccctgtgccctgagtcgggtcgtcgggcccgatcctttctgtcatttgtacctgtggtgccggtgcttcctgcaggtgggggttggcatagacgccaatggcatggacgaaggagtccgcgcagccgaagaagccgacgatgctgccgttgccgcgcatcgggatctggaaaggacttcctccgcctcgtccgaatggaccgcgcctacgggcgttggtgatcagcgtgagtgatgtgacgacatccctatccggtgcctcgttaaatgggcccatggtcccgcatatcccagttagaaactccaaagggccaagctctatctgcatggacaaaaaaaattgtaagaaataaaattgcatcaggcttgctctacgtcgagtctcgtggaagataaatttaaatcgtcctccgtccctagattattcttttagaaacacagaataaaataaatatagacgctcacaacgcatacatagttatctctattaactcacacgcatatcctaactctatgagcacatacgaaacactcttttaacgcatatcctaactttgactaaatttataaagagaactatattatttgatatgagatatgtatcatttttatagtttattatttgaagtgatagatgttaatacttctttttataaaagtttatcaagcatttacaaacactctaaaatcgtagattggagggagtataaggtgacaagtttcttttttttttaaagaaaatactaatccagcaataggaaaaatggactagaacttggtgggcttggtaaaatacattttaatgagttaagcatgtactcccgaatctatacaatctatctagattcattgtattaggttatgtcacatccaatcttaattaggtttgtttttttttagcgaaggaagtacgtggttagattttttgtactaggtgacgtcacatccgatctttttttgttttttgacaaatggagtgctcaccgtataagcggttccaccaagaccgccccacgggcctatcgaatgcttctgcccatcacgatcactgtaggagaactcaagtgaatcgatgacattgccactatgaatcgtcacgctttccaaacgccgtggtgccaccttgatgtcccgatgactccctccgttccaaccccatggcccaatcttcgcgagggaatcctaacgagtatataaacattcgataaaagtgagaaaaaaaataaaatcacatatagatagatggaaacaacttctcattttagaagttatatatatattgatcacctcatcatcatcgtcttctactgttttctgcttagggttaacatagataccaaaagcgtccacgtaccacccagcacgtgcaaaaaagccaacaatgctgccattgtcctgcactgggatgtggaaaggagttcctcttacttctccaaaaggtccgtagcttcccttattagtgataaacgtaagcgatgtaataacaccagcgggtgccctatcaaatggtccgattgtcccagaaacttccgttacatactctataagaccaagctgaatctgcaagaaaagtttcaaaataacataatactactagtaaacctattataaatttcactagttgtgtgcagagataatgaatgtataccaatcattttatctaaaagaaaaatgcaagaattgaataataagattcatagtcaccttagtacgtttgttccctttatttgggccatagccgccccatgtgcctgatgtgtgctgctgcccactgtggtcaatgtatgagaactcaagtgagtagatgacctcaccgctagaaattatcaagctttccaaccggcggggtgccacctcaatgtcatagtgactggaaccaccagctccaccccacagcccaatcttggctaccttagcctatgtgttaagccatcaaggggaaaaaaacacattgtgaacaccaaatatgaaaatagaagttatgtatataaatatttaaaggaattatttattggtaattttgttaatggtgtcgtgcagaccaatcatctgttactacaaagttataacccactgcttcctcaagaatacatgcaaagatgacacatcattattcactaacaattattacatttaagcatcatacaaacatgctatattgtctataatttaataatttattaaattttaaagattttaaatgtaagcatgttaaatcatcccacataatcataatatttcaatatatctctccattatttttttataacatcctatatactatatatagttcatcctcacttagttcatgtcatttttcttttatcttattaagtcatatcacatcaatggttcaaattgtctctcttcttttcttctctcatcaaaccatatcatcttacttttacatttgaatctttattctacatactatttaaatttaaatcgcatcaacttatataaaatcatgtttatataagcttatgttatttaagttatcttacacattatttttacattatttttagttattgttatcataataaattcccgtaacagcgcagggttttaccttagaattatttgactgtcccgtagataaatgtcccattacaagagaacaacaaaattacttccttcactgattcgttctcggttggttagtaaaaaagttgttcttcgtgtgtaaatgaactactagaagtgtaaaatataagagtacttctatcataacgcctcaactttcagctaggggaagatttagggggaaaaggaaatcctagagcaatcaacagtagggctaagaattttgatcccggtccaatatatatatatatatatatatatatatatatatatatatatatatatatatatatatatatatatatatagtgctccatggtgcccgggcaccattgttgaaattaagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattcttataactaggtatatactcacaatttgaaaattttgaaaaatttgagtgattttgtgcatttgaaaccatggtgcccgggcaccatggtgccccatatgagtgtcctatatatatatatatatatatatatatatatatatatatatatatatatatttcctccctttttttctagctttgacgttggttagtgcaaacaataaggggtgtatgtagtagctgagaagagaaggctttcaaaagaaaaatggtaatgtcatatggacgcatgcatagttcacaaagatactattggtaactattaatataataaacaatgggtgtgtttagttcacgccaaaattggaagtttgtgtgtgggtgtgtttagttcacgccaaaattggaagtttggttgaaattggaacaatgtgatggaaaagttggaagtttgtgtgtgtaggaaagttttgatgtgatggaaaagttggaagtttgaaaaaaatgtttggaactaaacacggcatgtgtaggaaagttttaatgtaatggaaaagttgaaagtttgaagaaaaagttaggaactaaaccaggccaatagcttgctaaggggaccgagttacacaaggattattctaaaaacatccacaatgtatgccataagggggtcttaaccaattaaggctttagggtgggtagtatacattatgaaattaatctttatagatgaccttatgatgagctagcattaggtataaggaccacccataaggaataaataattcatctctgttctctctcctgctcacttgctcacaaggttgtcagtatcccgatacgtatcctagtatcttacgatactacgatcctaccaagccgaaacgataccgatcccacctagtatcctaattttcatagtatctcgatcctactattcattagtacacgatcctacgaaatcttaggtggtatcccgattctacgatccctacgatactacaaaatattatttaaaataacatggtatgaaaataatataaataaatatgcttaaatttatataaaaatcagttaaatatatcaaaaccaacttggtttctcttaataaatgcctatatttgcatgacatataccattactacatttttttatatagaatggctacatataattaatataaatattaattaaacttaaaaaaagaaaatctcatagtatcccgatactacgatacgatcctatgatacgatattactttgagcaaaacgatactaacaagtatcccgatactgacaaccttgcttgctcaaaactctctcctacatgctagcattaggtgatatttttatatctgtggggcccaccttatttcctaacaagttcataccattgttgggtatgtaccacaactaatatcacctgttgtaggacccatctatatagaccacttgatctcatatcctaaataaacgatagaataacatacccatgcctgtttgccataggaatttaacacttatcaatcattataaaaagggaaatttagtgtgcaattgtagtggtgaaaatgggcaggtacgattggattatagcattcggatatcctaacctatattttactttaaatttggaacctgaaatgggtagtgtcggacaatatatcactcatcccgtatcctatccaatattacttccttcgaatcggcttcgggtacggatatctatttgcatctctaattcataaatattaaatataacgaaccaattatagtgtcaaaagagataaattacgggaaaattatacaatattgcacgtgagctcgtaaaatagtgattaaccaatccttttatcatgcatgtccgtaggtggacttgtaatagattttcatatgtgttctataatatgggacatatgagtggatacaagtcttcttgtatcataacccattttttttaggattcgaattcaaacttggatagtatcgggaatccttattttctcttccatattcttcccgcgagtctcagatcgggcaagctatctggaaatacccgtccattttcaccctatgcaatggtgaatgcaagtccacaattgtgaaatgtaatcaattcatgcagtagtagggatgaaaatgatcagaaacgatgtcattattttattacttttatggaatcggtcatggtatggtcgtaaatttttggtattcatgaatttaactatttagcatcaacttcgatatgatgttgataaaagttagaaaaaaatctaaattttatatatggctagaaatgaaaacgatcggaaatgatatcatttttacattagttttatgaaatggtatcggtatggtcagaaatatatgtatcattttcacccttatgcgatagtacttaccaccaaaattagtttttatggttcttttttgtacaaagtaggtataatatttctggcatttcaccaaggatgtacacatacgtatttgtaaacataaggatttcaatcatggcaagtagagtatgtattatatttctgagtgaattttttttttgcattcactgacttttatgattgtggaaatagtttcactgactttatatatgtggcattaaataactacttcctctaatattcccaattgatcatcatatatttttatgttattttcaaatgatgatcatattagtattcattcactaagtttattcaatatctctgtgtgagaataataaatatcttggtctgttagtgcactgcattgatcgagttgttaccaaattaaatatagtatggagagttattggcttttcttgattttcatgtacttctataaaatgtgtggatcaattagaaatggaattgagtatttattatctcccgcctcccgcaaagctaacatatacatacatctcaatcatcgtcataattatgaatttatcatacctggtcctgtgatgacgacacggctctagtataaatttctgtctgtttcaactcatggataatgtcatttatagcaggtctgctgtgtctatcaacctcgacgcagcgtacagctatttcaacgcattttttcacttgctggcactcttctttcgcgtgcattgatgtgtccccgatcctattcctccaattatttgcaacctacgaatcaaaatatgagcaatacatttgttgattgagtacacatagacatggttccgccatgcatgcatggtgtctgcttagatgaaaactgaacttgttcttctaagggcacccgcaatgggctctctacaagatatccatgttagtatattttcctacatggaagagattaaatgaagagagagagcaaaactatctactaacctggagatagtctatagagaaaaacgaggcaatgcattagaaagctatagatacccatgtagacatactattgaggtggtttactattaatctagtctattgctgagatgcacatgttttatagagagcaccttactttaccattgcgggtgctctaagggcagtcccaaccctccacctaggatggtgtctatggtattaactacattggcatgtaggacttttaacttatgtggcactatattaattaagagagagagtgaaaaaagaaagaaactgggtctcatgcaagatacagcttcaacacgagaacctatgcactagacactatcaagttttgtattgggagataatagtgtcttcataatagatgaagaataaatatgattgataaagaagagagatgatgtatttattaatggcccattttaagaaattacgggttatgaagtgtagtttctattgtgatgtcttattgacatggcaccatagacactacttatggacactatgggttgagactaccctaaagctacgagaggggttggcaacctatcctccccgttacgcaaaacaaagcatatattattgcatgattaattaagcattaactatttttttaaatagaattaataagattttttaaaacaactttcacatagaattttttttcaaaatacaatttagcaatttaaaaaatttgcgtgtaaaatacaagagttgtgagttggaaaagcaggggaagaacacaacctacgaatagacaagttccgctagccatgcacttcttttttacttgggatggacgacatctctctttgaaaggaaagttctccagctacaaaagacccgtgcttgttatgccttttttttattggtcacttttgactaggcacaaataactaggtaatcataacttttgcacaatatgctagtttcggcattgatatgattatttaaactagtactccctggatcctaaaatatatagtacttactccatttattttttataggtatttttttaaattaaaaaaactacttttgataggcatatttcaatctaaccacctaccatcttaatgactttctcgtatttaatgcgttgctctccattcttccacttaagattggttatatgagcatcgagaaatgtaaatataatgaattgcttgtttacgatgaataactagtagcatatttaaatggatgataagtagaattacttatccttggtcattgtgacaagaagaaatatgactatcaaaaatagatgggggagtaacttttagctactaatctgaacaaggaaaactgtttggctagattcatatctaaaatttgttatattttgggacagagtgaatacattgatgggttggtggaggtgaaattattattagataaggggtaataatatgaaaaaaattgcaaacaaattttgttgtaaaaaatgataaataaacaagaatagagggggtaatttcttacgagatcgacgaattgttgggttgatgacatttcgccatattttgagtagcctttatgtcccaccattatctggatgattataatacctaagctgaatatatcattcttatttgatattttacgttgtgccaagtattctggtgccatgtagtacctgcatcatatcatcagtgatgttaaacaaacaccatatcattcggttagtactaataagaaagaaagaggacatatctcttgacgtcctctctacttactctgaacctacgcaaactttagtggtatgtgtatgcgagccaccgaagggccttgataccccaaaatctgctatttttggcaccatgttattatctagaagtatattggccggtttcaggtccagatgcaaaattggttcttccaatcctccatgaaggtaactaagaccttcacaaatccccataattattttgtagcgtgtgcaccaatcaagcccgcgagactcttctgttaaagtggcaaaaaatattcttgaaatgtgaggattacttttttttgtttacatgttaaataattggatagagttcgcaaattaccaccatactcaccatgcagataattctccaggcttccacgcggcagatattcaaagcatagaactttgtatatcattttacaaagtacatcttccccattaacctccatgagttcatgtcttgcttcattgcaatagcctataaatcgtacgatatttttatgttgcaccctcataaggttgctgaattcattgctaaattgcacatcatcaagtcctcgcaagtcatatagcttcttcacggcaatctctgtcccatttgtcagcactccctgttgcagttgtatttcgatctcattatttcattaatatgtattactacaagggtacgccgtaagtgggttatcggagttcattattgataccacttgaaacaaagatatgagtatcatatctcacaaaccttgtaaacctgaccatagccaccactaccaactatttggtgatcggagaattttttcgtaatatcttctagaaaatgtaccggtagatcagttggcattgtacttggatggtttaacttctcctgtttacagatttgctacctcttcacctatatatacacatgaattattaaaactttcgtataagaatatttagagtttacataccttaaattaagatgagtgaattgcacgttattaacgaaattttcacccaagctagatataaaacctaaagataaatatttacatttattgtcatagtttctgggtagtcttttaattatataaataatatatatcaggattaatttaaaacaaagttgttctttttatgataatcctatctattaattaaccattttatgctgtattggtccccttccttccccagaggtctcgatttgtgtgtcattagaaactaatttggaagttcccaagcattttgaaaattttataacctttgatgctgtaacaaaatttgaaattatataaaacatgggaataatgtaagggaacattttacgaaaaataaaatatcacaggtacaaattcctattaaatttaaaaatatatttttcattcaatttttttgttagaaatattcaggatgcaaaatcttttgtacaaatataccatcggtctcgcacaaccattgcacgagaatgacgtgaaaatgacatcgtggccggtatcatacagtgaaagtgcgagaccgcgcggtctcgctcaagcaatcagcgctatcgcacaagcaaagagcgaaaccattcctagccgatttaattagcgattaattatcctgattagcgattaattaataattaattaatcactaatctggataattaatcactaactattattatttaattgttaatcaagtaattaattactaatcaaatggagccctttggacagtgtcgctgattgcttgaccgaaccgttcagtctcagctctttcattccgcgataccgtgtggtctcacgctgttgccgcgcgagaccgcgcggtcaaaattaaacgaaaagtatattttcaaatttagttcttcgtaatagtgccaaaatttccccacccgtttttttatttttttaaaaaaaatgttgtaaagaccctttttttagaactttgtaaagaccatagaaaacttactaggatgacatctttggatcatgcgtagagaaaaggtaaaatttattcagtgcatacactttatttgttcttatctttcgatcaattgatgatggtttgagatataaacatgtggtatgtggatgttgtactaaccaaagaaacaaatacacgagaccacttgcaagtaaaacagaccacacgctatctgctagctgtcatattgattcaagtgtatgttatcgaggctaactaccgttgcattagtacattttctttttgctatagagtcttttgatgacttatattttttaaaaaataatacagtaattacttaaaataaagaatatatgtatttacttgaaaatcatctctacactttgcttgtgaatttactccatatagtttcttatttcaactcaatcatgacgtaattacttctaatactatagagagttacttctattacatagcaaggttgcataaatgtttgaatatattcaagatcatcttgttttgtcacatattttaagggaagtacatggtgcaaatagatcataaaaataatatatgattaagaagatataagtcataaaaagattaaaaaaatacgtttttagctaaaagagaatttagtaggttgaagtgattgccgcattcttttcgggctattgggtttgctgattagctacacgtaaaacgagaaacatgattagcatatgattaattaaatattaattataaaattttgaaaattgaatttatttgatttttaaagcatcttttatatagaaagtttttgcacaaaatacaacatctagtagtttaaaaagtatgctaatgaaaaacgaggaatagataaggtgaactagctgtttagaacgccgccttaaccaagcaacgaccggtcgcgcgcaaactcacctgagtaagacatctcgttgtcgattaaggccctgtttagttcccacgcaaaaattttacaccatgtcacatcgaatgtttgaacacctgtatgaagtattaaatataggctaaaaataactaattatatagattacgactaatttgtgagacgaatcttttgagcctaattgctccatgatttgataatgtggtgctacagtgaacatttgctaatgacgaattaattaggcttaataaatttatctcgtggtttgatgatggattatgtcattagtttttttattaatgctcaaacaccctatgcgacaccctatataatactcgatgtgcacgccaaaactttgggcctgtttagatccctgccaaaaattttacgccctatgacttcaaaagtttgaatacctatacgaagaactaaatatatatagactaaaaaataactaattacacagattgcgactaatttgcgagacgaatcttttaagcctaattgcttcatgatttgacaatgtggtgctacagtaaacatttgctaatgatggattaggcttaataaattcgtctcatagtttactgacagattctgtaattagtttttttagtgcccaaatatctcatgtcatatcctatataatatccgatgtgatatgctgagactttacactcagtacatgtaagcaccctctaattcaatgcatctgcagctggatgtacatgcctgagcgagagccccacgccagcgcgtgcactatgcgaacacgacctgccactggtactagggtcaacaatatttgacgtcagtaaagcaatcggtttgaaaaaagaaacaccactccctttggagacttgacacttgtgatgggacgtgctccaagtctgcaaacacgtaccgtcatcatagctctcgtgacttttaaggctgtggctgtgttttgttcggtgccaacaaattttggaaatacatttaaagtattaaacatagactagtaacagaataaattatagatttgaactataaactacgagacgaatattttgaacctaattaatccatcattaggaaatgtgggttaccgtagcacttatggctaatcatggcgtaatcaggctcaaaaaattcgtctcgcaatttacatgcaagctgtgtaattggttttttcttccacatttaatgctccatacatttgtctaaacatttgatgtgacagaaaagttggatgtttgaaggaaaaaggttgaaatctaaacacagcgtgtgttcggatgccccttttcccaagctcgttttcctcacacatgttttctacactgctaaatggtgtgttttttgcgaaaagtttttatacgaaagttgtttaaaaaaatcaaattaatccatttttgaaaaaaaaactaatacttaattaatcacgcgctaatggaccactccgtttcccgttgcgcactgttccttgggaacaagcaatggtgaacacagcctaagtatattacttcaaaatataagagattttggttcgataagatatatcctagtgtttgcgtaagattcataatactaagatatatttctttcaactaaaatatcttacttcctatgtcccataatataagaatatttagagggatgtgacacaaccagtaaaatacatctatatggagagcctgtccagatataatgtactaggatgtcacatccctccaaaatcccttatattatgggatggagggagtatattttataaatttgtgcaaatgtaaaaatgaaaagttatacttaaagtactttagataataaagtaattcacaaataaaataaataataattctaatttttttataagacgaatggtcaaacagtgtaagtaaaatgtcaaaatcccttatattagaagatgcagggagattaggatggaggaagtatatggtattagtgttatttactagtttcataatatatataatctgataacaatttatttttcttctataatctgataatagaatcgtattgtgaatgttcttatgctttcctcatgtacatctttttctccagatcgaactagctagtatcttttgcattatacatctaaactaaattattttcattatagtagtctacatatttatcgatatgcatctaggtaatttaagatataccgatttagtttttcaagatgctactacaagattcctaacttttaccaagggggtttaaggtcggccacctataaaactgtcggccatacatattactgagtggttaccctcggcaacacgcacatgtggtcggtaatttatcatattgccgagggtaccctcggtaaccatgtacccgagggttacggtcggtctttttttccagagaccacgcatggttctttcttgccgacacatttcccgagcgtataccgtcggttattcttattctcaccgagaggtttattttcccgtcaaattgagaaccctcggtttctaatataccccgtcggacactaataatcatttccgagagttaaattaaacccctcatttactaatataccccgtcggccactaataatcatttccgagagttaaattaaaccccttggttattaatataccccgtcggccactaataataattttctagagttaaattaaacctctcagttactaatataccccgtcggccacttataaccatttccgagtggtatcttataactctcactcactgatatatcccgtcggccacatgctaaatagccgaatgttctcgtaactacccttattaaaatttcaaacggtcggctacctaaatcttcctgacggtctgtaggattttttgcttggacgcttggcaaatcttaggattctagtagtgagatcaataaaaaaaagagtgtatatgttaactttaataaatctgtgttcaaaagaatgcatagagttggcgtccaaggctggcatttcttttgggtgggggctcgtagtccaccgagttcatgttctttcttggcaggcacacaatcccaaaacaaatcagaactcgaaactctagctagctatgtcccatctgccgaagacattgtcgttgtcgccgtcaccgaatacccgcagctcgtcatcactatctccgtcgctactacccctccgccgctaaatctgtgcaggggagagccgccgccaccggaggagcacgggggagactattgccgccagatgcgcacgggggagggccttcgccgctagatccacgcggggcaaggctgccgccgtctatgcgccgctcctctgttgactgttggcctgcgcttgagcccgccgccgcccgctcgctcctaccgtctctgccttggccgccggagaagagaagtgggagaggggagagggaagtagaagagatgaggagagggagtggagagagatggcgtggaggagtgggggagagaagaagagagagaaaaagatgtggtagagagaaagattgtttttaatatatctgccacaccgtttacatattgattttttttaattgacgagggagtgcggtagatccgatgatcctggttcactcgtagacgatagatgaccacccaaaaagaatcttggtcgctcagaccgttcaatggaaaaacgatcaaggcagtagactttttcatgagttcttgaaagcaactattggtttttatggccaatttaatttgttgcagcaaaagtgtggctagaaattactaaggcttgccatcttaggcctggtttagttctcaatttttttcttcaaacttctaactttttcatcacatcaaaactttcctacacatacaaactttcaaattttacgtcacatcattccaatttcaattaaacttccaattttaacgtaaactaaacacccttagttaaagaatgcactaaaattggtctcatggcatgtgcaacaggcctgttaccctatacctatataataaatgagtagtctgttggaacgtaaaaattaaaaaatatatataaacaggagaaatgtagaaatagaaagtcatggcatatacaatcgccagaaattgaaacactaaattttgtcgaacaagttgtttgaatacttcatagggaattcatagtaaaattatagggatgatattatttagatagagttgagaggaaagataaagatatatagtgtatagtattggatttctcaaaggaaatcaaaaccaaggtttgagcttatatttgaaatcctaaaaaaaaaggaaatgaaggattcctatggaaaatgtctagccaaatccaacaaaattcctataaaaaatatcttgatccataggaaaattttcaatagaattttaatatattaggatagtggctagataggatttcaatcctacaaatttcctataaagtccctggaaacacagggctcttttggaacgcaacaataaaaaaacatagaaatacgatagaaatgtacatgcaaaaacataggattgaaatgttgtttcgaatacaagaataaagtaaaacacaatattctttctaaacaaagaagtgtatataggggtgtgtgtgtgtttccttaatgtgtgttcaaaccgtgatcattcgaagcgacacgcattatgtctttgacttcttacaagaaaagaaaacaagaggtcctaatgcatgctgaaatttctatgaaatcaaggccaaacgaaaattttgtctaggccccgtttagttccccaaattttttccaaaaaatcacatcaaatctttagacacatgcatgaagcattaaatatagataaataaaaaactaacataagtgctacagtaacccacatgtgccaatgactgcttaattaggctcaaaagattcgtttcgcggtttccaggcgagttatgaaattagttttttcattcgtgttcagaaaggccttccgacatccaatcaactatccgatgtgacatctaaaaattttcttttcgcgacctaaacatgccctaaattttctttaccttttccctccagttcgaaggatgcatgaatagtaactcgatcaattctgtagtaaccgagacctccaatcctagggaaatctccaattaattttcctttagaattcctccgatcgatctaaaggaggcctaatatcatgcaccatcctagctatagcatggaatgcatgttcatgaagacatcgatttaaaagcttaagtttgcacatatttacaaattacaataggttttcatatacttgacattaacctgtccttcacgacgctagctaagctctcatcacgcacatacatgcatgaataatatatatccacacagcacagatctaaatcgttgcgatccaaaagataattaggagaactcgtcaaatatagggaaacattcgatatatgaaatcaacgttcaaatatatatatttatgtacttaaaaaggaaggaaaaacaaacagatcctcaccgcttggtggagctagcaaccttggtgggcgttggcgcggaggatgatataatacggcgtgcaagctaagctaggcacggctgatcagtgagcaaaatcgatcgtcgaaattaagctgggcctctgtgccgggtgtgtatatatagagtgtacgtgtgttgtttctggttcggtcgagttgtacccccgtaccgagaatcgtaacgagcgatcgcttgcgtgaggaagtggatagcgattggttggtgggcctctcttcccagtttccactagttcctacgttgcttttttttttactgtattactttcctatttcagtaagtttatatattttaagtttacacatttaaagtttgtacggttaaactttatacacatagagtttatacgatgaaagtttatatactggatttaaactcgaattcaaatttaaatatattttaagcaatcggttggtgggcctctctttccagttcccacatcgctttcttatattttggcaccacattaattttctattttagtaagtttatatattttaagtttacatatctaaagtttgtactgttaaagtttatacacataaagtttatacgataaaagtttatatactcgatttaaatttgaattcaaatttaattatattttatataaaatatttatatacacatagtttatatgtacaaagttagcaatgtatatgtatatatatatatataaagtctatgtaaataaatagtttttagtgtaatatatttttcattctcttttttcacacttattttcaaattgattttaaatttacgaagaacccacgactaatcgcctaacgtcgttgccttttttttttttacgtgaggaaaccgcgtgcgggcgtgatttctgatcgttggcctccggcgccagcgatcgttcgcgcagtagccacggccagttgtaatgtacgagggaggggagcatcgaatgagagacgggggtaataattactagattaattagttgaccaaaaggcatggaacgagacgggagtaataatcaattaacgcatgtgcgtcagcaccgtaagagcaagtttgaaagtatagcgactgctaactctaaatcatctatagtcaatttaatatgtaatttatacaataattaccattataaatatataatcctacctaccatatacacattgtatcttagagtctatactatagatgagtataaatttgtagcccgctactcttctcccctattttatcctctcaacatttgtttatagccactactgtacctgctctaaggttgtgttcttcacccttttttctcaactcacatctatctttttctgcgcccacattttgtaaaatgataaacggtattcgccctccgcaccagaatataagaagttttagagtttgacacaggtattaaaaaagtaggtagaagtgaatggtgcagggttgtgattggatgagtagtggaggtaggtggcaaaagtgaatggtggagggttgtgattggttcggaagacaatgttaatggagaagttgttatattttgggataaatcctgagggctaaaagttgttatattttgggacggagggagtatgttttcctaaaattttctatggtagagttgctttaaaaagtcgtgttaatccatttttcatgttttcttttgactggaaatttttcaagtcttttaagctaatatttaattaatctcgctctaatcttctcctcccgaactcagccagtcagcctaggtagcatatctcgcccaagcgtattactaagcccgcgtttagcatgtactctctccgtttcacaatgcaagactttctagcattgtccacgtacatataaattttaataaatataaacacatatatatgtctagattcattaacatctaaatgaatgtgggcaatgctagaaaatcttataccgtgaaatggaggaagtaacttattataataacaaaaataatgtaaataactaagagtccaactgaaagttttaaaatattaaagtcgaaagttctgaattttgattgtttcgacagttgaattaaaaattttaaattttgagttgacagttttaaaaattcgagttaaattttcaatattttaagtaaaaaaataattttttttcaaatttagaaactttttgttgaaaaacgtcttataaattttttctcaaattttacaagtatttaaaaataattgtagagtttaaataaaactcaaattaattaaaaattaactgtgaaaaaaatgtttaaatagctttcatttattgtaaactgcttaatataaaaaaaaacacttaaagaaacgtttgcttcgtatcaggccctcaacacaaaccagcgcgtggcaacgcaagatttagtttttccggtcaagcacgacggtaccaggctagaattaagttttgtgaatgtgcaaacatccgtgttgtactgtaatttgttctaaaggaaaataataaaaatgaaaaaaaaacaagaagaaaaagaagggaaaatcgctctcgcggacagcatgttcgccgtcaagcggacggtcgatcgaaaggtacgtaccgtagaccgtgactttttttgtacggagggagcaggaaattaatatttgtaggcctcgacttgacttcgaatctttaacacgacccgcgcggcttcgcggaagcttcctcactgagtaccagtagcaatgtgggggcacattacatgtgaacgttttcctggtgtcttggcggcagtgagccgcgaagccgcgtggtcaccttgacaaggccaagtggccaacacgccgcgcccatgctgtcacgtacgaggatgattcgcggaccggcgaggcggcgacgcggacttccttgcctcgccatcgacatccgccgtgtttaggcctggtttagttactgctctaaactttttccttaaacttttaactttttcaccatgtcaaaacttttctacataggatttatttaagggctgtttgatacagctccaactcctaaatattactccaggagttaggtctggagtggagttatggagttgcctaaacccagctccataactctaatatattttatgagagagctccacccaaacagacccttagttttaatagagctgaaactgtttggctgagctccagctccaggaggggtggagctgaagctgaagatgtgccaaacaaacccttagttcacatcaaaattggaagtttgattgaaattggaatgatgtgacggaaaagttagaagtttatgtgtgtaggaaagttttgatgtgatagaaaaattggaagtttgaaaaaaaagttggaaactaaaccaggccacacgcaaacttttaacttttccgtcacatcgtttcaattttaatcaaactttcaattttgggtgtgtttagttcacgccaaaattggaagtttggttgaaattggaacgatgtgatggaaaaatttaaagtttatttatgcagaaaagatttgatgtgatggaaaatttggaaatttgaagaaaaattttggaactaaactcggcctttggcgtgaactaaacatatccttagattcaaaattttttcttcaaacttacaacttttccgttacatcaaatgttagacacatgcatggaacattaaatgtagatgaaaaaaaccaattacacagtttgcatataaatcacaagacgaatcttttgagcctaattacgccatgatttaacaatgtgtttctacaataaatatttgctaatgatggattaattaggcttaataaattcgtctcgcagtttacagcgaaatctgtaatttgttatattattagtctacgatcaatactttaaataggtgtccatatacttggcacacaaactcaacacagccatcgaagaaaaattttccattgtaacgtaaaaccttttttcttttaagaaccatagcgtaaaacaggtccgccgatagcgtggcattcgccttgcaggtataaagcggaacagtttattagcgtgtgattaattaagtattagctattttttaaaaagaaatatattaatttaattttttaactaactttcgtttagaaacttttaaaaaaatatatatcgtttagcagtttgaaaagctgaaaataagagagagtggttggaaaaaaaaaaggcatccgaacacaccaaagtaccgcacggggccggacaggggcgtcatgcagcagtggtccaggcggtatatggtcgcgacgtcgcaagcgcaggcgagcgcgccggccaacttgcagcgcgacgactcgtccctcctgcggagcaagagggtggtgcccggtgccgtggtgggcgatgtcggttgcgccgcggacgacgactttgcgcgcggaagacttcgaaaatgtgagtttttcttttctttttctttttttaacggtgggagtatagcactagctgttgcgtgtgtcacaggcccagcggcaagctatagatagccggagttgcatccatatctagagcacccaagtgcaagttttgtgttctgtacgagacaacttgcccttcttctggtcctctcaggtctcagcaggttagtcaatcgcgagaactgcattttttcccctcttccatgcatgctaatcaagctgatcttctagctttatcttctagatagcctcgccatttcttttgcatggtttcccctattttttcagattgatcatgcgagaaatccgcatccacacttttttttttgtttttctcatttctcctagtcatggcatcatgggtacaatagctccatcgtccggccttcattgatgtgcgtttcaaaaacaaatatgcatacaagtaccctatgagattgagagtgcaaccgtgtgttatcaattgtttaactatatacttcctctgttttaaaatgtttgacactgttgactttttagaacgtgtttgaccattcgtcttattcaaaaaaattaagtaattatttattttttttgtatcatttgattcattgttaaatatacatttatatacacatatagttttacatatttcacaatttttttaataagacaaacggttaaatatgtgctaaaaagtcaacggtgtcaaatattttaaaacagagagagtatcagattatccccaacatgtagttatgagaatattgctttgcaatagttatgcttacacactttatagaaggacagtaggagataaatggatgacaaggagaacacgttagagcatgcaagagtgatgcccgtggaccttacatacaaaaagttagaagaaattacaaatggtttctctgaggagcacaaagttggcagtggtgggtatggagttgtttacaaggtatggttcatacttgtatttctatttttttgtaagtaatacaatatatactaccattaatactgggccaccagaaccctgatgccatatatgaaacaaattaaagccacttcatcaaacagggagtactggaaaataacacagagattgctatcaagaagctacatcaaatggtaggactggacgatgtgcaatttaagaaagaatttaataaccttatgagggtccagcataagaatattatagggttagttggatactgctatgaaatacgacacaaacatatcaaggtggatggagattaccatttttctagaatggaagaaagagcactttgcttcgaatatttgcaccgtggaagccttgacaagtatctttctggtatgacatgcatacttctcaatctacatggactatacatgtactattttgtaggtaagaaatagtagtgccttgcatttacatatatcatatggtactattatttttgtttataattatacagatgaaacatgtggacttgattggcacacacgttacaaaataatcaaggggatttgtgagggtttagattaccttcacaatggtcgtccagaagatcaaattgttcatttggacttgaaacctgctaatatattactggatgagaacaaaatgccaaaaattgctgatttcggtttgtcaagactctttggttcaacacaaacttttacgacaagaacttttattggaacagtgtaagttatgcaagttgattcattgtgaaagttccattgatttctatacccttttctaatcattaacaacatgcagtgggtacatgccgccagaatacattgagagacgccatatctcaatgaagtttgatgtattcagtttgggtgttataatcatagagataatggcaggacaatcgggccgttctacaagtgctgaaatgtctccccaacaatttattgatactgtaagaattgttttttttttctcaaactttttatcattcactttctactttctgctttattattcactttggatttgcaaggtacaagagaaatggaaaaagaggatgcaggaaatttcgagtcatacatcatcacatgaggcagatagcctagaagtcaagacatgcatcgaaatagctgtaaggtgtgtagaacccgaccgaaagaaaaggcctactctgagggagattattgataaactgaacgagttagaaaatgtgaggaaggcacttataggccaggtaacgtgacattcgccatcacgacatcgcggttatgtctaattcaccagaaaattgcgtattttcctcctttcttcagcttatgacttaaatttaatttgtcaaattatgcggactcagcgtatataatgaacttgacatttactaaggaagaaattaaaacaatgctaggatacatttgttgattggtagctaaatatttaagtaaggacttatttggttaatctcacccacaccgcaagaggattgagaaagatttagaggggaataattccatatctattaaggccctgtttctttcagtttgggattattataatttagattattgagtcagattactataagctagattgttataatctgtagtataataagcgattagttatttctttcctagattattagagcctagattattgggtttgcaagtctaaagagggagtggggtggcatggtgggtaattttgcacccaataatctagaaaaagctcacctaaatgagcttatcagattataataagctgggctccagattataataagctgggctccagattataataagctatagcaataagttgtctgtttctttcagcttactccaaataatctggattataataatcccaatctgaaaaaaaacagggcctaaggtgtgaatttaatcatatcccctcaatccactccaactcctcccttattagggcatgtacaacagttagagataatatggtttttaatcattaatgtatccaaatactttttttttctcttctttcctttctttcactatcatgcaacaaaatttactctaataaatgctaagagtcgactctgagccgttgtcatgcataacaaccatactcctttctctttcttccatgtcatcaaattacttgcatggcaatagagagagaccactaataaaaaccgttgtacatgcacttaggattaactgaaaaaggcctaagagagattctggcaaggttccacattttgttactcagttttgctaactcactaatagagaaccgatctttcgtagattaaaaaccggtattaaagttgctttactaccggttctaaaagtccaattccctataaacaactttagtctcggttgatgttactaaccggtactaaaaatgcctccagagttaggtcaaaaggaaaacgtctctattcaagtcagatgtgtaaatatagttggtgagatggttatacgcgtgagagataaggtgagagatcttgagtttgaatcctacatcccacatattttttttctcttgctatatgcatttttagttttaaccggtactaaagatcgacatctttaatcccaatttgctcatctcggttgctaccaccggtagtaaatgtggttgtaaaccgggaaaaaaaacgtttcccctgtagcgactgtataaactacgaagtgacaagtgactgaataccaaattaagcctagacacagggactagtatgtatggcaagctaggtttcttcttgagtatatagtatgatccctctgatcgttgtgacagagctcagctgggtgtaaatcggagcgccttgtgatcgaccctctggaggtgcgcttcccatttgagaaggacagggatgtatcctgcgtgctgcagctgacgaacaggtccgccgatcgcgtggcgttcgccgtgcaggtggacgagtccaagtaccgcgcggtgccggacaggggcgtcgtgcagccgcggtccaggcggtacatcgtcgcgacgtcgcgagcgcaggcgagcgcgccgaccaacttgcagcgcgacgactcgttcctcctgcggagcaagagggtggagggcagcgccgacgacgactttgcggaagacttcgaaaagctgatgggcaaggcggtggatggggagacgatgaggctgccggttgtctatatcgcactgcctctacctcctagcagttaagcgatttatacgcagctgtctgtcctcatgtatcagagatccgctagctagtccgaataatgtccgatccgtcgacatttgcgtcttaacagcctcgtgatttatatatatgacttttgtgaaactaggaagatagcccacgcatatgtgcgggcatttgtttaatgtgtttatgtgcagttggtttttttattgaaatatcatttatactctattcaaatttatttgagatttctatgaatgttggttatgattttcttctagcttgttacccttgcaacataaaaatttggtaaaatttgctacgggacataaaaaaagtgtaattagccaggggataccggaaaaatatgtatttgctggagaacaaaaaaaaactggtaattagctgctggacactcgcggtattattttattatttcagaagaaaatagagagataaacagctgtggaattacggttttacccttcaatccagtcaagtttcactcccctgtgggacacaccagtcagggatctttttttactttttctctcctattctactccttcctttcttcttcatgtcttcttccacaatggcctgtacctccccatgaccccacccatcgcggctctcgtggcgccaccgccggagtgcgacaacacgcaggacctgccccggatgttcgtgttgctcaccccgaccgaatgcaacacgtcgctcacctacacgcagtggaaggaggcggacgcctccatgcgccaccgactctcgctcaatgctcgtgccgtgctcggctacaccgcgcagaggatctttgcgcggttcacggcagtcaccaagctcacgctcagctgcgtcggggctccgggacagacagcctctccgacgacgcggcatgccaagtggccatcgcattgctgtccgagcggctcgccaggctcaagctccgtggcctccggcacctctcggacgacaggttcgcgtcgctcgctggggccacaccggtgatccacaagttgtccatcgcgtccagcagttttgggccctaggccttcgtggcgatcctccggtcgttcgtgtcctctctgtcaagcgttcacggcgtccggctgggagcaagagctagagagtggagaccacgacgagcggccaagcattggcggtggcgtgggagaggcccacgaggccatggatgcagccggggctggagacggcgaggagcagactgggggagccgatgaggaagggagttggtgaggaagccgtaggggcaaacttatctttaatggatatttctccctctattttctccggaaataataaaataatatcgcgagtgtccagcagctaattaccggttttttacggtgtcctccggtagatatgcgttcttgcagtgtctcttagcttactacacttttttaaatgtcctgtagccaattttgcctaaaaatttgttaactaaaattgcgtgaaagcatgcaattttgaatttataagaaaatattgtgttattacaatgaagttggtttctatgaaactatatatattttgtactatgggtatttctatactttaagtaatactacctccgtttcacaatataagactttctagcatcatccacattcagataaatgttaatgaatctagactcatatataagactttctagcatcgtccacattaatacagatgttaatgaatctagacacacatatgaatctagattcattaatatctatatgaatgtgggcgatgctagaaagtcttacattgtgaaatggaggaagtaattgcttttatgctatctatgtctttgtggattttaggataaattaatttaagattttctattaaacatatagctaatagaactatgtcatataattaaagatagattatacttcgccgcataaatgcgagaaagttaaatttagcatgcagtagtgactaattaggtggaaacaaaagggggcggcgtctagcaaaatctagcatgtagtagtgactaattaggtggttcaggctctagtagaccaatttggtcccacattgcatattttctttagataatggaatagaatcctagcctttacttaaagagttacagccaattattacgccaattcgaccaaacacaaaacgcaacacaacaaaccataaaaacacaagcgtaatagaacaggagcacacgaaaactactaaaagtcaacacaagaaaagaccacaagattattgaattttatttgtgaattttcatccgaagttggcaaaaagatgcataaccattgactcaagattacaacctgcagcttttattagcttgttatctacattacacttttgcagttgagcctaggactggagccaatgtgtttcctaaaaagaacctgcatataaaatatagatggtgatttatcaaaaccaaattatttctactgaactatacagcccaacatatattggatgttcctaaaaaataagtttactggttttttttatcaatccccataagcctattctaaaaaaataagatatactaagtggaatatttaaaccagaagaaaactatagtgctctccaaagaaattttgcttaatgacactccataaataaatgatggatagttttatttttcatgcagaagcaatattttaaactatcatgccaattcctcctagccaagttatcctttattaacacaaccccttttaacaggtgttatataaaaatcttaatcttaagaggcatcctaattttctaaataaactcattcttctcaatgtagccattattaattaaagctaagtacatagaacgaatcgagaattgaccatttttatgaagattccatctaaaatatcattctcctctgtcaaatgaatatgcacaattgaaccacacaaattatgtaagttagtcaggttatgccctactagagctttctaaaaaaaaatattctgtgaaacataacacataatatttgcaaccgaggagtttctgcttcgaactatagcatataaagatgtgtatctatcattgaaggtatagtttcctacccattgcgtattttatcaagcgaaaatttgacttcgtctttttcatcattgagacggggagaaaaaagaagagaaacctagctatctgttcacctatttgttctgtttcgtgttgatacatatgaggacgataggaccacccaacaattaattaactcgactagtataacactaccagatatcccctgtttattaggttaggtgaagatcaaaaaagcagtaggaaaacagtttcgctaccaatcttttgaacaagcatgattgcaaagacccaaatgactcgtagaacagtctacccttgatgttacaaggcagctaaccaccagaattaagacgacgaaatgcaaagacctgatcgtcgaagacccgaaccatattcattgctaaacctggtcgtcgcttactcgctttccatgtctcgttgcaattatgttgggtgccgagaaaaaacttgtgcacacatatacacatggcctcctccggttaacgccacaaatcgccaatgtacgtagcggcaaacaccactcaatccatcgcacactagctagaacacaagaaaaatctcagccccgatcgatcgaaatccatggcgttccagttccacacgctactatcagccgtaacaatatggctgggcgtagcggctgctacggcgaggctccatgccgccgtcgccggagcacgagcgccgccgccgccgccgccgcccggcaactgccaaaggaagtgcggcgacgtagacatcccctacccgttcggcgtctggaacggcagcgagtccgacggctgcgccgttccaggcttctacctgaactgcgacgtcgacgacaaccacgtctacaggccgttccacgggaatgtggaggttctcagcatctccctgccgaccgggcaggcccgggtgacgaactccatctcctccgcttgctacaacaccagctcccgcgacatggactacaacgactggcagatcaacttcaccggcacgccgctgacgatctccgacgccgacaacaagttcaccgtcgtcgggtgccagacgctggcgtacatcaccgacgacgacaacatgggcaagtacacgagcgggtgcgtcgccatgtgccagggaggcgacctgacgagcctcgccaccaacgggtcgtgctccgggataggctgctgccagacagccatccccaggggtctgaagtactaccgcgtcaggttcgacacgggcttcaacacctcggagatctacaacgtcagccgctgcagctacgcggtgctgatggagtcgaaggccttcagcttccggacgagctacgtgagctcgctggaatttaacagcagcaacggtggcagggtgccgttggtggtggattgggctatcggaaacgagacttgtgataaagcccgcagaaaggttgacacctatgcatgtgtcagccacaacagcaagtgcttcaactcgtccaacggaccaggctacatctgcaactgctccgaagggtaccaaggtaacccctacctgcaggacgggcagcacggttgcacaggtatgaaaactgatccatttaagggtgagagaggaattgtatacgtgaatatatacacataaacaaatgaatcacatagccaagtgagaattggtgtggatatttcttgattttaaatgcttttacggtactcatttactagcagaattgaaatatataacagttgattatcataagcatttaaaaagtttagccaatgcaaggtaattaacattcatctactgtaatttggaatgatttttcaatttaatttattattttattactatatatttattttaagttcaattttaccactttaaaatttgtactacactaattaaattttgaaatatactttatcacaattttacgggaatttactagctagattaaaaaatatttaaatatacccgattcgcctcgagaaggtgacacctggaataaattaaaaatatatatctatctaattaacttgtttagttgtaatatcaagacagttaagatgtactatatttccctacactttttaacatagcttatgagagaaaacatgcatcagaattttttttttgcctttatcttttgattagtttagtatgagtcacagaatctgaggttcattatattattaatatatgattaatacacaaaacatcacaatttcccacaagaaaatcatattgcccatgtatatatgatagcaaatcactgtttatttttacctatgtttgattaatgcagatatagacgagtgtgcggatccgaagtacccttgttccgtgcctggaacttgccataatcttcctggcgggttcgagtgcttatgccctcgcagtcgtcccaaaggcaacgcattcaatgggacatgcgagagagatcaaacccttcatactggaggaaaagtagctattggtactccattatcctcgcttatcattccaagttctttttccttatccaaaaatcagtagctaagattttccttatgttaggccatagcatccacatgttccacaccagtttatatggattctccacaaaagaaaacaaaaactaattttaatctgtttgattagtcatggaccccaaccgatacgtcactctcagaacttttcagaaaaagaactgaaagtgtaactacatagagttctaaaccgttagtccgttacatgatgtcgacctgtaattaacttatttatttggaataggaagatgattgcatccccgcctttgcatttaggatgtacagtacacaagcatgcagtttaattttgaaagttttttcttaagataaacagtatctgtatatgcagtgctgaagcacttgtttcaattcaacctttagtctcctttacaaatattcatttctgcaggaatttccggttttgctatcgttggcctcgttgtttttcttgtacgagaagtgatccagcacaaacgaagtatcaaaagacaagctctgcagagacagactgacatgtattttcaacaacacggaggacagatcttactagaactgatgaaagtagagagcagcgctgagttcaccctctacgacagagagaagatcgaggtagccacaaacaatttcgccaaggagaacattgttggcaaaggagggcaggggaccgtttacaaggctgtcctcgacggcaccactgttgcgataaagaggtgcaacgaggttgatgagagcagaagagccgacttcgtgcaggagctggtcatactctgtcgtgtcaaccacccaaatatcgtcaaactagtcggctgctgcctgcagttcgaggcccccatgctaatctatgagttcgtgcagaacaagacactgcaagagctactggacctccaaaggagtaggaagttccacgtcacactggcgacccgcttaaggattgctgcagaatccgccaatgcacttgcacatctccactcactgccgcgcccaatactccacggcgacgtgaagccagccaacatacttcttgctgaaggattggttgcaaaggtgtctgactttggttgctcaacgattgatgagaaaacccaagctgttgtaaaaggtacaccgggatatctcgacccagactatctacttgagtaccagctcacagccaagaatgatgtatacagctttggggtcattcttcttgagctcctaacgggtaagaagccactttcaaaagaacggacgagcttgatcccaatatttcaaggggcaatggaaagtggcaaactcgttgagctcctggacagtgacatagtagatgaagccaacatgggagttatctgtcaggcagcatcactagctagtcaatgcttggctaatccaagttcatcaaggccaacaatgaggcaagtggcggagcagcttcgacgactagcattggcagatgaagtacaacaatgcccacaaccgccgctagtgctcgatggcctcatcctcacagagatggggagcacaacatcatcatggtacacaggaagtggaacaagcggggtttataaccttgagaacaatgtcgttctaagcacagaattcgctagatgatccatagaccccttgtgctttattgagtgttacaatgtgttgttttatctgtgttagattatgagttgtgttgttttatctctgtgttagattatgagttaattcttcccagttgtggtggttgacgggcttcccaatgtgtgcggctgtaaccatgcattgtgaggaacaagtgaaacaatcatgtttcacaatatataataattcaagtgcatcaaacacaagtagtggtagtcatagatcaaaacgaaattatctgcacaaagtttgagtttgctattatgagtcgaggtctagatcgtccagtgtgaagacaacaatcctgttgcaatcaattggtgaaaaagatttgatgagagtaggaaaacagaccttggacgcatgagatatactacatcccgttttcaatatatatccggctagagttaatgtaacatcctagcctagggcttaataggattactagaatactcatagttgcaacttcttttccggaagccgatttccaaagaactccagggttaagcgtgcttggcctggagcaatttggcatgggtgaccgaccgggaaattcttcccgggtgcgcatgagtgaggacaaagtgtgcagaaaagacatgtgttggtctgtgagggcagtctgtaacctatgaaagctatcagatgtaagtgggcccggcctgggggaaggcgggacgttacaaaatggtatcagagccgactctcgcggtttcacgggcgtgtgtgtcgcagttgcgcatggtctctcgcggtttcacgggcgtgtgtgtcgcagttgcgcatggctggtgtggatccggagtggtcacacagcatggcacatgcgctggcactggacacacggacgtggccaagaggggacgttcctggcctggggttgatcgacgggggcgtcgatctctcttaagggggtgaggatgtaacatcccagcctagggcttaataggattactagaatactcatatcaacaagttgcaacttcttttcaggaaaccgatttccaaagaactccagggttaagcgtgcttggcctggagcaatttgggatgggtgaccgaccgggaaattcttcccgggtgcgcacgagtgaggacaaagtgtgcacgcttaacctggagcaatttgggatgggtgaccgaccgggaaattcttcccgggtgcgcacaagtgaggataaagtgtgcagaaaagacatgtgttggtctgtgagggcagtctgtgacctataaaagctatcagatgtaagtgggcccggcctgggggaaggcgggacgttaccattaaccaatggattccttctcgtattgctaaaagttgagaatctctttatggggagaagctatacaggttaacagaagaaagtaaggcacaacctgcttttcaactgtcacaccctaaaaatcgctaaattataaattgttgtgaaaaaggaaatttttagaaattatttaataaataaagtaagtgtttgaataaaatctatgaaaaattttaacattaaattgagctagataaaattttattaaataatttgagtgtccaagtattttccggatttttcccggaattatttgagcattggaagtatttttaacaaatgaaacatcatttcagcaattatttaaaataaaagttaattgaaatcctctccctagtcttgggccgaattcggcccacgcctctcctctctcccatccttggcccgcagcccctctctctcggccgaagactgctttagcttcttcctccattccctctgacgcaaggggcccacccggcacagtgccgtcttcctccttcagccggcctcccgtcccgtgccctcgaatttcgtctcggttcttatcccgacgaactcgggataaactctaaatttccgccgccgtttcctctcgaatgcgcatcgatctcttcctcctccgcctatataaaggatgacccaggtctcctcttcgtttttcccctcttttcccatgctgccgtgccctagtcgcctctccctcagctcgccctctctctccaccatcgccgccaactccagccacgccgcgccgcccctctggtcaacgcgggcttgcgccttcgcctccctcggctccgcaaggccgagctccaccctggccgccggttcctttgcgccgaaaccccgccggaagctttcgtcgccatgaaccagtgggtcgccgccgtgtttcgatctctagccaccacccaccgtggactccatggtcgccagaccttgtcgtctcgtcctttggcatcacaaggaccccgggaagcccgtccaccccttctcctccgccggagttcgctggaacgctggtgtcgtcatcatcccgaacctcaccgccgctgtaagtgttggtaagcatcgccgtgtcctcctcttcctccccattctataggcttccgtcgtcgtgccgctgttcgccgtcgccaccgccaccgctgtccagagccaccggcgtcgatccagcgtggctgtcacgtcatcgccctgttagccgccaccgcattgccacgttgtcgttctatccacatggcatctgcgccagcgacacgtgtcaccacgtggccgctatcctaaacgctatattggatttgatctcacctgtcagatcgtggtcaaaggcctgtcaaagcaatcctagccatccatcccgtggacccgtgaactatctttgtggacttggttcatggtagacccagtctaccgcttgtatctatgacgagtgggtcccatctgacactagccctttttctctcttcctagggctgacgtcatattcctcctttatcacttctaaaataattaaatatgatgtcataaattacttagttgttttctttataggttttaattgattaaaacttcattaattcataactaattcatatgaacttggaataaggtcgttcaagtctcaagatctacctatttatgaactttcattgtactgtttatttggtttttattagtgttttacctcgttttgcgttctaggtttagttttcagtcgtttcggaggctcgttcatccattggagaagttcctgaagacgaattgaagacgcttgtttgcaaagcaagtcacacagatcctaaacacaatcctttgagtatattgaacctatatttaaattctccatttcattcaaatgtgcatttattttcaaatgtcatcgggatgtgagccttttccctatattaaggcataagatgactttattttcctacgggttataatttgactagcttgggccttacatatttgttcagctagatattagatataattgcttagccatgcttagaaacattagcacactatgggattcactctaattcagtccttaattatatcatgatgtaccgttatggtattgatttaattaaactaaatacgcttaaatggtgggttgtgggtgcatggtttgatagtcacaaccataacaattaacgtccgattctcgaaatctctggaagatatacctgtacttaccacatacctgcatgggctctaggctaaacttggagtgtagcttaacctagccaatgtaccaaggcaaggatggacgtgatggagtatggatgttccgtgctgcggtctatgctgcttccggattcacctaggcacaagagggggatgcccgctgccttttgaggagtgggggtgaaacctgaggtgtgtatgattggttaggaagggttatacaaaaggttctgtcacagtctctttcctgtatgtcgtggtggcatgttggcgcttggtaacgtgttgtgaggctgtgtcttgtgggtaaagttgtacacctctgatcaaagtaaaactattcgaatatccatgcccgcggttatgggcggtcaaccagctcaccgtgattattctcaccttaataatttgacatattgaactgagttagtacaggtggtttggttgggcctatgcaacgagtatgttgtatagcgttggattaataatgtttaattaattgctgtactattttacaaatacttaactctttgctaaatgctgctttcacaaatgaaccctatattatgccatcctttggtatccatatgtacttgcatacttgtcgtgtggcttgcggagtattccatgtactcaccttgcaataatcaatcaaacctcggttgaagaaagaggatccagaaggagaagacctttggcttaaatcccagttgagctgcttgtgggagtagtgttgaaactttgctagattttatgttctgctgtagttttctccgtggtaataactaagtacctcttatgtaagtatttatcgcattagttattatgatgaatctgtatattaagttgtcagtttgtgtacctcggttgattcctggacgaggatttaatgcacaaattagtttgaaaattacttatgaatttttgggcgtgacaagttgacatcagagccatctcgattgtaggtcaagccaaacggttaaacccataaggacatgtctttgccaaaacaaaaagtgcatgtttcgaagtcaagatggaggcccaaaccaagtcgatttcgagtacgtttcggagtcgaggaccagtatgcactaaaatgggcgcccaggtcgcattcatgcttggattggggcgttctttatgcagatggaaagctaagaaaataacctttccaatggttctagtcccatattcaaattctttcctagtcatcgggaatcgagcgagcaagttaacgtccagaatctgttccggtactgcgccgccgtatttttgcctttcggccgcgtatcgtgttggagcccattagggtttgcacgaccctaaactttatatattagtagcagcctccacctttagggtttgggttttgcttacattaatatgttaagaacagtttcatcgatccttcggtttgtaagacctcaacttgtgagcttaatcattcatatacaatttggttgtattctttcttgttctggtgtgtgttcttcgatttgcaattagggattagccttctcagcgaggccaaccgggtttcgacacggttgataaccagaggagacgtggtgctgcgattacggggctcaagagcgtgttcattcagaagccggatcaatttgtgtcgcgactccaccaaatcgactgtttatcacaacatttcggaagatcgggtaccctacatccacatcaagtggtattagagctccaggttatactaaattagtttttgttttcgccgtaatcctagagtctacagaaaagccaaaaaacaagtgtagtcattagtttcttcccatcccagacagtgtttagcctttgcataattctttttcagagtctgtagtgttgagttttagtcctagtttaagtttttgttgctggtttagtgcgtgttttagtctaggcttatgcgccatggattggatggcaaggtcgatcggttctgatgacgtgtagcagatcgatcaaaggtagagcccgactgggatatggattggattcatgttggatgagttttgatattgtcctactttgagcaggagatattcggtataaatagggagggagactatgccttgagtaaaaccatgtttgagagattagatagggtttcgtgagaaacttgtgaggggtgctaacgtgctgtggctgcaccctgtgaacaatacttgagtaataaagaacatattcaatcatcaaggcatcgacgatctcttctggtttcttaagttttacattattgttcggttttggcattaacttgtgagtctttgttttgctgcaattttgttcaagttaatccatccaaaacctttataatacttcatagatcaaatctgcaaagtttcgttgattgattcttgttagattcgactttgcttaagttttagggtttgttcagatttactgaaattctgagacagctggcttttgagggtattttctcttaaaccgtttatcagtttgcaaatccctccggtggagttgttccttggtttgtctagtttattcctaggctgacggttcgaccgcgagaggacctgtgttcagaccgatcctaataggtaggatagaccatcggacgtgtgttccattggtttttgaggatgtggcgtgttttgatctatcaagatttggatatttgacttgcgttgaaataatctaccattcaccccctctctggtatgcttgattacttgtgttcgatcctacagctgctgcagcttgcttaacatccattgcagctaatgctgggctcctgcattgggcaagattttgggatcgatttggggctagggttaagaaggtcagccggggtattttgatccctacgaaaatacacagtagacaaaaaaaatgattcatatggcgtatcaggttatacatatcatggtatggatccagcttttataatgttgaagtggcatatcgttccaatctatctattatattattaaaacaactttgaaaggaggcaccacgttcgctgtgagggctagtaaatcccacattaatcggagaaaaagaaaaaaaaaagaaaaggagagtccaagtagaagtacaatataaaaatagctgaaattcggaactaaaaataagtaatattgaaagaagtttccatatatataagaacccaatacgagattaaccataaatcgaaataaaaataaaataaaatctaaaattagaaaaggaaaggagagtccaagtaagaatacaatttaaaaatagctgaattcggaattaaaaataagaaatattgaaagaagtttccatataagaatccaatatgagattaaccaaaattcgaaacaaaaataaaataaactctaaaattagaaaaggaaaggagagtccaagtaagaatacaatttaaaaatagctgaaattcaaaattaaaaataagcgagattaaccaaatttcgaaataaaaataaaataaaatctaaaattagaaaagcaaaggagagtccagataagaatacaatttaaaaatagctaaaattcacaattaaaaataaacaataatgaaataagtttccatataagaacccaatacgagattaataaaaattcgaaataaaaacaaaataaaatccaaaattagaaaaggaaaggagagcccaagtatgaatacaatctaaaaatagctgaaattcggaattaaaaataatgaatattaaaagaagagtccatataagaagccaatatgaaattaattaaaattcggaataaaaataaaataaaatccaaaattagaaaaggaaaggagatcccaagtatgaatacaatctaaaaatagctgaaattcggaattaaaaataaggaatattaaaagaagagtccgtataagaacgcaatacgagattaattaaaattcagaataaaaataaaaatgaatccgaaattagcaaaagaaaataaaataagagttcaagtaggaatacaatttaaaattagctgaaattcggaattaaaaataaacaatattgaaagaagaatccatataagaatccaaaattagccgacggttgacgggacttctagaaaataaataaaatgaattccaacgatagttatgtttgatttttagaatcacaatgacaatgaagagtaagtggcggacgggttgtacaggggcacagtggcatcgtttgatgagacttctaaaaattataaaaaataaaactacaagtccaatttttaaaggttcagaacttctaaaaagtaaaaaaaacaattataatcatgtttgattttaaaatctcaatgacaataaagaagggaggcagcgcgcgagctgtagaggagtacaatggtaaagccgcagactgtttggcgggacttctagaaagtaaaaatgaacacaaacgataatcatgttcgatttttaaaatctcaatgacagtaaagagaagagacggtggacgggccatagaggagtataatggcaacaattgacgggacatctagaaaatatataaacgaaatccaacatgacaataaactctaaaaactataaaatctaatttttaaaggttccaagaagaataaatagaaatagtgatagatcgagtaagcaaataaatgagatgacataaggagtagcgactggtgtgacttttaaaaactatataattagaaacacgaggatgataaggtttggtcttttaaagtcttaagataatgagatagctatttaataaattttaagtaaaatcatattaaaaaatatatgattttgtttgggtgctagccgcgcaattgcgcgggccacccagctagttatacaaatactaatgatatttttcaaaacaagcaaatttacacacatgcaagaatccaattaaccattccatgtaatatagccacgtaaacttgtaattgaacaaatggatgcacgttccatcatgcaaccaaaaagacaacttgaaccgtcttgctcagatcaacctcattggctatacttctgcatcatccaattccgatctcgtgaattattgcaccaaagtctgaagtcccggccctatttcaacattgagtgtcgaattgtctatgggcctcattaagttgattccatcaacatcgatccatccatccaaactagagtagtattctgtaaactattggtctacggggtataacaataagttatttcaagcaacggtaaccatcactgatcaccaccgtgtttccaacaatgcatatattaatccttgtgcttactcggtcgtatgccgtcattagatgattcttcgatccaaaatatatattccactatcgatgacatagtcttgcgttctattttttctttgattgcatgtgcatacgacatgtataattatttttctttgattgtgcatacgacctgtaattatttttcttttattgtgcatacgacctgtcataattaattatttaaagtgcagtatacaagctatgttgtttgttttacctactaaattatggaaggcacttttaccaagacattgttaatatcccacaaaattttcgtacaatggaacatttcaacagttgctacaagaagatgcatgcatactgatcaaattaagatgcaaaagcgactttgaccggtcgcaggtctttggaccaaattgttgaaaatggtcagtgtgccatacagaaacgtagcactgttcatgcacgcatggatgatcgacactaatattatacttttcgcagttaaaagcgcgtcttaattaattacttgcgatgaattgatgtataacataactagtattccccgtttcacgaagtaagactttctagcattgccatatttgtctagattcattaacgtctatataaatagcactactacagaatgagtttttgcaaatgggcgaacacgattttcgcatctggttgggccatccgcatacgcgaaatcgtctgcaaagatcgtcatctttccatgcggccagggcacccgcaagcgaaaatccaattttcacatacgggcgcttacgccgatcgcatgcaaagagaaaaaatagggaaaaaaatttcaaaaacaacaaccctagccgcaagcggcgccaccgccgcccgatcccgccagacgcgcccgcctcctgatctgggcgggatgaggcccgtcaccaccgcccccgctcctaccgccggccgcacccgccgacgacgccccagttccgccgccggccgctctcgcctccggatctgggcgggacaaggcccgccaccgccagatccaggcaggatgaggtccatcgccgccggatccgagcgggacaaggcccgtgtcgccgcccactcgtcatcgtcgtcggggtcgccccagctgcccccacttgtgtcgtcgtcgtcgtcggggtcaacccctccttgtcgtcgtcagggtcgccaccgcggagggggcagcccgagcgatggggatgacgtggccgccgcccgccacgcgacgcgccgctctcggctgccggcgcccgcctctgccccatccccacctccgccctgcgcctctgccccgtctgctctatgccgtgagagagagagagaggagataagtgtgtgtgagagagagactcagtagagagggttgtggttggcgtaaggataaggttggggttgaaaacttttgaactgtggagagggaaagagccgacttcatttttacatgcggaccacttaaggatccgcatgcaaaaattagttttttaatttttaaatcaaatttatggcactaaattaattcttatgaaaatgttgttaaaaacaaagttgtagaactcattgagatctaccatttttctttaggttatttctccatttgaatttgattgaactatataaaatatgaattttaaaatataagaatttcaaataatttttcgagtagtaaatattttcagataaaaaaaattgtcaacaacaaagttgtaaaatgcatcaagatctacaacttttgttttggtcatttttctatatgactttgtttcaacagtttgattttgaattttaaattatgacaactttaaacaacatattcaaatagtaaatgatttgaactgaaaaagtcatcaataacaaagtggtataactcatcaagatctgtaacttttcttttggtcatttttttcatccgataaaatgatttgtaacattgttcacagaatatacatatctcttatatagttttataaactataagagagatatgtaaattttgtgaaaattttaccatcactttatcggatgaagaaatgaccaaaatagaagttatagatcttgatgagttatacaactttgttgttgatgactttttccgctgaaatcatttactccttcaaaatagtatttgaagttttaaaattcaaatttttaattgataaaacaaagtcactacaaaaagtgcccaaaataatagaagtaagaacacaataacatgacagagtatgattttagaaacattaagggaaaagaatcatccaatttaggttcatatgagtgagataatctagtttcaatttttttcaaattttatttccgcagacggctacttaacacgcccgtatggaaaaattgatttttccatgcaggcgcttaagtgagccatatgcaaaaatgacctcatttttacgtccggacctcttatgagttcctatggaaaaatcgattttttcatacgggcgtcttaagcagccatatgcgaaactgccgctcgatttttgcagatgccactagttatggtccgtttgcaaaaatcatgggggtctcgtacagaaaaaacacttttgcagtagtgtatgagccatgctagaaagtcatacattgtgaaacaaaggaagtagtattatgtatattcgtgcgagatgtatactttgctttgtttatacatggagtatgtggtagagattttttgattatggcagtattcgttatgccataatctttcgttgggttttccacgcgctaccaagcgtttatatgtatacaaaatttcagcacagtatgaacgtaatataccagtagtgaaattccatatgtatgttttatatatatactcctagctaacacagcttctttcttgctttaatagttacttcctgtagctgatctcgcccaagtgaggatcctatcacaaacaactagagctctcacgtgaagataatcaatgtaggatttagggatttttcttctcgtcaaaccatatattacctttggcatgatcgtgtaaaacaacgtatgcgcatccactagaatgtgtattcctaaacccagttgtaaactcaataactaataaccaaattacaaacattgttcgtcaacccgtgccagctattattattgctatctatgtatctatctattatattattaaaacagctttgaaaagaggcaccacgttcgctgtggggctaaaaattcccacattaatcggagaaaaataaaaaaaagaaaagaagagtccaagtagaagtacaatttaaaaatagctaaaatttggaattaaaaataagcaatattgaaagaattttccatataagaacccaatatgagattaatcaaaattcaaaataaaaataaaataaaatccaaaattagaaaaggaaacgagagtccaagtagaaatacaattttaaaatagctgaaatttgaaattaaaaataagcaatattgaaagaagttcccatatgagaatccaatacgagattaatcaaaattcgaaattaatataaaataaaatccaaaattagaaaagaaaaggagggtccaagtaggaatataatttaaaaatagctgaaatacagaattaataataagcaatattaaaaaaaatccatataagaatcaaatacgggattagttaaaattcggaataaaaataaaaataaatccgaaattagcaaaagaaaataaaataagagttcaagtaggaataaaatttaaaattagctgaaattcggaattaaaaataagtaatattgaaagaaaaattcatataagaaccaatacgagattaatttaaatttagaataaaaaataaaaataaatccaaaattagaaaaactaaaagagaattcaagtaggaatacaattttgaaacaactgaaattgaaaataaaaaataaaaacattagaaaaacgtattaactaaaattttttaaaaaaattctgaaattagaaaaagaaaaataagatttcaattatgaatacaatttataaataactaaaacttgtgataaaaatagagaatattgaaagaaaagaccatctaaaacacatgacgagataaattaagtaataggcctataaaagagtagagtggtggcggttgatacgacatataaaaattgttaataaaacaccaaatagaatcctaatgacgattaaaaggagggacgtcaggcaggccgtgaagcaaacgagtaaggcggttgctgggacttctagaatgtaaaccccattgataatcatatttgatttttaaaatctcaatgacaataaaaaggagaagcagcgggcggggtgtataggagtatagttgcagagccgctgacagttgacgggacttccacaaaatgaaaaatgaattccaatgatagttatgttagatttttagaatcacaatgacaataaagaataggcggcggacgggccgtagaggagcataatggcattgtttgacgagacttctaaaaattataaaaaatagaactacaagtccaatttttaaaggtctgaaacttctaaaaagaaaaaaaccaatgataatcatgttctattttaaaatctcaatgacaataaagaagggaggcagcgggcgaaccgtagaggagtagaatggcaaagccgctgacggtttggcgggacttgtagaaagtaaaaatgaacccaaacgataattatgttcaattttcaaaatctcaatgacaataaatagaagagatagtgaacggaccgtataggagtataatggcaatgtttgacgggacatctataaattataaaaatgaaacccaacgtgacaataaacactaaaaactataaaatccaatttttaaaggttccaagaagaatgaatagaaatagtggtagatcgagcaagcaaataaatatggagatgacataaggggtagcaaccagggtgacttttaaaaactctataattagaaacacgaggatgataaggtttgctctttcaaagtcttaagataatgatatagccatttaataaatttgaagtaaaatcatactaaaaaatatatgattttgtttttggtgctagccgcgcaattgcgcgggccacacagctagttatttaaacaacaacagttcatactaatttttttctgcggggcagttcatactaaaattagaatccatttatattacaactcgctaattattaatttcatctcaactcacatgggtccacgaccgatgacagaaacttttgaatgttttaagtagtagtgatagagatagagataaagataaagaagtaaagatagaaatagagattaatatgacattaaatttatttcttaagaagggtctatctcttacaatttgctaaaaaaatatttcaatttgttaataccacattaattttgaattctagaaactaaattagtgagtccatggtatctcgtatggcatgttttgtttaacacaaactctcgatacgatacgatctatgtgttcaaaaagatatatgattcatctaatcgatgaatttttttttctaattatgaaagcaaccgagaagtgcccaatgaatataaataaatatatattaggggaaatggtagtgcgaagactttgttgagttgcattcaagccgttgggtccttttcgtttatttaaaatttatggctggctagtgtccaacagtccaagtaagatccatcaggctccgctcctcttcatatactccctccgtcccaaaatgtagctatttctagcacagtgttttgtcccaaaatgaagctatttcttcacctacctcctcctctcaaccaatcacaaccatttttcttcacctactttctcttttcaaccaatcacacacttcctccaatcattctcacctactttcttaatactcgtgccaacctcaaaaatggctttattttgggacggaggaagtatatactagcattaattcgtcggactaaggtgcacaagtacgcgtacgatcagaagagaaacacatcgacaaataagttcatacttccatggcttcctatggtgagctaacaatatcatgtctcacggccatagctgttgctggggcggcgttgctcgccggcggcgcagaggcgcaatgcctgcacacctgcggcggcatagacatcccttacccttttggcatcggatctgacggcgactgtgcattgcctttttacaatatcgactgcaacaacaaaaaaccattctaccgagatgtggaggtcctcagcatctccctccagcttggtcagatcagggtgagcacccccatatcttcttcttgctacaaccccttctctaagaggatgtactccagcgggtgggggttcaacctgtcatacacacctttcatgctgtcggactccaacaagttcacggtcgtcgggtgccagtcattggcctacatttccgacccaaccagcaactacacgagcggctgcgcgtcctcctgcccgggtggtaaagtggtgagcgccaccaacagaacctgctccaggataggatgttgccagataaccatccccagaggcatggaattctgcaaggtgtcgttcggggagagcatgaacacatcgggaatctacgaacacaccccctgcagctatgcagcgataatggactactcgaatttcactttctcaaccagcaacttgacttctctgctagagtttaacaacacctacagtggccgagcgccggtgaagtttgactgggctatctggggtccccgagactgcgtggaagcgcagaaaaatctcacatcgtacgcgtgcaaaagcgaccatagcgtgtgcctcaattattccagtggagcaaaatcagcctacatgtgcaactgctccaaaggataccatggcaatccttaccttcaaggctcaaatggttgtgaaggtaaaatatgcctatagatttattctcatcaaagctacaagttttaaataattataggtatttcctgacagtaagtataatatagagttgtcatgtattgcaatagagtgtataaacagctatcttttttctctcaatatttaacggacacatctatacaattaatgaacccacttctggtatacaccctccgttctaaaatgaactaatgccttctgctacgagtccacattttagttattagagggacgtaggctttaaaaaatagcatagcacactgcttatttacccatctgcatttctcctcagattagagatgacaatggccccattttccgtggtgaattcacccattaggagcaggcatggttagaattggttcttcatggggacataaaggggaggaggcttgtccccgtcggttttcacgagggtggggatggttcttcattccttgtccccactccccgtggagctccacataggtatccaagtttaatgtgattatattaattattatatttgataaatgataatcatatgtttttatcgtgtgaaatagtatataatatttctagatatatgttgatatattaatataaagtgcgtatatacgttgcattgcatatataatttgacatgtgtatattgctttaagcggggacgaatatcctgcggggatttatttcctgtgcggggtggggatgggaacaaagtttccccgttgttttatcgcagggatggcgatgcattccccgacggtgaattccctgttgccatctctacctcggatccaatgtgtttctatgtactttagcctctcaactatgtgaatgcgcgttgctgctgcttcttgttatttttaaagtacagagtgctgttaataccataaaaaaattaaaatgaactccatgaaagtcatgtcgtctcggcatgcatagtcgccaagtataatttcctatagttagcatgccttttataaaccaacttttttttccatgtagctttgtcctttaatttgtgtgcatatcatcacttttttttttgcggggtgcatatcatcacgttataaatatttctataaaaggtttatatttgattgcagatattaatgaatgtgaacatcctgagagttacccgtgctatggagaatgccacaataaagacggcggatttgattgtttctgtcgtgatggtacacgaggaaatgccactattccaggagggtgccaaaaaaacttcttaacgcgaaaggcacgagttgcaattggtacgtacttactccaataccgtgttgcctcatattatgatatgctcgatcaggtatagacacacagatgttgaaatagtaccttgataaaccttttcactaatgaaaaaacattatctctcaaggtgttgttgcctgcatattatctatcctcttcggtttccttggatgggaagtgatacggcacaaaaggagcataaaaagacaagctttattaagacaaaacgatgagttttttcaacagcacggaggacagctattgctagaaatgatgaaagtagagggcaatgcagggtttacactctacggtagacaagagattgagactgccacaaataacttcaacaaagcgaacatcattggggaaggagggcagggaactgtttatagggcggtattgggtggaatcgccgtcgcaattaaaatgtgcaaggagattgacgagaacaggaagatggaatttgtgcaggaactggtcatactttgccgtgtcaaccatcccaacattgtcaagttgctcggttgttgcctgcagtttgaggcacccatgcttgtgtacgagtttgtgcaaaacaaaacactgaaagagttgttggatctccaaaggagcacgaggttccatgtcacactaggaacccgcctaagaattgctgcggaatctgccggggcatttgcgcatctgcactcattgtcgcaccctatactccatggtgatgtgaagccggccaacatcctactggctgagggattggtcgcaaaggtgtcggactttggctgctcaacaattgatgagagtactccggctgtgccaaaaggcacgccagggtatattgatccagactacctactcgagtatcaactcacagccaagaatgacgtatatagcttcggtgttattcttcttgagcttttaactggtaagaagccattctcaaaagaaaggaagagcttgaccttgatgtttcaggaggctatggtaaatggcacactccaggacctccttgacagtgacatagtcgatgaagctagcatgagagtaatccatcgagttgcagtgctggcaagtcagtgtttggttgttccaggtacaacgagaccgtcaatggctttagtggtggaggagctctggcggcttgcgctagcagatgaattgcagcgatacccgcagccaccactggtgcttgaggagttgagctttctggatacgggaagcaccagtgggatttacagccttgataataaggccgtgttaagcacaacattcgctagatgatcagtagatctatcttgattgtcttcgttgtgtcatttgtaggtttttgtatattgagtgttgttctctattttggatgtatttgttgtgaggaatgagaatataagaacctgtaaacacaataaatcatttagtgtactgtagaactactgatggtttggcagaaatgtaatgaaacaactagtagtggtaattgccgcatcaactctttgacttcttggctcctgctttatgtttctttcacccgagaatgtcgccgaagttcccatgggcgcaaggacggtggtgacgggttcttctttctcccatcaccgcggttcaaatggtggctgtggaggtggcaccatcggttgaatctggagttctggtgagttgcctcggtgtggtggtgacgtcaacaagttatacgcactcacaccaacatccacgcatattctcaaaccaatttcatcaaataaatcatttacaaaaccaattattcgttacaaaatattaatcacgacaatcattaaaaaagaaaaaagtcctgcacagcaagttctgacgcatgaaggtgacacactgacagtgcgcaccgggccaaagcggtgttgcgacggatcgcgccaaagcaggatacttgcacgatacttgcagctgaccagggcatggaaagccacacggcgtgctcgctatgtgattgggagaaatagacagcaaatcacgtgcaaaaatgatactcaaggacaaaaatgacttttcacccatctactaacggtatatgtgttaaataagcctactggaaaaggtcaataaaacataaaatttgatgatgcataatataagtgcaaaagtgaattttatcggggcaaataaggctgaattttttatttataataaataattacccttaaattaaacaattagtaaatcgtaggggggatttacaggagtaggatggacgtcactacagaaaacgtctagaactactggatgccgttttaaacaacgtccatacttggacggtgttggaaacagcgtccacctccctggtgcagccaagccacgaatagagcgagaacaatcaaaagaaaaccctgacaatgaaaagaaaacctaactgtcgcgatgagcgctgatcgcgcatgccggcagccggccacacaccgtcgtaaatcgtatacgagtttgccctctctacgactttgatccatccgcttcgtcgtacgtccaagccactctcgccgtcgacgccggtgccttcgatttgtctgtgttttacggcgccaccaatcctgcaatccggccacggcaccgtgtgcattggcatctctcgtcgtgaggcaacaggtttgccctgcaatttatatcacgcatgcatgtcttttcacttatagcatgtctctgctcacactcatctaattagcattaattgatatgtaatacattgttcatacctacttgatatatgacatgagtgttttattgaatatatatatatatatatatgtatagattattattcaactagtagacatataacctgcctttgttaattggtgagttcgtttggaagacacagccaggaaataaaatgattattgttcattaacatttttatactagtacagattctttcatctgtgacggcccctaacatgcctgaaatttgtgggccgtcacaaagaagtaatctcaatcgggcacacagacagctagatcggcataaaactagagcccgtcacgaatgacacttatgtgtgacgggccatagttgaggcccgattgagatgatggttcaatatcttaatcgggccctaaaggaagcccatcacagatgaccgtcatctgtgacgggcttcaactagagggccgattgagataagtttaatgcccgtcacagatgactctcttatttgacgggcttttattaaggccagatagagattacttctatgcccgtcacggttaattgttttagggcccttacaaatatttgttgcacagtataaataccccccaccacctagtgtaattgtatactactgttcactattttggtgggaggctatagagggcgattttttgtcttttttccaaggaaaacagaacattaccaaaagtgatcaaaatggagcactcaagtgagtaatactaatgatgaattcagcaatttcatcataacttactttagcaatactgatattataatatgtgcctctaatttatttttttattttgtagcaatggatcgaagttggatgtatgcgacaactgtgaaacgtcattttccggagtacagaaatggcgtaataaaatttatgaacgccgcagaggaggataggaaaagaagaaacaatgattacatgcgttgtccatgtgcagattgcaagaatgagaatatgtttgatagcgaagaggttgtacacgatcatctgatacaacgaggattcatgaaggactatacatgttgggtgaagcatggagagcaagaatcaggaagtggtgcagcaacagacagaagtggtgcgcataatcaggaagatgaagatgagcatgacatgtttataccttctccattgggcggtgaaatgtggatcacgatctgctacaagacatgttacgtgacgttgaagacccagcccagaatgagagagatttcatgaagtttagcaggttggtcagtgattccgagacgcttctgtacgccggatgcaaagcaaaacacacaaagttgtcagcgaccttgaacctaatgaagttgaaggcaagtagtggatggacagacaagagtttcatagatcttttaggaattttgaagactatgcttcttgttgagaacacattgcccaagacgacatacgaagtaaagcagattctatgtccactggggttagaggtccgtagaattaacgcttgtccaaacgactgcatattgtaccacaagcaatatgcggacttagatgcttgtcctatctgcaaggcttctcgatacaagcgaagagaaagtgctgacgaagcaaagaagtcaaagagtggtggtccggcaaaggttgtgcggtatctaactatcattgatcatttcaagagaatctctgccaaccccaacgaagcgaagttagtacgttggcacgccacggagagaaggaatgacggtatgcttagacacctagcggattcgattgaatggaggaatatcgatggaaaacacaaggacttagctgccgaccctagaaacatttggatatgtctgtgtacggatggcatgaatcatttcggttacatgagtagtactcacagcacttggctagttcttattgcgaagtataacctcccgccatggttgtgctttaaacggaaatatattatgttgtgcttgttaatccaaggtccaaggcaacccggcaaagatatcgatgtattcccggagcctgttatcaatgatcttgagattctttagaaagaaggtgtgaaaacttgggatgcatatggtcaggagaacttcaagctaagagttctattgttctgcaccattaatgattaccctgcactcggtaatctttccgaacaaactataaaaggaaaaaaggcatcttcgactgcaaggaacatacacgaagccggtggctgaagaaatcacgaaagatggtatacatgggtcatcggaggtggctcccgctacgtcacgcatttagaagaaagaagaatatttttaacggtaagagagaacttcagcctgcttccaaggatttgtccgaagatgacctagtgttgggggatttttcttttttcttttttccgaatcacaacgaacagcaccaggttatgaccgcaccaacctggacgtcgatccaattggtgtccacatttgtacgttaattgtaatagcgcacacatcttgacgctgtttctagtaacgtccaccttactttggtaaatgttatcctctaattactaataatttaatgtaaagaatattatttattattaattaaaaaatcggcaaataagggaaagagacctgattaatgggaagataaagaaaatcacttattactcatttttggagaagatgttgccgcaagcagtactataatacccgaaatatatatgtttgggaactcttcgtagatttcgatttcccaaccggtacgtatggggtgtacggtttgaaaaaaactagccagctcggctcagctgaagcttcaaagccaccaaaatcgaattaaaaaatccaaaaaaaattaaagagaatcaataacttcacattacggatcacagaatcaagcattcatcaacaagttcataacgcctaatcaaacattcaataaaaatggacaagtctaaaaaaccaaattaaatgcaccaatcatggtaggggatgtgacatcgcttgccgaggaatcgcttgccacttcctagctgtgacctgtcaaatctcgacgcctccacgagcaggtggaggccggatcaggctgcccccctgagccagttgtcgaggagatcttctggccgtcgccggggtcggggtcactcgggacaggccaccattgctatccgtggacacagcccaaggccaccctccacctcttcgataaggtttttgctcggctcggctcctcagatttttcttttctttttgtagctgttcgatttataagaaccgtgccaatttttatctaaccggcaccttgttgctcaaacatgtcagttttattttttttatcttgataaggtgagaattaaatgttaatagctaataagtataggttttaaatgaaccaacagaggtgatacctattttgtagtagtggcaattcgaggatgtcgtcgcctgctacccttacgctaactgactggaagcagtatgagtgcacgactagctagatggtatagctgcccacatgcgaagcggccccacgggctatatgggcttgtttagtttggtgtcaaaatcaaccttactaaaatttagcttcgtcaaaaagttggcatattttgacgttaacaaatttttggtagcattggatgtgtttaatttgttgtcaaaccaattcttggattgtttgtatgagtttctagaaataccaaattttggtaaggtatcaatggcaataaaatatttagtttgttagcttacaatgttttcgtaatacgaaaaactgctaaggtggaaagtggtaccaaactgaacaaccctacacagcctgcgagcaatgccacagtagcgtagccggctacttagtgaagaagtgaaagttgaatccaccatgatctgtgcgggaggtgaccaaaacagcggaatgggctatcctccggttgttaaaaggcctgtgattctaacacggtttaggccttggaatacaagaattttctccggtaccttcagtggggaaaaagtgcacgcaaggtccctcaacttgtcatcgagtaacaacgtcgtcccccaactataaaaccagatatctagtgtctcttaattaatcaaaaccgatcgcaatgatcctttggtggttttgaccccagttttatcctacgcggtggccgagtcagcgtgagacccacgtgagccccacatgtcaggatgccacgtcatctctctcccttcctcctctctctcactcttctcttctctcagccggtggctagggaggagcccgcctgggcgaggcgggagagaagggcgacgccgcgacggcggccgcagtggggaagcacggcggagctctgcggcagccaaagatgggtgaggggggctcatgccagcgacggcggcgcacgcgcacgaggggagtaagggtgtgggcgtggcggcggcggcgtcgatgatggagacgtgttgctgccgacggtccacttcggcgggctttccagcagcagcgcaggcccggagggcaacgtcggtgacgagacagacccaggggtggccgtcggcgggcgcgcgtgaagatgagcagttcctccaatatgtcgatggacgaaggtcaaacaaaattgttttctttagacacgatccacctggacagatcgaagacaagaagatgttatggagaggcggcgtgcgaaatcttacctccattattcttcttgacatgagacgcgagaccccgagctcagtgggtacagggtgtcatcggtctgcagggttccccacgcaagaacaggatcagggacctttcacatttagtgagaaaaaggggatgaaagcgagggcacaaatcaatggagagcaacattttgcaataactggtagcttaccaaatagcaggaagtcgaatttgggctcttggacctttgtggcagtgcttgtggtgtgggtggaaaaaaaccgaaaatttctccataatccaagaccctgtcctgctatttattcctcgccgttgtcgtcgtcatccgagcaaccggaggtggcggcagtgacgtcgaagcggcagtagcagttgctgctgccatggtgaggaagaggaagctgccaagatggcggagcgacacgctcctttgagaagcacggcggagctccgcggcggccaaagatggtagggggctcatgccgacgacggcggagaacgcgcacgagcagagtaagggtgtgggcgcgctcggcgacggcggctgtccctctcgctccacaggccggaggcggcgacgtcgctgctgatgcagcagtagcagcagcacaaccaccaccacctccaccaccagccgtcgccaccggcgggcgcggcgtcgacgtggcagctgcagcagggcgcgtggcatctccgcggctcaaggtccctcctcccgacgcagcagctcttgcaggagttctccagcctcctcgtgaagagcatcacaacccatcatcggcaagcaaggcacccaagctagccacttcgccttgctcgccagtggcggcccccccccccccccccctggcgacgccacccagctgcctgcccagcctcctcccgtgcacgcctgtcgctcgtggaaagggcaggagagaggaaggaataagaggctgacatacgggtctcacgctgactcagccgtcacgtagaacaaaacccgagtcaaaatcaccgaaggatctattgtgaccggttttgattgttaagagacgtcagatatctggttttgtggttgggggacaattttatgactcgatgataagttgagggaccttcggtgtactttttcctttcagtggaacatacacgtgcttcccaagttagagatagggggattgcagtggccgagccaaggcctggacatcatgggccagtgctcgggctctgccaaacgaacgagtgattgccccagctaaattatgagacaaaccagtgattaccctagctaggttacatggcaaatcagtaaggaatgtatgagtgcttactgcccaactaagttatatcttgaaatgttttttttctcacaaatcacaattcaatagtgttaacttttgttgcattatgtttaaaaaaatttgttgcataatgacaaatgactcataaagtagtatgaacatgtgtgttaccattagaatttcctgggctctaaaaaatttctagatggatcactaagagggaacaaagtggtacaagggcagcgtataatgccacgggaggtaaagcacaacagaacactcaaaccatacctgacgatgaccttgatacagtcacctacacactatacaagaggcgactacaatacatcacgatatagcggaacgacgactaaccttccaattattgaccatctaagacatgccagataatgatacaggaacacacgatattatttgttaacgaagttcagtcgaatcctacatctcccgagctcttattatgtacgctcgtcccaaccaatatagtacttagccgttacgagtaaatggtctcaccgccatcctcttcctgcgtgactatgctatattttagttgccatgcttatattgtagtgccttgctctctatttaagagagttgccaggttacagagttcgactctaatttcacccccgcgccacctattacaactccaagtctaactgtaaccaaacaggactagtatattcgacacataatctagcaggtacaactcaccaaattcaaaacctcaaaatgtaaagatataacatcatcattcattaacaattactacaattaaacatcatacaagtaatgttatattatctataattttataatttattaaattttagagctttaaaatgcttgcatgttaaatcatcatggcatataattcacataatatttcaatataactctctattattttttataatatccgatatacctatttagttcatcatcactcagttaatactactatttctctcctctctctaagccatatcacataattttttcagtccctagatgactaatttatggtacaaattatctccctcattttcttcacctcaattgtttttagcccttaatgattaatatatgggaaacatatcctatgcacacaagctctcacgtgtacacacgtgcacaccaactaacaaatatcaccaaaaaatctagaaaaagtcatacatgttatttcaatagtattacacccaggcataaaatcttaacctcaaattcattataatttttagccgtaacaaaaaaaaatctgataattttaaggttataattctgttagaattttgtcttttttcttactctctatgtagaatgaaattgaagatgcgactttgcacgtagatgaaatactattggaagtaaatgtatgattttttctagaattttttgtgataatttttagttgatctacacggtgtgtacacgcaagggcctgtgtgtataggatacgctccctaatatatgatctaaattatcttccccatttcttctctcataatttaactttgataaatttaaatgatcataaaccacatcaaattatattgtctagctatcttacatatctttttatttattattatcataataaattctcatacagcatcacgtggggtttcactggtacaaggaaaaaaaacggtcgagctacggaaacaatccagccatttttcagaaagtgaatcgtaccaaatcgaattatttagaatctgctggtgtcgggaaacattctgaaaaatacacgctcagtgctgccagacttttgaatgctattgcagcggatctctgtttgatgtgtcaatggcttaaagaatactatgtagagtgaatataggtggtgtttaaatttcgtgaagatgaaaataaaggtaaatattaagtggatcacgtaaaacgatgtgatgtgtgattaattgagttttaattactacaaacttaagaaatagattaatatgatattttagagcaactttcatatagaaagtttatatacgaaaagtaccgtttagccgtttaaaaaatgtatcatgagtatctaaaattttatcctccgcttgtagaagaaacgaacagagccatagtcactccaatttgccgtccacataaaaagactgcaaaggattgagccaagccccaagcataaagaaaaccgaaatttgcccacaattttgtccgtttggacacaccgtacaaaattacagacgaaaactattaatggcatcgatctcaacaggaaatgcatctaagacaattgagccccctgatgtttgcatttgacagttgacacgaccttggcgttgatatggcaaacctgtttacctgtccactgccgcggtgcaccacacccttcaccggcaattccacaacagcaagctagcgctttccaagttccagcaatgccgccgcgaggtcagacatggcgagggactagagtgtatagtggcggcaactaccacaaccgcgagagcctaggacgttgccggccggctcgccgcccgtgagctaggcctgctccggggcctagtccctcggccacacatgagctgatgaagcgtattcaagatcacctaagcacggtggactcccagttaaaataaatgattgtgaagtactctctccgtttctaaatatttaaatatttgacatcgtcaatttttagtacatgtttgatcgttcgtcttattcaaaaacttttatgaaatatgtaaaactatatgtatgcatataagtatatttaacgatgaactaaatgatacaaaaagaattaataattaactttttaataagacgaatggtcaaatatattttaaaaagtcaacggtattaaatatttagaaacggaggtggttgttgtatttagttagttcgctacatacgtacttacataaaaagttggcattacaaaagtcaatatttgtgtggtaaccgggcaagcgacgtggacatggaatctgatctgatgggcagccatgtgtgatgacatcgaaagaaatattcacttccagcctcgtggtcgtggagaggtctcacgtcgtagtcacgatcgaagatgagatgcaacggtgactttgaccggcaaagtctttggatcatcgtctttgttggaaatggtcagtgtgcattcaggcatcgatgatctgtgatccatgtgttagcttttgccagttaaaagtgcatctatattacctgttctaaatttatatggataacttaattacaaggagtatgtgctggtggatttttagataatttgatcgtcgttgtaaaatcttagcagctctacctcaaattagttttcttcaaacactcccgcataaactagtagataattaaccaatttggaacatgtgccagaaagcaagctaagctagggcaaagaaagtggtccagactaaaatttactctaaaattaacactaaagatacagtaagcgaagacttgttcaagtcgttgggtctttttcttatatttaaaagaaagtttgtctagtgtccatgttggattcatctcaaattctcaacgctggctctactcatcttcatatacaagcacaagtccataatcacctatcaagaaacagaggtttaagacacaaacagatagctaggactagctagttcatccatccaccatgactagccacagaggactaacaacaacaacgctgtgcctcgccatagcgattgctgcagagctcctcgctgggagagcagaggggcaatgccagaacaccaagtgtggcgacgttgagatcccttacccattcagcaccagcttggacaagtgcgccgcgtccgccttcgaattcgactgcaacgacaccggcaacggcgtctacaagcccttctacggaaatgtggaggtgctcagcgtctccctccagcttggccaggtccgggtgatgaatcacatctcctcttcctgctacaacttatcttctaaggagatggactccgacacgtggcagctcaacatgactggcacgccgttcatgctctccgactccaacaagttcacggtcgtcggctgccggacacaagcctacatcgccgaccaggattacgtggggaagtacatgagcgggtgcgtgtccgtgtgccggcgaggtgatgtgtggaaggcgacaaacggcacctgctccgggataggctgctgccagacggccatcccaaagggcctggattactaccaggccttcttcgacgacagcagcatgaacacgtcggggatctacaaccgcaccccctgcagctacgcggtgctaatggactcctccaacttcaccttctcgaccacctacttgactacatcggaattcaacaacacctatgatggccgggcgcctatggtgctcgattgggccatccggagcgccaacagttgtgaggaggcatggaagaagatggactcttacgcgtgcaaaagtaccaacagcgagtgcttcaactcaaccaacggacctggctacacctgcaactgctccaaagggtacgaaggcaatccttacctcgaaggacccaacggctgtcgaggtgaattttcctataatcccatcaatactacatctagaattctaaaattgtgacagttcatatgaaatagctttcagcgtgtagctttcatgattttgttttcttactccatccggctatatttttaagaaataagtttagttggtccatttataaaatttccaatacatagtctgtttatgattctgacttttttccattaatcccatttcatatttgaaattctcccacgtttccattttccagattaccaaattcttttccccacatcttacaaattcgtcatttttattttgtagatattgatgaatgtcaagattccaagactcatcattgctatggagaatgccgtaataaacctggcggttttgattgtaactgtccagcgggcagcaaaggaaatgctaccattccagatggatgccgaaaagacttccgcttgccgctaaaagcacgactggcaattggtaggcacatgttttacaatctcttttttttaagactatgttttactgctgcatatctggtcgacatccatgttaaaacctacacatgctcaaatatttccactaatgtcagatatttgtttatccaggagcggttatctgcgtattagttggcctctttagtttccttggatgggaagtgatacgccacaaaaggagcataaaaaaacaagcactattaagacagactcatgaattttttctacagcatggtggccagctacttctggaaatgatgaaagtagagggtaatgttggattcaccctctatgagagaggggagattgagactgccacaagtaacttcaacaaggaacacatcatcggtgaaggtggccagggaactgtttatagggcggccttgaacggagttaatgttgcaataaaaaagtgcaaggagatcgacgagagcagaaagatggaatttgtgcaggagttggtcatactttgccgtgtcaggcatcccaacattgtcaagctacttggatgttgcctccagtttgaggcgcccatgcttgtgtacgagttcgtgcagaacaaaacactacaagagttactagatctccataggagcaagaggttccatgtaactcttggaacccgcatgaggatcgctgcagaatctgccgaggcacttgcgcatcttcactcgttgccacaccctataatccacggcgatgtgaaaccatccaatatcctacttgctgagggattgatcgcaaaggtgtctgactttggctgctcgacaatcgatgagaatactcaagctgtacccaaaggaacaccagggtatattgatccagactacctactagagtaccaactcacatctaagaatgatgtatatagtttcggagttattcttcttgagcttctaactagtaagaagccgctgtcaaaagataggaagagcctcaccttgatgtttcaggaggcaatggcagagggcacactctttgagctccttgatagtgacatggttgatgaagctagtatgagagtgatgcatcaggcagctgttctagcaagtcaatgcttggttgttccaggtatgacaaggccgacaatggtgctggtggcagcggagctccggcgcctagcactagctgatgaagtgcaacaatgcccacaaccgccgcttgtacttgaggatttgagctttgtggagatgggaagcacaaccagtggagtttatagccttgagaagaaagctgtgttgagcatagaatttgcaagatgatctatagacagtttgttgtattgattcccgcgcgtggtttgtaggtgtgtgttagattgagttttcttcctagtgatgaactgaatctgtaaaatagcatagtagcatttaggtgcgctttagaattaaagataaacatagttgtaataaaataactagtgatggtatttatacagttccaaagtgagcacaatttaattggtttggttacactactacacaaatgttttctaggacgagcatcccaataggttgcaggcataccataaatgcccgcatctgcaaaaatcgacccccccattttcgcatacgcttcttaagaggaccgcatgcaaaaataagcctattttcacatgtggttctcttaagtaatctgcatgtgaaaaaagacccactcgttttcttttattctcccctccttgctctctcctactaagtcctcctcttcccactctcttctcctccactcctctctcggccctcctggcctcctcctcttctcccccactccatcccaacggcggtggatggctcgtgcgacaggcgcgagctctagcaacggcggtgggggagggcataggaggtgtgcaacggaggcggcggcagttccccacggggagaacagtggaggaggcacccatcggcggccctcccgccacgtggatctgaggacggcagtccccccatgcgcggatccagaggcggctgccctcccccgcgacgacgatgacctcgatagcgacaatgacgagacggcctaggtggaggcagcggtctagggtttcgagtggcggtggcgactagatggtggcaaatctagggtttcagggtagggtttggttttttttttgttttttcacagacgggtgacttaagcgcccgcacccacatggaaaaatgacgatttttgcacatacctgggtgcagatgggtcagggcccgcacgcgaaaatttgtttaggccgtctggaaaaattgtttatgtactagtgttatttatgatgggacatgcctttccgtgtctgctcattttttggctaattattatttttaatgccagtcgatgtacttattgacattgattttttttaaaaaaaagttatatagttgaaagagaattctttatctccatgttcatcactcatcagtcttgtatatcgtgtggagccaaacaagttgccgcaccagtcgtggatgcaatctgatcgaggctatacaagtttcgacgagctaacatacgcttcttgtttaggtgtgattggctttcttacctttctgcttaaaataacccgaggtaggtagcttgatggggtggccttcacagctcgttgttccacccacgttctgatttgctttgccgagaaataattgatggcttcgagaggtgcctgccgcgtactctgtctgcgtctcaagaaaagcctctagcgggcgacgacttgacttgacacgggaatgaccgtccacgcgcgccgggccaggttgacgcgcaatagtgcccaccaacactgtgacgccgaaaccgttttttttttttttttttgagaaccaggaatttattaaacttagaagcatagtacatgcttgagagtacaattaagggactcgaaatgattgaaaagaattctagcacaacagtcccttgttggataggcaatatgggaaatgttttgacaattgaagattagtgcccaccgacactgtgacgccgaaaccgctaattagcagttggctgcgcgtccttcttccgcgtggacaggaaactcgtcgctcgttagctcgttcgactcgcgacaagatggacttagcttggatcgactcgtttcatttttctgacgaaccgagctgacattttaacttgttatatataatgagccaactcgagctagctcgcgagctactagccttaacaagctagactaaccctaccttagcaggtcacaggcccacagtcacatagcacgtagggctatatttttggaagaccgagcccaatagagcatcaatcagatcaaaaccctagtcaccccatccgatcgtgcctctgtctccactctcttcatccctctgccgccctagcgtagcgccgtagctgcattgcagagcgcgaccactgcgcgcccccacatctccaccgctttgccgccacgcgcccgtgcatctccttcttgggcacatctccttcttgggtacaaaagttgtaatatgtaatgaaatggaattaatgcagggtgtcatagactggatttgtgtaaagcactcctattttctggcgtggtatgaagcaatgtagcggagcttgagccggtttggctctgcacgaattttatgtgatttgctgcttttttttccttctttcttaatgtacactatttgagttttttatttgcaagctattttcctcttgttaggtcagtatttgatgcattggctcacgagctaaatgatcaagctcgagctttgcaacgagtcgagccgagctgggtatttagctcgtgataataactacttaacgagtcgagctaagccaactcgttaattatcttaacgatttagatcgagttgagctgactcgctatccaccctacgcgcggcacagccatgtggcgcgcgaggagaccctggcggcgggagggcgcgtggtaaggtgacatgtggcggttttttctcgcttttcttttttttctaggtttttcttttttcctttttttgttttctaatatttatatatatagcacatatacaaactttgtataagtagcgttcttttggttttttaatacgtacgtatacaaattttatatacgcacataataatgcatatattttttttacacattgaaattttaccgtacaccgagttgcttgaaggcttttgaagcccaatcgtacattcgtaccgctcgagcggaggaccgaggacacgtcggcggtccagaggcccagagcacagtgttgcagcccacatgccgattgtataggccggctgagaaaaattccaactcgggcactacaaaatagacttttttctttctcctgtcccaattgagtccacttcgagctggcccagtggacgggagtgcctggagtggtccaagcagtggaatactggaatggggcgcccctaatgcgcgatcagtcgcgcggtcacgcgggcacgcgaccatcagatccactactactactcgtacactactactataactcatacactacgggttttggtacagctccaactcctaaatataactccaggagttgagtctggagtggagttgtggagctgcctaaacccagctccacaactctagcacattttgtgagagagcttcacctaactccacttccaattttggtggagctgaaactatttggctgagctccagctctaggaggggtggagctggagctggagctgtgccaaacaggccctactactgctactactacatgtatatatatatatatatatgtacatgtatatactttgtatacatacatataaatttgtattattgtatacatatgtataaattttgtattaataatataaagtttctatatatgtatacaaaatatatacatacgtgtatatataatttttatgtgtaccaaaaatcgatgtatacaaaatatacacatatacaaactttatatacacgtgtacaaactttgcatacgcgtatacaaactttacatacgtatatataaacttatataaactttgcatatatgtatacaaaccttgtatatgtacatattaaaaaccgagagaaaaaaatacgaatacaaagtttgtatacgtatgaatacaaacttggtataacacgaatacaaactttgtaatatgtacatcttaaaaaaaggggaaccaaaaacggaagagaaacgaaaaaaacaaaaaaaaagggaagagaaatgaaaaaaacaaaaaaaacggaagagaaacgaaaaaaaccaaaaaaagggaaaaatcgctcctcagtcgcggcgcgccgtccgccgacctctccgcgcgcgacacatgtccagtcgcgcggaggagggcgcgcgcaactagccgccccttagctttttcgactggaatgggctggcctcttgttggaatgcttgcttgcaactttcagcaacccactctatagctcacttgcctgtcctttctagtgtagttatcaagattggatcggatatcgacggaagatatagggtggaaacaacgtatctatagtaataacctgaaaactaccgttgaattaaaaattgaacgtctgagattcgtccacgtcataacgagtaaaaaattttactcatagatttactcatgacgtggatgaatcttagacgtttattattcgatccaacgatagttgtttccacaacatatatggtttgcactatatatattttctcggatatcgaactggtcaaaggcctcgattcatgaaaatcgatttttacttcatgaaaatatatatcgctctgcagtattgcgatcgatcaagcgacaaattaattagaaaccacttggcgcaagagtactggagatcgaaggattatgatcaattcaatgtcttttcctaagcaacaagaggaggaagcgaatcaagaactctcccaagtgatttccatgagccattccactcgaccacccgtccattcatcacacagctcagctcccaactccctgtcacagctccacgactagttccggcaacagccagctggccgtgccgatcgaccaggcgtctcgccaggccacatgttttttcccggtgtgtttactcccatttattcaaagtagcagtagcagtaaaaaaattgggttcccatctaaagcactgacgacaattaaaaaaaggggtattcaagttttcacaagggaatgaaaatctgcttgtattaattattggcacaaagtttttacatatgacagaaaattaccgtcagaaaaacgtacgaaatcataaaaatgttgcgtatacaccctaattttctaggcaagaaaaagatgcataatagtccatgtaccccctaaactcttgatataagtctatctagcatcttaaacattgaaatgagacatctaacctcctctaaactaactttgtaataccgttcaaattactctctagcattgttttggatggtagttttgggtatcttggaaactaaatgagtggttttgaatatagcaggtttacacatcatcgtcaataataggtcgccaatatatattctatagtgatgtcaccttactattatattaacatctgtctacattaaatgagaacaaaaaaataagggttaaaaagtcaaaactaaagatttaggtggatattttaacgcatatgtccaattcatatatcacgtaataaaactctcatccaacgtatacgtaaatcagatagaaagctatctataaaacctggtcaaggtgctagatggattttcaaccaaaatttagggggttatttggactttctcctatgaaaattgagtactagtacgaaactgtgaaggctcctgcagatactaaaatccactgaaagctacgttgaaggcttataccccctggcaagacttgaaaattcaagtcacgcatgctagtttgtttcacacatacactatcatcaagccgtttggtcatttccacgccagtgcgtataaacgccagtgcatataaacggtcaggaagacgccggatcatccgacaattgacgagttattgagccatgcagctccagaaattagcagcaatattgttgctaattagtataggccattcggcactgctcgccgccgttggagcgccgccgccgcctcctggcagcagcaactgctcgacggcgtgcggcggcgtcgatatcccctacccgttcggcatcggccctgcaggctgcgcgttgcccggcttcgagctcacctgccgcgacaccaacaatggcggcaagaagccattcttggggcacggcggacacttcgagctggccggcgtgtccctgtccgatggtcaggcccgcgtgtggaacaacatctcctcctactgcaacgacacctcccaaaccatcatggatgtggtgagcttcgctgatccgtacaggctctctcaggccggcaacacgttcgccgtcgtcgggtgtcaggcggtggccgtcgtcggggtcggagattccgccgataacatcgtgcgtttcctgagcgggtgcgtggcgaccaactgcgggcgacgcggcgatcgcctcgccgacggcgcctgctccggggcaggctgctgccagacaacgataacgaaggggtttaacgcctaccaggtcgagttccagaactactcgacagtgttcaacagctcgaaggatatctacaacgtcagccgctgcagctacgcggcgctgatggagtcgtcgagctttagcttcaggaggagctacgcgacatcgtcggaattcttcgacgccaacggcgggagagtgcccgtggtggtcgaatgggccgtccggaacgcgagcaactgcgtggaggcgcggaaaaaccgagaatcgtaagcctgcgtcagcatgaacagtgcgtgcgtcaactcgtccagcggaccaggctacatctgcaactgcgccaagggattcgagggcaacccttacctctagggatgcacgtgggtcgggctgggtcgacccaaggtctgacccacgatacccaaggcggtgatttgtgggtcatgggtcaagtcgacccacaaaacatgcttagcccactgacccaagagccatccatggggcggcccgcggccaacagcagcaagcaaactggaccgcatcatacaagcaaaatgacagcagcacagcagcacgcagcacagcagcgcgcaggcatcatacaaaccaaaaattcgtagatgattaatcatttgacatcagctgaaatcgaacaaatacaagcaaattgtagagctgaggatgcagagtcagttatacaggtaaatgatactattgataaaatcatcgccatcagatgcataaggggtttcttggttcataaaaaactgaaactaatcatttttcaatagcagatttgaccaaacaaatggttacaattatcattaggtcatcaacatatctattgtcaagaacatgagttgaggataagtctttgacatctcagcataaataggtgcaatgacacgacatggtccacaccaggaagcactgaaattttccacaacctacaaaacaaaacagtgagtatgtcaaaggtactagtttgcatcaagaatttaccaagtggatgagaatgcaagtgatattcagaacagctgagagtacaatataatgttgttcaacttgtttggatgagatacaaaatcaacataaaacagtcctaagtaacagacaaatgaggtttgaatcttttacaaacaaactagaacaatggaaaaaaacagttctacacatcagcataactagaaatgatgtacagggtactagatagaatatctgaatgcagttttcatggatcatttctgtcttaataactagaatatcagatttttttcactctcatccagagtcagttatacaggtgcatttcagtagcagctaattgatgccaatagtaattatatgtcaggtaaaagcctggagcacaaacagagctatcgaacagtaaaagcctcattacataacaatttccggtaaacaacacgattactaatgcactggaattacctatcaaggcatcaagtttcttcttcttgtgataagaccatcccaacagaagggcctagaacattaaaaaaacaattaactacataaactcaattggcactgtcatactaatagttttcaaagaaaaggggatagacttacaatcaacgactctcatccaatcctgtagacaaatgagagcctcaactatctcaggcgtcaatctacttctgtagtcattgattaccctccctcctgtactgaaagcattttcagatggaaccgttgatgctggaatggctaacacatcacgtgctatgtgtgagagtacaggatattttagtgagtttgccttccaccaggttaagatatcaaaatcatcaactcgaggcagtatatcttctttatagtatagcaccaacaacgatctgaggggtctccatgctttgaccaccttctgcataccaacaacataacatattgcaaaaattaatttcattattacgcacttaatcaacatcagcaaaaaaaaatacaaattgttaatgccaaggaataatacgatccatttacacacttctaccctggccaccggctaatcgagtcaccggctggcctggcaataactgaaagcatcctaccagcaaaatttagtgttgtgtaggcgtgtagcacatacttgcaaagatataactagagtttcttttggagtagtatctattaaggaggagtagtatcattgttggctctgctgccgtacaaaatcaacctaaaaccgacaaactgataggaaccaagtaccattgctagcattagtattcaaacataaggccaagcagaaatttctagatactattcaggaggtcactagagagtagagacatattaggcaggaaaagaccaatttctcattgtctgtagaaaaatcttaaggcagccaaggagacaaaatctacctctgcttaaacaggtccaaaagaaacagatcaaggtccagggcaaactgaatcacagttctcactataatctgatgatactcacgtttccttttggaacctgacttagctttcattgaatctttgcccttcaggaactgattctaaatctatgccaaattcccaatataatgcacacgtccaatcaattcctcccaatttcttgattcaaagcaaatagagaatcttgcatacctgcagcatcaacacatgttgaggtccgtcgttggcggcggcgcggcgagagtgatgctgggtgtggcgctgaaaggtggagcatccgcccatctgatccatccccttcttctatggccggttgggaggtctgctggtggcggctacgcggcaatcttgggggtgcgcatggcgctgcagggaggagaaacggagcatccaagcggcgatcttgagggtgcgcatctcgctcttccatggtagacggcaacggcggaggggcggagctccacaacatgatgcggcggaggagcggagagccccagcgcgatgcggcggcggcggagctggtcgtgccgcctggtactcgacctgaaacctagctaatgggtcggcccataatgctccatgggtcactgagggtcgacccatgatgacccatgaaatttcatgggtaagcccatgaggttttgaccccatgtttcatgggctgggtcgctgggtagctgggttaacccgacccatgtgcatccctacttacgaatttttttcgtttttagattttttttaatatttacagaaataatctatcgaccaaaaaaattgcagaaatagcccctgccgcccatacagagggcggcaaggggctaattgcaattttggccgcccataaagagcttgcggccgtactttttcatctgggtcccttgccgcctcaatagagggcggcaaaggacccagatgaaaaaagtacggccaaaagatttttctatgttatgttaataataaataaagaagtatttattggtaaaacttgttaatattgttataaaaatgtgttgaagttggttgttgcgcaatttcatatgttaagtgaggtattattttgttccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgcccctaacatgtgaacgtggtggggtatggtgggtacgcttgattggcaccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccaaaaggtatcgtgcacatataacaacaacgtagtcattacacaagcatacagttctggaaagtgaagcaagtaaacaaagagaagactgctctactggcgctgccccgcgccgcgaccacgcttggtcctccgggcctgtgctcgcacgtggtcctaggagtaggtgaaacgatccggtggcacagcacgggtagcacgagtgtcccgcggaggagtggcctgcgcctgatcctgcgtctgcaccggcggtgcgcctcccaactgtgaggggccgatgacgtcctctgtcgagcctgaagcgaagtcgaagtcagtgatgtcgaagaggaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcggcctgcatcatagcgaactgggcgaaacctacacatcgacaacgggacccttgtaagctaagacataaaatgcatgtaaattgattgtcgaagtaatattctttttttaagtacctgtggggggcacaacagaaggcctagccgaggaaggcggggtgctgaacggtgcacgaaaccctgaagcaatcggcaagtgaaacgactcacttatatgtgcgaggcatgtacagaaatagtaataaaaatacttacctccgtgcggagggggtctcggcctaggaacgtgcgcagctggatggggaccagtcggttcgggtggccgctgtacagctgcgtctgcccgagcaacgtcgtctgcacgacaggtgagcactcgaagaatcgagcgcatcgactccaccatccacgtgtacgtcgtcaggtgctcctctacgggtaccggaatccctgcatctaaatgttggatcgtcgttgaaccatcaacgacgacccggttgatgtcgtcgacctgcatggttaatttgttcgtaaatattcgtaaaatttgacgaagagaaagacatgaaaacataaaggaatggtgcgatgcagggtactcatagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcggggccagtcgccagctgactgctgacccttgcgcgagtacctgcgaattaatgtgtaatattagtgtgaaacgacagatgttacaaattattgtgaacaggcggattttaatgcaacaacggaaagcgtagtgcaagatcttaccggtgaacagcagctgggacggtggtcggaaacggtactggaaagggctgacggaagccgaactgccgcattacgcagaaaggggcgtgaggctcaacgcagatgtcgaataccatcggaaccatagtcatccagtacgcctggtccctggtgcagagtgtggacagacccaacggcgcacgagcctgggtagctgcggcactgttgggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcatgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaattgaagcagccacctcttcgtaggtccggtgttgcggtggtgtgccaacggctcgagcgggaggtgcggtgcgcgctgtaatagtgcgaaacgtgccgtcagatcgtcctgtcagtccacagccatggtcactggcccaacagcgtctcccgcgagcggtagccccaacaagtacgatacgtcctgtagggtaggggctatctcaccgcacggcaagtgaaaagtgtgcgtctctggcctccatcgatcgaccaaagctgctaggagggacctgtccacagtccatcgtctgggcgggtccgcgtcgccggccgcagcctccaccagccgacacatcggtaggaggccggcctcacgtagcctgcaataacaaattaatatgtaattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggagatctatcgccgggtccaacagctgaggtgtatcctgacgtgccatctctgaaaaatatagtgtttcgtgttagaacaattcaaaaagtagtaatgtaaaacaaaagatgactcgcaaattaatgaaatactcaaaaaatcatgagaataattacgtacaacaagagtacagcttatttaaataaagcaaacgttagtaatggtacataacgatgacgtgcaatttaacatatatgtagagttcgataatataacataacataacataacattacgtgtcgaagtccgacatacatcagcatacctaaagacactatgtgccttagtctgacgttacatcacgagaactaaagacatgacaagccgaagtctgaaattacacgacgaaacataaacacatcgataagttcgaaacaaattacaagcaaacccacatgccaacatagaacataagaactacaccatgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttataggtgtgcccacgttaatcgcatttgctgcaacgcttcaccctgccagcctccgactcgtccatattgttgcggatgcgacgagtcctcctccttccagccttgcctcggagcttcgatgggtcaggaatattgagtacttcatcgttagtctctgtgaactccccagctatgccgaacccgtaaatctcgccgctccatgtatgatatattgcttgcttactgaagtactgcgacacatatactgcatctggtatgccacactccgctgcggcagcaatgacatgggtgcatggcctgtggagcagcttcggctttgaacaagagcaatgacatgtgccgtcggctttgagaacacactcctgcttcactctcttgcggtagatacccctgcctgccttatcttgacatagtatctcgaacctatgttgttgggtaccttgcactagagctcgatgtttcatggcctttttacgcaactcctctagctttttctgcatgaaagttccaaacaaaatgctgttgttcggcatagagggaagaactgcctagaaccgatccctaaaatacctgcatgtcccatgtaaaatgaactccactatgccaactagtggcagtccacggacaccgcgcatcacccagttgtaaacttctgccaaatttgttgtcattattacatatctagcaccaccggtgtcatacaccttggcccatttctcttttggttcatgcagaatccactgagaaaatttccgaatctccaatccagttcttctaaccaaagttggactatctgttgggagaggtccaagagcttgaggagggtcatcaacggcagtcgatggagccgctgcacgctgattactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcgtcccaaacaccagggtatcctcgttccatgctcccaaacagaaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgtcagtatctggccccgatactttcctgtcaagaatgtcccatcaatgcagagaactggacgacagttcacgaatgccatcttgcatgcatgtagagctaagaacgccctttgcagcacactcttgccaggatgttcaattgatgggaatttcttcacttcgtaagagctcctagggtttctttcctcgataacaccaagcaggcgtggcaaattgtcatacgaggcttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttggtaacgactgacactgtccaataatccttccatttccccttgtacgcgtgcactctccagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctgactagcccattctgctggattaatatccgtctcctcatctgacgaatcaccttcctctacacgctcgttgtcaaaatcctccctctccatttcatccacaatggctgcgacagtctccccctcgtcggccactccacctggttgaatgcccactggagctac

SEQ ID NO: 80303 - DNA, 25520 bp, Oryza sativa
  unsure (1)..(25520): unsure at all n locations
tctgatataatctcatacattacatttctgttaaaatatgcacactatttttttttcatcagccgacgccttacgcccagtgaggaggttcacaactgtgcaatacaagcgcatattcaacagtatctaactcaaaagccggcccaattatacttcaaaatttgtgaactcttgactctccattaatgcctgaggtaacaccagtccacaagtgtgccactcaccgaatctcagctcatatcctaacatctcatggttctcttagccagactgtaattccactgtctgtttaccggtagtatgaggctgtgatgtacagcagagcagcggtagctgctgtaacaatcaactcctggaagaaatcaccaggtagttagtttttcccttttttatatataatagtaggcaatggttctgaacagagttgatagatctacaaatctttgcatttgataaaaagaaagtgcatattcttttgtacctgatagtaataaacaatgcgtggagtatactgccatgaaaactcaatcacgttaacagctgctgtataaccctggaaagattcatacaaagaaaaccaaaccaaaaggcaactgataaatattatgataggtagataacatggcagcagcagatcaagaaaattccagcattgcttaccaatgacgcggcaaatacacatccaaatatcaaacccaaagcacggactactcgttttgccattcgtattccacgtccttcaacctcaccatactcctgcagaaaacaccaggatgcgatcatatgaccattgtctaatcatttcaaataacggtcataagattaatataaaataaattcatgatggtacccatcatcagtaagaaccacccccatttgaaaagttacaaaagcttttgggggacggaattctgcgcatcttcttttgtttaattgcctttcagtttacaacagaatcaggtaatggaagcgaagtcaaatgatgaaacaggttcagtaaaaatacattaattatatttgacaaaaaaaactgataattatggaagtagcaaacaacagcatggcactccacagtaaaatgtgcaaattacagtatcatgattcataaaaaggtaaatagaggtgactaagaaatattttctcacattatatattggcgttattggtggttcagtagcccttagcttttgaagtattctgtagaagaaagcaaaacataggaactgcaatggcttccagtccgcattgcccatgatagctatccaaacaacctgcagggtagtacaaataaaaatcttttgcaagaaaatcgtaaccattgagatagaggtatcctcaaagcattattgtctagaacaaaaacataggagtgttactcgcattgtctaaatagtgccaattctagctttacaaaaagaaacaacatgtttactcttattaattgacctcggaaacatatgaaggttttaaacaaaagtaacctagccgcgtggttatagataatccaataggacttatatacctttgggctcttaataagggcattcaagcagaaacattacctagataaatcaaaacaagaagtatctgaacaaaaacttgtttaggctaaagcagcatgacagcatctattttggactggagcacaacgatagaactatataatagtgcatgcattcaaactaacatattacaagaacattataccacacagaagcatgctcccaacttataagtaaaccccaaagaatcaatatctttaaaaatagatagattttgttataacaattatgatatagagcccttgcagatatggaagacagtgccacaaaattgcaaaaaaggaaaaaaaaggtcagaattatatcactagttgatataggcatgtgctaaatattaagagaagagctgcatacaatggctgctgatattcctaaattgatgcgcatgtcctttactgttgatttggaggatctgcaagaagaatatatcaaccactagttattggattcaaatggatgtttctgtttaatttaaataacaagcattctatgtgcatatccttctcaacaatttcgctgtccatgcagaactagaacattgggggcctcatcgtttggctttttttcgtaataagccaaaacggcttattagagaataaaaatgaatttgtaggtaaaacttttatatatgtgttctcggtgacttaaaagccaatgctgaaaaagaaactacgttgaaaatatctcaaaatcaatgtcaaaattaagtttgaaaatttaaattttggctttttctttggctgaataggccatccgatgggggcctggaaatttcactgctcatgtacaatgcttgtcctataagatggaaatgaaaacaaaacaccagctgaggaaagcaaaactgaatagggcaaagcttgtaggacaggcctgcctttcagcggcctcatccacttcgcaagagaaacagggcaattcaaatttcttatgatctctaccaaatcttcatggctgtgtttatatgaaagatagaagcttgttattttccataaacatgcatcacatcaatcattgacatacacccaaagagattatcgatggactaatgaaatatagtattctaataataaacttgattaaaaaggtacctaggtccccaaggaacaattggctggtcatcagcatacttgatatccttcgacacctgacagtggaaacaaaaaccagggcaccggtgaataaaatcataactggataatataattgtaattgtaggaaatgatgtagacgacttttgagctactagtttatcaatagaacaaaaaatgtttgtggataaactaactgtagtaggtgacttatgtctggatataataacaactgttgccttgtttgatcctctatccatttccaaagttctttatatattttcaatgcagtggtaactggtcccctaattttcataaacaccagtgcgagatggtgccattcatagcatgtgttttagtgtttagttacttgcctccatcttatgtgttataatcctgtgataagcactagtaaaccgaatactcacaaaacttgtttcttttgcaaataggatatgtaggaaagcactctaaaatcttgcagttttgggtgcctctgcatttatagaaatctgacctgaacagaaccatatgttactcctttcttcctatactgcagctgctgcatcatcacagtgtcgtatgccttctccaactgaaaccacaagaagtatatcatcagcgccgagcaacaaaataacagtaacattgcaagcccaaaaatacaatctctgcacaatacagaacctttgacaggtagtactgatctccattctcgtccgcttccttgtgcttcctcttgtaggccagcttcatgtggtcgaagctatcaagcggggtaatacccagaatctaacaatccaacagcgcaaaaaatcaaaacacaagtccaccgagcgaataaaagtttaggggaaactgctcatttcagcttccacctcgtaggggttctcctcgtcgctgaactccgcgccacctgccgccgctgccgcatccgccgccaccacgaccaacccacgtcgcctcgccgccgacgcgaagacccttcattccatgccaaaaaaaaaaaaatctcaaacttatccacaaaccaaaacaaccccggtccgaaaagcggcaaggtgaatttaccgaagcgatttggggccggcgcgacgagggagcgggaagaaggcgcggcgggacaagggggacaccagcgcgggcaccgccgccggggcggccgcagccgccgtcgccgtcgccgtcgccattggtgcgctagggttcaaagcctcggacgcgacgccatgggagagcaaagcgcaaggtctatctctctgggaggtctcgcggaaggtggtggggttgggccccacgcgacccctcatggacccgaacgagttaggcccaacatcataatgggcctactgggctttcggcccatgttaatggcggtagccgccgccgagggggtatacgtagtagggggcccagcacgcgtggggaaatctctcccccaatccgtttcgtcctcctcgcgagcgatccccacctcgccgcagttcgccgacttttcgccgccgcgtcgcgctcccccgaggtccactcctctcctgccggagaagcgggcctaggcgaagagcagcgccatggcgaccgcttcgggtaagttttttgctagcgtccttttaccggtttccgtaaccctagctcgatcctgcgcaaaaaccgcgtggatttggtgtagatttcgctggttttggatctaggggcgttgataaacgggtgattccgcttcgattcgacgggaaatagggtttcgcggggatccgtacggtctctgcgttgcctgaattggggatcgaggctgttgcgattggttgatgcgaggagatttccgcggatgattctcttattacggtgatttctccgttgctgcagtgtcgtttaagtctagagaggatcaccggaagcagctcgagctcgaggaggcgaggaaggctgggctcgcgcccgccgaggtcgacgaggatggaaaggagatcaatccccatatcccccagtacatgtcctcagccccatggtatcttaacgctgataagccggtaagttgacgcttgctctaacgaaaaaaaattactctgtacgagtcaggtgatttttggttagtggaagttctgacttcatgttgctttgatggggttcagagtttgaagcatcaacggaattggaaatcggacccgaactacaccaagtcatggtacgataggggtgctaagctttttcaggctaacaagtacaggaaaggagcttgtgagaagtaagtgcggtgttcatttcattatgccattaatcctaatcagcatttaatcataaagttttaacaatctatttattaagtcaggatgcatcaatatgtagaatttgatttgtcttgttattcagaatatatttgaatgttgttttgattccaaatagccttaccatatttaagttttttttggcctctattacttctattcccagcccagattgtctaacggagaattatctgtatgttccagctgtggagccatgactcatgacaagaagtcatgcatggaacgacctcgcagtgtgggagctaaatggactaacatcaatatagcaccagatgagaaagtggagtcatttgaactggattatgatggaaagcgtgatcgctggaacggttacgacccatcgacgtacacccgtgttattgcagattatgaagctagagaagaggctaggaaaaagtatctgaaagagcaacagctcaagaaacttgaggagaaggatggtgaggagggtgacgagaacgtggctagtgaggaggaggatgaagaagatggtttgaagatagatgaggctaaagttgatgagagtgctcaaatggattttgctaaggtagagaagcgtgtacgtacaacaggtggtggaagcactggaactgtgaggaatttgcgtattagggaagacactgcaaagtatcttctgaaccttgatgtgaactctgcatactatgatccaaaaacccgctccatgcgtgaagatccattgccagatgcagaccccaatgataaattctatgtggtaagtatgagacaccctacaagtttaatgctttacactgtgttatggcccatattgatttcttatcttgcaaagactactaggttcagtattctgatgtgttgtttttcacagggtgataaccaaaatcgacttagcggacaagctctggagttcaagcaactcaacatacatgcgtgggaagcttttgataagggacaggatattcacatgcaagctgccccatctcaagctgaacttctattcaagagttttaagatcaaaaaggagaaattgaaatctgaaaacaaagataagattatggagaagtatgggaatgctgcatctgaagaaccaatccctcgggagcttcttcttggacaaagtgaaaaagagattgaatatgaccgaactggtcgaataatcaaaggacaggttggtatacaatactagttactgtcgattacacttctatagcttcttgctcaatagttatttcttcctaggatgctaggatgtagtggtttcaacctaatcttctgtcatccttcaaatctcaagtgttttttttttgttctttgccagtgtaatgttgtcatagttcttcctttaatagtctatttccgtaacctgtcactatagaactctacaccatataagatgtgctgtttagctaactacacataataatctgtttctgagaacgctgtttagctaactagttccatatcgcatcagatgacaagaagcttaaggtttgttctaagcacttaggcagttgcaagttatagagaccattcattacaactgcaagaaacttaagaaatgtggaacagcacatgaatgtagaactctccacacgagtgtaggttttgtggagctcttataccagtttttcctattagctctatccatttctgggtcattactttaatacttttcagttgttcacattatctattgtcttttgcatgtattagttcatggattctcaaagttcatttcatacaggatgtagcccttcccaagagcaaatatgaagaggatgttttcattaataaccatacaaccgtatggggctcatggtggaaagatcatcagtggggctacaaatgctgcaagcagactatccgaaatagctactgcactggcttagctggaattgaggctgctgaagcatcggctgatttgatgaaggcaaatatggcccgcaaggaagctgcagaaggtaagctgttgagagatattttggctttctgtgtatgtcttgtcagtttacactacacatgatttaatattcatattgccagtttagtttatgtgggataaaaacatgtcttcgtgggttgcatagctatcatatcaatgtgttttcagaaaagtattcccctcaaagttgtcttatttatgatagcgggaggcctcagatgtcagttgcttcatgcttatcttgttcaatgatgttttgtgtggataattggaaacgtgcagctgaaattctttccatataaactagcttaagtggtctattttacattaagccatgtgtgagtactgttagtccatgatgatgaacttcagttaacctgaaattgccaatgcagatgagcctgtacgacatgaagaaaagcgactggccacctggggaactgatgtgcctaatgatattgttcttgacaagaagctgcttgatgaagccctaaagaaggttagcacctttcatcttatattatctgtttcgttctgtcaatatatttatttatgtagatgctgacactgagttccattttttttgcaggagggtgcgaggaggaaagaggagatggatgaaaggaagaggaagtacaatgtgaaatggaatgatgaggtcaccgcggaagacatggaggcttaccgcatgaagagaattcaccatgatgatcctatgagggatttcctccattaggccttgtatgctccatagttgctcatatatgagcacaacactctgccttgcagtgtcacttgtgtaatgtattagctgtggctatgtcttcctctaactggagtgataatttagagctaagagctctctacttctcttccagatgttaccatcctcttgtccggatggttgtgtttgtattgctgatctttctataaatgatatggaaaaaaggagttgcatacttgcatatgcttatttgagatgccgaagttatggatacgtaatgtacaaagcaggatggagaagtgctaatttttgtgtgtaagtgactcgattgtatttaccatgattcagactctttttatactttctcctgcgacggatgatcaccgttacccatgcaagattttttttcccctggagagtatgcaaactgatgatctaaacaagccggaaatccctgtttctttttttccttgtgaattgtgataaacacccagcaatatacatccatgcaaccaatgaatgcaacaatcctacataaaactaatatttacacgaaaagactccaaattcaaactatagcaatcttaagaacacgacataatctcctcctacctaagcccctaaaaatcttccaaactccaaaccatagctacctatcaataactcttaataatcatgcttagattatgattattatacaaatgactaataataaactaagatgatgatgtgtcataggcctctcgcgagcatggcttggaattcctcggcggatttctggttctgcagcctcatctcctccctgaactttctgatgaacacctccgccctcacatccacctcccccatcccacacgctcctcctcctctcagcgggctcatcagcaagctcctcacgccgccgcgcgccgccttggcgccgccgccgttggtcgccgcgccagcggcagcagctttcttgccgccgcccacccgccccttgcctctggccccggcagcggcgttggtcgcagcatcagcggcagcgttcttggcggcgaacatggcgctagcgttggtcgcggctacagcgttgttgttgttgttggcggcggcggcggcgacggcgcgcgccttgccgctggcggcgccggcgttggtcttggcagcggtggtgttcggctgctgcgcctgcgcctcgtggacggcgacgtggtgggtcttgggatggctgtagagctcgtcgacgtagaccggcgcgaagctccggtgatggcaccacccctcccgctcccgcgtcgacgccgtggcggcctcgcggcgccggcgcccaccaccatgcccgcccggccaccgcacggcgcggcgatggatcttggactggatcaccggcgcaacttcagcgcaccttcgccaccacaaccgccacggcttcacactcaccctcctcctcccccttgtcgacgacggcgacggcgacagcggccacccggcgctgctcccgctcgccatgccaaagcaagacatgctagctagctctcagagagttgaaagcagcgtgtagatcgaagtaggagacgccgccatgggaggagaggagctttatagcggcgatggcgagagggggtggcgtgaggaggaggcgggggatggctttcggcggttttggcgggtaagactcacgctatgtggttgactgcgcattccttctttggttggttggtgtgggaatggcagttggctagcagctgcctagctccaacctgtctggctggctgcttctctttttttttcgccttaaatggtattcttttcctcggtctctatatctaactggatatatacaatcttttatattagaaacttagcatattaaatatgaaacttagccctcaaataacccaatctaaaatgtgcttatatagagatttgaatttaaaactttagggtgctactcaggtcactgcaagtctgcaacctataggttgtttctctttgcttagcttagcttgccaatgcctttactgctactgcttttttcaggctttctcacctgctgggcttgtgagatctggattagtgtcaactgtcgactgtcactgtactccagtaatgtgatgggtgttttttctaatgtgatgtttttttttgtttgtattgaggatttgagggatattctcctgttcttaaaattcagtcttttggggttcttttaggggtaacaatccataatcttcttatgttcttatcacatattcaggaaatttaatatatgttattttctaaatcttattgtctaatagccttatcttttctcttatgcttatgcttatcattcaaaatttgaattttcaaccttagtgatttggggattttttttcatcgaagtttatttttcagtatttgcttttagatcgttaagaacacgtatatagaagttttattcacaaattatttttcatttgtaaatatgctgtttgacttgttccccaaataagacaaacgatgaggccgtaagacttcatctggatatgaaaggaaggactttatatcaatggttttaagcacggagtgagtcccaaacccaggctgatcaacccactaatttgtggtgctagccactaaaaaccaatgggactttctctttatcacatatttagaaaaagaaataaacttaattatatggaagtgtttatttaatatatgacaaatccactaatatcagttttactcatcagtgtgatgtgttctattaattttccaaatgattaggctgttgggtcaaggtgatcagatggtcttaattagcatttggctgagaatcaaaatgactgaactttggtatctgattcttttttggggtgtggaagtaccccacttgagcaccgaaaactatctgaaaccaaaatgaacattctcttgacttgactaatattgcagcaagtgagacttgaccaacattaactcactgatgtgctataaatcactagaacctgagattaatgattgtttaatcagaaaagataaccatgctaacagcatgcatgcttaataattcttgcccttttggatcgcttgaaagtgtggatacacaaggccccatcttctgggtagctgtctcaagtcacagggacaagcaccaaaggccaaagcaaacaatccagtagagcacacatgaaggaagatatatacacatcttcacaggtcacaactcacaaacagctaattacaagttgctttttttttaccaaatacaagttgctttgagcaagcacaccgaccacttatgggacttgtgcttgcctgcctaagaaaagaattcttaaaactcctcccaaactaagtttctctaagtacaattagctttagaatcttgtgtgatcaaggggaaacttctcttgagatgcatacgtcttcttcatcggcaaaagggcggcagggcagattccatcatgtttgccgagattttcttctcatagatctcgtgaattcgtgatcgatcgagctagctgaagctgatgcccaacttgcagcaaaaagaaataaaaaaagggaagaaaaaggaagattctatcctcgtcttgtttgcgtgtacgttgctagcttaaaagctacgagaatgggaagaggaatatgcacatctttatcagatgaaaaattaactagttaatcagctcgttaactacatggtaattaatttaatcctacatgctagtggtactggagaggagactcatatgtgcaggcacacgagggtcaattttaatataattgtggtagattcagcgattttaatattcaggaactgtgtctttcactctttttgcatcaaggactttaatttgctggcttgctgagcatgcatgtgcttgaggagtggatattctactaccctggacacatacgtatatatggtcatgggcagctggatttatttgactaattgactgtagtattgatatcagggtttacaatcccaatatagaaaataaaccgctcatgagatttcgtggaatccatttacaaaaccaatgaatcccaacaaatattgtcaaaaaactaacattcagtttgttttgttttcatctttgacttaaaatacccgagcgttttctgctttcgacccgatcagaagactggttttctttgggattgtaaacagagagctttaattaatttttcggaattgctatatttttgtcagacagttttctagtgctgatctgacgaaaatgtttagttcacttttctgcatggatgatcagcataattgggctgggctgctacacgggaacaagtggaagaataagttcatgttaggtcccttcttttttacgttaagttttaaatcacatccctaaaccgcaaaatggggatgaacacatcctttattattcaaaattcagtcctaaaacagtattaaaggctattttgagtgacatagaacaataagcaaaaaaacaaaaaaaaacacatgagacctatatgtaagtgaaacatatccgatgcctaaaacagcccaaggagttaatctcataaggctcacatatttgtcttgctgcctggccttctaggcctgttccaagtgcagcggcgaccggcggcccaacccaacccgtgagcccaccagaccgatggataaaaacggtatgaaaatttcacgacgagcgacagaaaaaataatataataataataatttttaccacggttaccgtttctaaataaggtatagtttttttcctatttctatcaatgtggagtcaaagttgacactaaataattaaatctataaatataaaatttttctgtttttatttgtttctataaaataataaaataatgacaccgttttcgactatttccccctcgtccctacgtggatcgatccgtccgataccaatgtttccatggtggtaactgagctcgggactcccgccgcttaggttgattaattgcgtcgtcgtcgtcgcctgcatgcccccgccgcgctggagcgcaccgtctgacatgcttcgccacgcatggccgccgcgcgctgggtttggcatggcgcgcttgtgcgtcgccgtggcgccacggccgtctccggcgcgcgcgtggcatccatggcatggcatgcaacctctcgcgttctcccgtccgtccatgccctgcacctcacctaccgctactgtccaatgcacgtacgctgttacagacttacagttcgtgtaaagtttaacaaaattgttcagatatggtcatatggatagactcgtaggaccttttcactgtgtttagagagcttgtagtttcttttaaatcttaagaagtttgttgcagttttttattacaatctcaagctttctggctttctaaacagagtagattctcgcttatattatttttaaaaagagactacaccacggaatttcgtctggacgggatacttaatactcccacggaatttcgcttatattattgctgaggttatcccacaccccactttttagctcttactctataagggcacgtacaatggtgtttatcagtggtctctttctattgccatgcaagtaaatttgatgacatggaagaaagagaaatgagtatggttgttatgcatgacaacagcttagagtcaactcttagcatttattagagcaaattttgttgtatggtggtgaaagaaaggaaagaaaagtaagaaaaagtattttgatacattaatgattagagaccatattgtctctaactgttgtaggatgctagtctctagataacgtagagctcatatctgactctacctttgtacatgccctaatgctacgtactctcttcatccaaaaataacttaatctgaggaccgagcgtagctcggttggcacattcgcagtggagcgaacagccggtcgcgagttcgactcacgggacctcacctcgacgggatttttccccgtctttcttcgggactgtccttcggggcagtctcgactagaaataaggtacatacgtgtgcgtgtttagtgggactgcacatttcccgtgcactgagacctagtggtctccaatctcattcctagtgtgtgttaaggacgcgcacgcgtgtgtgcgcgtgtgttgtggtgtgagtgtagtgtgtgtgtgcgtcctgagttgtaccattctcaaaaaaaactcaatctagacggatatgtgactctttcttcttgttcaatgaatctggataattaactctttatccagatctattataatagaagatgtcatatccttgtttacattaagtgtattttctcaaaaaaaaaagactgagtgcattttctgagacgaatagagtagtactgtaactctaatctaagatgcatcacttatctcactttatctgtggtgttacccatcctacacctccaattgctgtgagagtgacaagattgacaaggcaagattgagagaagatttctcttgttcggcagctttagagaagatctctctagttctccacacacacacgttttccaaactattaaatggtacgttttgcaaaaagtttctataggaaaatttctttataaaattatattaattcttttttttcaaatttaaataattaatactcaactaatcagtatggttcatctcgtttcacgtatcttcttaatcttctttttttctctaaacacaaacgcggccaaattactagagaaaaattacaatttgtttcattggaaaaagaaagtgtgcgacgatagaaaccagacctaaccaggcatggtacacgcatgtggcaagaatggtagtacttacttttagatcaattggtaaaataaaatatgatacccgatacttttagggtaaattggaaccatgccattataattttacaaagtttgagatatgccatcggtatctcaatgacatgtaggacccacatgagtcaatgacatgtgggtcaggatgatatatcttaaattttgcaaaattataatggtatggttctaattttcccatacttttatgatacataataactccacaatacttaataattgatactatcttcattctaattgaaaaagagtttattttttttataaggatctgaaaaaaaacttgtccatatttatatataagtgaatttttgagatggaggtatcacacccataatattcataggtactataaaatttggtaccaaaaggttcaagtatcatgatattgatctccatgacaccaagataccaagatacttgtactatgacatttggtacctaatggttcaattatcattatacctaatatcaccatgatatcttaagatatcatgatatatatttgatacatttatgatatttaggtatcatccatatctatatctatatactactcgtacctgtttaatggtaccatcatacatgataccttcatgatacccaaagaaatcatggtatttaggtatcatccgatatttttatatttattgaagttatcataatacctgaaactttcataatatctgatgatactacctctatattttaatagataacgccattaatttttaggcagacgttggacccttcatcttattcaaaaattttagggctaattggatccataccattaaaaatatgttggttttgaaatatgacactagtattcacgtatcgggaaccatgccattataattttacacgtattcaagatatgccactaccctttggatgcatttacaaaaatctggaccaaactacccttttccccttattccttctcccttcttcccctttcttcttccgcctctcctccatggcgtgacctgactggcgatggtggccaccacagtcacacctcctcctttctctagcactctttcgttcgtgtctccctccaccttagcccgccgccggcctcctcatgcgcgtcatctccctccacctcgacccgccgccggtctcctcttgtgcatcagcgcgtcctagatccagtcgcctctcctcgccgtgtgaggagctctgggcaatggcgatgaccaaagaattaaagagcggccacttctctctggcaagctcctgcacctccctccctccctccctcaccgcacccgcagcttctccggttcagcagctgcctccaccacctcgacgcccgatgcagcgaggacggccttcgtgaagagcctcggcagatggcggacctgcggtgttctgtccggcgctccgagctcccgcgacggatgtcgcaggcgaagagaggtagaagatgagtgaagagagagagatagaagatgaggggatttttcgtccaatacatgcaaaatacgtatcttagtggcaccattgagattacgaacaagcagcagtggcattgttacaaatacacaaatagtaatggtatattttaaaaccggcaattttttagtggcacgtatctaattaacccaaaatttttaatatgtgagtgtgtacgttctatgaatctgtcacaagtcatgacgccgcgagccgcgtccagctacaaaccactcaacccaaacgcatccaaaacccctcgctgagctgccatgcatgcactccccctcctcccactataaattatcaccacctcattcccgccatgtctcaccaccaccaccaccaacactgcaacacaacacaccaccatgaagacggcatcaatggcggcgtcgctgctcatcccgctctgcctctgcatcctcctcctgcgcggcgcctccgccgtgagcgaccagcaagaagccggccgtcgcgatagctgcgaccgcatcgaccgccgcatccgcgcgctggagccgacgcgccgcgtcgactccgaggccggccacaccgagctctacgacgaccgcgacggccagctcccctgcgccggcgtcgccgccgcgcgcatcaccatccagcgcaacggcctcctcctcccttcctattccaactccccccgcctcgcctacatcgtccacggccgtggcatcgtcggcgtcgtcatccccggctgccccgagacgtaccaggagacctcgtcgtcgtcgtcgcaggagcaggaggacgacgagcgccgccgccgtggccgccgtggtgatgaggagagacggcgatcgagcgagggagaggaggaggaggaagaggagaccagccgccgcagcttcgagcagtccatccgcgacgagcaccagaggatcaccaccgtccgccagggcgacgtcgtggccatccccgccggcgcgccgttctgggtccacaacgacggcgactccccgctcgtcgccatctccgttcacgacgtcagcaacaacgccaaccagctcgaccaaacctccagggtacgtacgtgcgtaatcaatctcgagattaattaattgatggactccatcggtcgaacacctaacgtgcaatgtttcttctgcagcgtttccggctagccggcgggcaggcgaggagcgaggggaggcagaggtacggtgagggcgagtcgtcggagtcggagacggaacgcggcggcgaggagtcgtacaacatcctgagcggcttcgacaccgagctgctcgccgagtcgatgcgcgtcagcccggacatcgcgcgcaagctgcagggccgcagcgacaagcgcggcaacatcgtgcgcgtccgccgcggcggcctccgcatgctccgcccggcgacggagcgggtgaccgacgaggagatgatgaggggcgccaacgccgccgccgccgccgggaacgggatcgacgaggccgtctgcttgatgaagctccgcgagaacgtcgccgacccgatgaaggccgacctctacacccccaatggcggccgcatcaccgtcctcaacagccagaagctccccgtcctcaagctcatcaagatgagcgtcaaccgcggcgtcatgcgccgggtgagacgacgaacgatcactgttttaaacagttggtggacgtccacccgtttttttcatggcatctaaatccttaaaaaaaattttcaaaaaaattaacatgataagttaaaatataatatatcacttcagaaatatgtaaattgaaatttaacttatacaagttgtaacaaaaataacaacttgtaaaagtcgaatttgaacctgcatatttgtaaaatgatatattactaacttgtaattttttaaaatttttttttataattatttaggtggtatataagaaactagtagacgttcacctgagagtttagaatccaacttctatgattaattaacagacacgaattaatcgatggtgtttgatttgatttgcagaacgcgatcctggcgccgcactggaacatcaacgcgcacgcggcggtgtacgcgacgagcgggagcgcgaggctgcaggtggtgagcagcgaggggcggcgggtgttcgacggcgagctccggcgcgggcagatggtggtggtgccgcagagcttcgcggtggcggggcgcgccggcgacgaggggttcgcgtgggtgtcgttccagacgagcgacggcgccatgaacgcgccggtggttggcaagtcgtcggcgctgcgcgggatgccggcggacgtgctggacaacgcgttcggcgtgtcgagggaggaggcgcgcatggtcaagttcgggagggggcaggagctcgccatcttctcccccaagtccggcgccgccgcccgccgccgccgctctcccggccacagggacgacggcgtgctcgccgccccggcctgaggcgtacgtagataccagcgtgagcgcacgtgcgcatgtacatgtagtactaataatgtgcacgttttccgttaagggtgccacgcactgcatgcaccgtatgttggcccgtacatgtacggtgtacccgatctagaataaatgaagtcgctgctgctaccaaagtgcagtgtgttaattaagagctcgtttcgctttatcaattaaaatttggcttaaactgtgaattaactgtggaacaatccgaaattttgtcggtcgatcagcgcatgaatctatccatggctgtgttcttaagagcaagttcctaacactcatctctctcattttccacgcgcacgttttttaaattgttaaacggtgtattttttttaaaaaaaagttttctatgcgaaagttgtttagaaaaatcatattgatctatttttgaaaaaaaagttaatatttaattaatcatgcgctaataaactactccgttttccgcgcccattatgcaggttcccatcctcccctagcgaacacagccataatattagttttacatgagctcgagggaggagtcgtcaaccatcgtgtgtagttgctggaagtagggacgtaggcgggtgaccgtgaacttgtttataggtcaaacaagtagtaaacctgcgggttcatgtgtcgtggtctaacttactgtatttatggatgtaattgagtcaacccatgaatctacttatatgtcaaaaatactagtaggcaatacacaaatcaatctgtggcttactcactaattttatctataaatggattctccgggtcggcccacttatacatccctagctggaaggtgagcgaggaggaagagaggagaggggggagggggtaaggaagaaggcaagatgaggtggaaatcacatgctaactcaacaagttaaccacgatcaaactgccacatcagtagaagccattttcaaaaccatgaaaggagttgatttgcaccggttttcaaagatgaaaaaggtatactctttttagttttgcggttgaaggagacaattcaactggggagcaagataggggaggaaagacagacttattcccaatgcgtacagaatactggcccaagtccactaaactgcccaagattgcaggctcacagcacagcaccaggattgctaactcaacaagtcaacacgatcaaactcccacatcagcagaaaaccatgaaatgagttgatttgtaccggttttcaaagatgaagtaggtgctacactcattttgcacttttgcggttcaaggaggcgattcgcgagcaagagaggagggaggaacaacagacttatttacaatgcgtacagcccaagattgcaggctcacagcacagcacagcaccaggattcctccatttccaccggcgccggcggccgccgaaaccgcccgctgcactccggcggccgcccaccgtttccccccaccaaaaaaggtaccaccgcctcgctccttaacccccctacccccgaccatgtcgccgcgttctcctccctccaatccgccatggcggcgcccaagccactgtccccgcgcctcgccgtcccgctcgccattgctctcctcctcgccctcggcctcgtcgccgacttcctctggtcatcatcttcctcctctggcacctccggccgcggccagctcgcctccgcttccaggacggtaagcgcttgattccgcccaatgcggcctgccccgccgccgtgatgcagcttactctaccagcctatgcaggcaacggcgaagaagagcggtagggcgcgcgggaagaagccggcggcggagggctacctcaatgcgacgtacgccgacataccggcgccgcggtgggactgggaggagatgccggcggcgcccgtgccccgcctcgacggctactccgtccagatcggcgacctgctctacgtcttcgcagggtacgagaacctcgaccatgtgagaatccccccctcttacaattccacactctctttgcaaaaatgcattctctcatttactaattttctgctttctgttcacctcaatttcaggtgcattctcatgttgatgtgtacaatttcacttccaacacatggacggggaggtttgatatgcccaaggagatggcaaattcacatctaggaatagcaacagatgggaggtacatttacgcgctgaccgggcaattcggtccccagtgccgatcacctataaaccgcaacttcgttgtagacacagtgacaaaagagtggcatgaactgccccctttgccagttcctaggtatgctctatggagtctgtcatcacttaccattggtgcttatgttatgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtgatgggtggtggaaaagaagatcgccatgaacctggattagagcactggagcttagctgtcaaggatggcaaagcattggagaatgagtggcgaactgagatagccataccccgtggtggacctcataggtttgtacgagtgtacttgttgtcagttgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagagggagacttcatggcaaaaccaggctcgccgatatttaaatgtgtacggaggcatgaggtatgtatgcttatgtaactccttgatgttacaaattgaagattacttacctgcacctgatgtttattcccttattatcaaaatacaagatataacgctacagtttgcattggccacttagtgatattaacacttgatgtttttaactattctaaacaaaaataacagtagttacacccagtgagtacttatcattgttaaaaaaaaaagtgacatgaacttccatataagaattctagttagtagtctctgtttacattttgatttttatgttctagccgtttatggctatagcttgattctgccataaacacaatttgcacttttgcaggttgtgtacggtgatgtgtatatgctagatgatggaaataaatggaagcaactatctccactgccaaagccaaattcccacatagagtgtgcatgggttatagttaataactctgtaataattgttggtggaactacggaaaagcatcctattaccaaaaagatgattcttgtcggtgaagttttccggttcgatttggatacactggtatgtcagttatatgcacctttcatggttatattctcccaagcatagtcaaatgatttgacagataaacatctggaatgctcctttttcagacatggtcagtcattggccgcatgcctttccgaatcaagacggccctagctggttactgggatggttggctctatttcacttctgggcagcgagatagggggcctgataatcctgctccaaagaaagttgttggttgcacgtggagaacaaaactacacctttgatgtggaaagttttagctgttgttactgtagattataggtcagtatctgtttcccttttctaactgctaggctctccagaagctatttttgtcctgtattttgtatgatagattgacttctgattcatagtgtccttgttgtctatattgttgtgcatccacatttcctagatgaatttcttgccatgttcttctaaatggccagaatataatatattaacacaatcattttgccacttcttgctgccttatgtaagatagtcaccttgttggtcgtaccatggactgtatctgcagagttcgaactgaagtttctgttgcgtgttctgaatgttgacgttcctcctgattttgatgctgtctacttgtgttctgaatgataacttgtgtcctgattttaatgctgtttacctgcttgtcttcattctcacgtttggaatcggaataccagaatctaggcatatctccaaacaacccaaatgaacttctgtaacagtattttatagatccaatccatttccaaccttttttgagggtagcagcagtcaaggaatcaatatagatctactgtatcgaaattggattgtcgtcctctgctttgtcattctgttaagctatataagtatatggtttacttatgcagcaaccatttttgtcatgttgcatggctgtttgcacctttgacaatttggtatgttaactggcttcaattcaaggggctaattgactgtgaaacgtgaaccattctgcgctaatattcttttcttcctacgttgcttgtgacgaatattctgctagattgagttgcggctgatttagctactatgtttctttcaagtttcattgcacgtagcagctttagcagataagctttaatatattttatgactatgcttcaatctattttttgcctaccttttcttcttctaccatatataattttcatgtacaaaagggctccacgtcgagttacaattattttatttatttaactaatcatgatagcattggtgcaattatttgcatatttattagagatagaaatagacttcatcaatttaattccaagatataccaactatttcctcccccattttcttctcatttgccttgatgtcaagaaagaatcatttctcctgcaagaattattgaaccccattataatatagttcatgatacattttctcctcttctggtgcagatcatgaccagctgttgggtgattactgatgacactctctgctggatgattgtgactcagtcatttcttcttcttcctttgtgtagcttaaactttgccggcattgacaggggacctgtcacaattaacaatggctaatcatcaccgcatggaactgacttggtcttatcgtcttatttagtaggatttaattaggcccaacttctccgtggacgcccggtctggcggtggcggatgggcggccggcgatgagctcgccgtcgttgtcgccgctgaggcgagctgctcgcccggtcaccgactaccacctcaaatccatgcatgccgatatatattttctgaaagctcacatcatcgtatgatactaagtagggtcaaaaattaaatttggttcgagttaaaaaatgtagctgttcttgttactgaaaattagatatcatagaactgttgtgttgtatatgaaaactttttagtaatcatggcttctaagctacatcataatcatgtagcctcattatttttactaatgaattcctggtctcctggactattttcttttgcctgggtgtgttgctccttttttgccacaaagtcacaggagaaaaaacagccaatcatgggatttgtgttgatggtgatgtgctaattcgattccatttgtgtatggacatatggtgatcggcatggggccaatgattcagtggctctaacacatgtcaagaaaaaaggtgatgactaggatcaatcaaaacacatacacacacaaaatggtttcagaagtagtcgcgagttgcagtagttgctagctacatctagtggttaaccaacttttatctagaggttacgtctaattgcaacagctgctagttactagtagctacatctaactaatctaaggttaactacatgtaactaatctaaaggtgtttacccttttttggtctagagttttcttactgtccccaattcccatgatcacctttttagcacaaaaatcatgtcaacaggggttaaattatgagctgaggttgtttatggcctaacatatatccagcatatgacaaaatgcaaccacacgttttcctttctttttataatagaacaaatttctcagcctctggatttcatttataattaattgtccacacaaatacagtcgcatatttaaaggccctgtttagtttccaaaaacttttttccaaaaacatcacatcgaatctttggttacactcatagagtattaaatatagataaattcaaaaactaattgcacagttagaggagaaatcgcgagatgaatcttttgaggctaattagtccatgattagctataagtgctacagtaacccacatgtgctaatgacagattaattagtctcaaaagattcatctcgcggttttcaagcgagttatgaaattagttttttcatttgtgtctaaaaaccctttccaacattcggtcaaacgtcctatgtgacacctaaaaatttacttttcacgaactaaacaaaatgatcaactactggatatacatctatagaaatacgaacatacacttttcccctaatttgaaaacgatattgatccaaattttataaaatttagaattcgactttgctttcactttgccagtcatgcggatctttctggcatccctcacacgtaattactccacgagccttccactcgaatctgccacgtcaccgacgaacggatgggatcacgccacgtgtcccctacccctccccggacggcgcgggcaacacgcgatcctggccgtggagtggagagatccctttgctcgctgagcactctaccccgggtccactgacatgtgggtcccaccactcgtgtgggcccgggaagtcgctagaataaataggccccacacctctcgtctccgcctactcacccgcccggtatttaccattctgcccctccggcgagccccaccctttcccgccctcatggcgcccagcaaccgcctcgccggagctgcggcggcggcggcggcggcgcctcctcctcctcctcctcctccgccggctnctctacctccgagaggatctcccgcgccgtcggagaaccatacagcgatctcggcgcctctgctgcagcccgcgggggcgggcgcgggcgacgcggcgccgctggcgaagtggctgcggcggctcgaggcgttcctctcggcggcggggctcgcggcgttgagcccgctcgggaaggcc

SEQ ID NO: 80304 - DNA, 755 bp, Oryza sativa
taattgagtgatcggtatcgattattaaacactgcaatagattaggtaattccgttcattatataaagcaatacgtattgccttaataataagaaaatgttagggtcggttatctctctctctctctctctaataaaacactctctaaatagtacaacattacacatgttctcaggcaactctagtactagtgttttcgtcaagttcggtccacggaggctgactaaaattttggcccacgaaaagtaattctcaatcccacctttccccgggcatgcagcaacaaatatgatttttgagtattcgactttcttttgagggttaattcaatcctgccattaaaatttgctaatccattacaaaattgctaatttgacaaaatgttattactattcgcgatatctcaacaacaatgacatacaacggtgctggctccggagacctctcgtcgcagatgggaggtggtggacgatgacagcaacggctctcctcccgccgtagataggaagaggtcgaagacaacggtggctcctgagccctcttgttgtggatgtgaggaggttgacaatatatggtgatggcaacggcggtggctctcgagccctcctaccacggataggaggtggtcaacaatgatggtggtgaaaacggtgacttccgagctctcccgtcgtggatggggggagatcaatgacggatgcagcaacggtggtggctcttaagctctcttgctctagcttgcttgagctcgttgt

SEQ ID NO: 80305 - DNA, 23167 bp, Oryza sativa
cattctccggctatcacaacacaacaaaatagtacagagaatcaaaccatgtgttactattatatactatgcgtttagatctttccatttggatgtagaggccagtttaatccattagtagaaaagaaaaaagacctttcgagttggttaaataattaagaacagagagttagttccttcaccttgcaacttcaagcttagctacttctacaagtagcagccgtatttcctcatcgacattcttcccagccttcaaggaggatgtgatccctgtggttccggtcctgccaactccctagattttaaagaaagcaagctgagatgacaatataggtccaaataaactattcagaggaccgagtactccatccgcctcaaaatataagtatttttagaataatgccaagtcaaactttttgaattttgactattaatatgtaaatttgatgttactaagtttatcattaaacaaataatcataatatgcaacttttttaaaaaaacatatattgttggtcaatgtagtatctcaaagaccgtgtcgagatctaaaaatgcttatattttgggacggagagtagttactagagcaggtacaatagcaggctataagccagctataaacatattttaaagagataaaggaagagagagaagagcagcgggctacagatctgtagctagctgcagcacggactccaagacgtaatgtgtgtataacaggtgggactaggtattaatagtatagtaagcaactattgtaagaattggctattacattagctatagatgatttggagctagtagtgggctatactattaaacttgctcctagtaaatgcctacaactgtaccataatttcttcacaggaaatcaattgggatggttgggaaccaaactcctccgcacggaaaacggagcaatccattagcacgtgattagttaagtattagctttttttaaaaaaaatagagcaatatgattctttttaaacaactttcgtatagaaactttttttgtaaaaaacgcatcaaaataacagtttgaaaagcatgcgcgcagaaaacgagaggatggagctgggaaaaggggaaacgaaccgagcctaagcaggccaaacaggtggacaggaaggaataatttaaactattcaggtggacaggaataatttcttcaaactattcagagtactccctgtcataagattattatgtgaacgcccgaaatgcatctatccttttaattactcaatgaatggaaatttgaatccattccgtcaatgcatgcaattttcaagcatccaacctaaatttgttcttagaacatcgacagtaagtttcgaaaacatatctaatccctgtaaaagaaccagtttgcgcttcaaagtattcgtctagtttaccaggaatttccatgtgccaaccatgtaagctagacgtcctagctaaagctctcggtatactaggtactatttatattttgagcggtgttttaaacagcgagctaagacatttagaggttagccttctcaaaagctatagcggctaaattttacatgagaacaaacagctatagacggagatagcggtagctattgcaagagatttaaaaccctgattttgaggcttgtgttccaggtgcaacgacaaacaagtgatgcatatgtaacaatgccacaacacgcatatttgcatttttagcaaccaaatggcaactcaagttcagtgattctttttcagtaaatgcctaccgtggaatagtttaggcatgcatactagtggcaatatgtggctactatcctttcatctgcgtagaagattaaaaacttcttgatcgcccatgtcgataagcaaacagattgccctaattttcacaggaaatgcataaaagctagattctgtgcatgaaaagattgttccatcatcatcagaaccaacagatggacactaacagttaatccctgctataggaacatgttttgtacacagttaaaaaaaaagaagcaattttcatgggtaaatcagtctccgatctgaacttttattttcggtagaaaatctaaaagttttggaagtctcagtaaagaaaaaaaaaactaaatcaccaacgtaccccaagctccctccaccttaccccaatggttcgtctaaaatttctcaacgaactgatcaagattcaagataccccaagaaaacaagctaaagtagaatgaacacagagccaaatttggaattgaagacacaactaagcttaaagtttgttgtttttttttcttttcccctaagaaaacgaaaggtgtgcgtcgatccagcttggaatctgggcacagtacgtggaggtcgattgattcgtcggcaaacacggtatatagaacatgaagggatcgatggatctattcgtggatcgaaaggaattaacgaactgatcacctgggtggcgttggcggagagggatcgagaggcggcaaccgcaggacgacgaagcgcggcgactacagggcggagatagcgcgtcgccatagcagcagcagcagcaaagctaggtcgaggtctcgaggaggaggagaagattggaagcttaatagtggtaatcctcttattggaacacgcagcgtactgcgaagtagatgggcctatccgataaaccctagtaaatcctgaacggtttccgggccagttattatgcgatacctacctggctttctgattgcctttgtcctacgtggacatataaatgatgcttggatacatggctttacagtaagaaaatactacctccatattttaatttatgacgccgttgactttttctccaacgtttgactattcatcctattcaaaaaatttatgtaattattatttattttattgtgacttgatttgtcatctaatattttttaagcatgacataaatattttcatatttgcacaaaaattttgaataaaacgaatggtcaaacattggtcgaaaagtcaacggggcatcatacattaaaatatggagggagtatcttttttttaaaaaaaaaaaccggcgagacccatatatatcaatggcgacgcgatttctcgccgggaagctcctcgccgccgctctccgccggaggactgcggtctccaaatccgccgccgccccctcctcctcaggtatgtagacaacagatcaatggcacaaccaaattaattacgagatttaatcttcatcgatgtccgtaatctagctgttgttagttaagttaatttcctgcttgagctcggaggctacaattaagttaattgtctcctactttgcatacctgcttatgtgagcatgaattttaatgtgatttttttcccctccctctgtctgcttacatgatcataaaattaaggacctcaaggagtatgagtatcacgtacaacattatttaacaattccatgtgtacagtgtacttacttgcatatgtatcgatctcagcttgtttttttttctctatgtataactgttcctataaattttagggaggatgcacattcagcaatggaagaactaaagagactgcatcttccatgaatgtggacgagggaatgcgtatgctacgtacatgaagaattagctaaaattgaagctacaaggtgaagtaactaacattgctcttattcttgtaaatcgtatttaaacgaactcaaaaggtcccactcaatgcatgattagtagcatacatacaaatgttctctctgttgttttgacagcaaggaaatagccgagataataatgtacaacaggttccaaagaaagtgtgtaatgggatcagttgttcttgggatgggccttgcaggtgtctgtcacgagcaaggattatgtggagaagaatcggggtgaatgggaatagattggattatagtagatgaaataacaacaaacggtgctgaacctaaacggcgcgacgctctccgtcgcattgagaaggcaggccgatgggcactgagataaatcttgatctaatgcctaattgacctatgatagtatccctccttatatagatggaggactacttaatctaatcctaacaaaccttatctaatcctaacaaatcctaatcctatccaatgagcctaggacgtccggcccaaagcccatgacagtgtctcttgtgtctggtatactcataatcacaggaaggccgtcagggaggtgttcagggagctggagccggagctgaagcacgagatcttgggaaagtattcatcaccaagtaactagccatgtgtccagttcagttctccttcccttgcaatgtgctacttactaatcaatggcaatgactctggtgtatgcaaatgttacctcatgtttgatgaaagattacacatctgtgactgtttagcttattgataagtatccagatctcaaggtaatttacgatatccaacaagagtgcagcatagtactcaaaattggcttcctcacatcaggtcaggagacctgaacggcaacatttcaagcatgatgatgatataataacgcttaagttatagaatatttgtagcagatacatagttaaggacgccagtttttgtatggcctaaattatatagctagttcagaggtccaccatctcctctcctatacagccctttaaacaaaataagcctctactagtttttgcatgtcagtagaagtctcatcatgcccacgcaagaagatatatagcttctttcgcctggttagtcttgccaatacactgacttagacaaacctaccagccagatgtatctgtcaaataagtaggctaacggttattattctatataactcatataaatgttaagctgccaattgttgcagatactagtagaagagagtccaaggaaaataaataatttacctcttgctcatcatatccacttcaatctacttctgcagcagtgcttgtgctcacaacctaattcagaagaaaaaggaacggtttaaaacagatcaaaatcagttatctacaatttacttcccatgaattcaatttgatctgacttcaatctaactggagtacttttgtaccagagctgctgctacagtttttctaacatgtcaaaccaatcctctgccattactacccccatgaactcagcattgtctgcttctaccatgtaacaattaatggttcaggagggttatttacaagaaacagcttgtcataatattctcaagattttgatatcagttgtactatcctcttgaaaaaagcagaacagaaaataaatgctaattactattaacagcaacaaggaactctaatgtcatacagtacaagtggttcagtcaggttaatgaaaacaacaatcaaggatgtttggaggaaatggcaagagggaagtggaacttttacatgatgatcacaatcaccaggcatcaaactgatgtaaatccagagttagttgagaaaagaacacaaggtagacatgctctccagagcaaggagctgagtggaatttctaacgtagccaccggtgatgctgttattttcaagagtatctacgaaaaaaatcacaccttcgacaaattaaaaggtggagcattttaaacgcatgttgttgatacctgcgaaatgtaatccttaagcttcccactgatggactcatccaatgctctctctgcaagctcatacatcatagaatggccttctggcccactaagcttctccttcagtaggtacctagatcaaagaaggggtaaatcaaagagaactcttccctacaaattaccaatttcagataacacaagaaatgaccaccaacctttgctgcacaaggagttcaagtgcctgcttgttgttaccaagaacagggtggttttcatcgctctcatttaaacccagccgtctcaattgatgccagagatcctctgaaatgtgattggcaaacttcagaaatataatcgtcggtgaacttttcctgactgacatactgataaaacggaaaccattaccttcagaaatttttccaccggacagatgaacaatgctaatgacaacaaaagcgaagccagacacatgggcagcctccttatgctcgacgtacttgctgtacacctcagggtctaacttactgaccaggacgtagctcttcgcatccacattaactaaaacgaattccaattcgctagtcattttatcaaattcctcaaggagggaataagagcagaaggtaagttaccctgctgctgggacgggcggccagagcgggtggacggggcgcgtgtcctctggagctccctcatctcgtagccaaatgtggcggcgagcctgtccccggcctccttgatgacgagtgccgggagcacgcgctggcggtagttcttggtaacgatctgcgtgagctcctcccgcttgatggggcagccggcggtctggtgcgtcttgaagagcacgtggcgcatcacctccgctacaagcttgtccttctcctgcagccgcagtggcgcaggacgggctggtcaattcgtcaaacacctcgcgtgcgcggagcctagtcgcgagacaagcgggaggaggacggagggggcggagagagagagaggagtagtacctccgtggagatgtcgatctgcgcgtagtcgtcgctgacggtcgccatccgaaccaacaagggaaggaacaggcgggggaagagaagaggaagaggaagcttctccctaggtcaggaatggaggattgggtgaggaatcggcggtgaggttggtggagagtggggcggcggaaggaggaggacgcgtcggccgatctggttgcagcggtcggcggcggcggcgcacggggggacgaggggagaagggcggcggcggaggggttgcgtgcaggttgaggagggagggagacggcggagttcgcgcgcaaaagctggcttttggcgccaccagttttagctgaatactttatgggcctaaagaggcccaaatcatgaagcctctgtcgctccccccggcccactatcataacaaaataaatttataaatttttacaaaacttattctaatatagttttttttaaaaaaattaaaaatttatttcctccgtctcaaaatataagcatttctagttattaatctgggcaaatagttattcagatttgtagctaaaagttattatattataagtgagataataatagtaatacagagtacttgtgttgtggatgataagacaaaatccaatatatattacctaataagtggaacggtttattagaaaatactttctcaattctaaaatataaggcacaaccacctttaacccaaagaccaaaaaataattattatcatcttatagtttggatcatcctaataaatactattatacatgcatccaatagaattagagaatgtgagaataaatgatttaaaaaggtaagaatttaatggagaaaatgtcatagttaatttcatgtatatatgcatgtcttatattatgaaacatctttaaaaagtggttgtgccttatattacgtaatggagggagtaaaaattacttcataagtcaaacttttatatatttgttcgtagcgacttaaatgttaacgctaaaagtaaattatattaaaaatatcttaaaatcaacttcaaaatcagagtaaaaatttaaatgttggcttttgctttgatttattaggccagtcaatggggctccgttcacaaatcaccaaacgcaaacgccatcgattttataaacttgatctgatatgaaatcagtgatcaaagtttcaaaagtttatctaaattttaccttaataaacttaaatatttatgactacatgtttgtgcgtgatcggaccaaatccacactccttcgttcatttgcaacgaatcagtcatcaaaacgctaaataaacaggcctcgtgtcgtgtcacacgccgccggtcttttctccgccgccgtcgccgtcgccgccgtggtggtggcggcgcttggcccagaacctgaggcggagctcccttccctcgagcatcttctccacctcctcgatggggaggcccttggtctccggcacgcagacgagcacgaacgcgagtgccgccacggacagcccgccgaagatgaggaacgtccacgccgccccgatggcgtccgtcagcgacaggaacgactgcgccaccgccaggttcgacacccagttcgccgtcgccgccgcgccgccgcacacgccgcggtgccgcagcgggtagacctccgagttcacgatccacggcaccgtccccatccccggcgagaaggcggcgatgtacagcgccagccccgccatcgccagccacccgtacctgctcgggcacccccgcgtgtaccactccctcccctcgccgcggcacgcgtcgcgagccgtggcgttcgacgccgccgccgccgccgccaggcacgccccggcgcgcagcttgtcgccgccgcccgccgcgcagaacccacaccccgccgacgccgccgctgccttgagacacctcgtgcagtcccagaacgacgacgacgagcgggaggagtagtccgggcatgtgagcgcgccgccgtggaagtgggcggtctcggcggcgccgacgggcggggagtgggaggtggcctcgtggaacacggcggagaggagggcgagggagaggatgacgccggcgaggctgatgacgagcagcttgcgccgcccggtgcggtcgatgaagtagatgctgacgagggagccggcggcgttgaggccggcggtgacgagggacagcgcgagcgccgtctggttggaggcgaacccggcgagctgcacgatggtggggctgtagtacatcaccgtgttgatccccaccagctgctggaacacctgcagcccgacgccggcgaccagcccccgccgcaccgtcgccgtcgtcatcagcagcgccaccaggctcgtcttctccgacgagctcctctcccgcgcctccgcctccaccgactccttcaactcctccttctccctctccacctcctccgccgagtatatcttcctcaagatcgcctctgcttcctcctccctcccctgatctcaaccacaaaaagttttttaaaaaaaggcaggaattaacgaagaagaaataatggcgggaacgaactaaatttgttattaggatgattttaccgtcattgggtagatactatatgcatttcatattataagcttttctaaattattcttttaggctaggtttaagaggagggaaaaaatacgtaaaacgagatgaggccattatcccataattaattgaatagaaattattttaaactttaaaaatggattaataagattttctttaagcaaatttcatatatacttttcttttttgcaaaaaatacaccgtgtaattgggaagcgtgcgcgcagaaaacgaaacaaactctctttcttcctccagctgctgaacgtagccttagatttgattaagtttataaaaaaaatatagtaatattttaacacaaaacaaaaaaaactaggttagatgtaatgaaactaatttagtgctataataattgttatatttttctataaatgtaatcaaagtttaaaaattttggaaaataaaaatcaaaacgacttataatatgatgaaatagaggtgcaaccatattttctgatatctctcgatattttcagtattacgaggtagttctgctcaactaaatttgcattacaagttttgataagagaacatctcaaatgctgtaaaatttatcttgttactatacctttcggtagagccatctcggcgactcggggaggaagagcatgaggaagaactggacgacggcggggatggcggcgacgccgagcatccaccgccacgtcccgggggccttggtgaaggcgaggttgatgaggtacgacaagaactgcccgccggtgatgaggaggccgttggtgctcaccagcgcgccgcgtatcctcgccggcgacgcctccgagatgtacagcggcgacgtcatggacgccgtcccgacgccgagcccgacgaacacccgccccaccaccagctgcgccggccccgtcgccgacgccatcaccgccgcgccggcgaagaagagcgcgtcggccaccaggatcgacgtccggcggccgtaccggtcgttcgcccacccgccgatcgccgccccgatgatcgcgccggccaccgccatgctcacgatcatctcctgcagtcgtcaccaccaacccagcaaaataaattttcagaaattcatcatgtgtttgtgttcttgctgagaatttcaagaacgtgtcgagaaatttggttgcgacctgaagccatgtgttcttgtcaactgaagggaaatcgtcacggatgtaaagcagagctcctgaaatcacacctgcagaaacacgcaacaccacagtggcaagatcacttcgctagctagctaagcaggatactgtaatttaattacttttactacttcaaatcttcagatattcagttaaatccaactaattaatcaacggaatctgatcacttcaattcttccaactaactggtgtctccagaaatctcatgacatgaacaaaaaagaaagcctcttttatctgaaattttcaagaacttgctactgacactgacaagaacctcaattgggcatttcagacacacaaaacctgacactaataatcagtggaacttgatcactttatctcttccaactaactggtgtctccaaaaagctcatgacataaaacacacacacagaaagcatcttttatctgaaatttccaagaagtagcatgacactgacaagatcacaagaacctgaataattgtgaatttcagccacagaaaacctgaaactgatcaccaatcaagagtatattaccggtgtcgtagccgaagaggaggccaccgatgccggcggagaaggcgagcctaaggacataagggttcctccatgagagggagaagcactctctgaaggttgagccatcgaactcatgaacacctccctccatggctatctctctaatctaatctctccccccttatcctttgcatcccaatgcttagaaatgaggagcacaagttggcctctgactagtataagtatatctgcaattctgcatagaggtgtagtactagcagtagcagagtcccccactgcattgtctgcttgtgtcatatggtcacagatgacaaagagaaagagactgattgatcgaaaaggagaagattccggattatgggattggcgtgatctcgccttgtcagtgtttactttgactccaatgacttgtggtcgtggtgatcctctctgatggtgacaacgaagacgatttttagtaggataataacaggcattatttggtccgtaattttttttttgtccctgttgactgatgttcattttcaagtcaagcttcagtgactgaactgtggaaatggattttaatctgtcaagtcatatttgtttttttacttgtagaggttaaattcaaacttgtatgttcgtgaagtgatattagtatgacatatcaatcttatcaattttttttctattttttctataattgtttaaatgacatgtaagaaatgaaggggcatcccctcaaatgtgaactctgtaactgaaaactggtttgtttgtgcaggtgtcagcggatggataagtgggatgaagttgttttctatccatttccttatgccaaatttgatgtgcctccaagtagcaaatgtgaattgcgtgatcgaaatgatgaaagaaactctgtaccgaactgtgtttgttcatgtgcatgttccctgcattattttctgtcgctgctgtttgttgtttgcctacagttttaacattgactacagggccgagtggtcaaactttatcaaatttggacgagtttaaaatggattggtcgaatctttagggcagtgtatgattaaactttcttttgactcatttgatctagatggcgcctatcttttcatcttagtggatgggagttcaagataccaaagcgcgagtgagacagctacgtgaatgcatgtcactgcctatcaattccttcctcatcatggtcgatgcgaaattccgtgcaaatggaaatccaaatcatctccaaagttgggcagatctttcaagcatttctggagcatacttaaaatgtgtttacgtatgtgccactttagtactttagataccttaatttctttataataaacaaaacaaatggctagtactcatgctggtggataaggcaaacatcttaaggtgggaaaaacaaaactaatgcaattaaatcagacaaaactggtagcatgggagatatggtgcgaacgaaacggacatgttgcatttgctaaccaagataaataacgagatcaagctgtggagcatgtgtggagaaaaaaaaacatcacgaaaatatccgcttagcatatctgggtggagctgctccaattttcttcttccttctttttcttcattcagtttttgcctttttttttccttattctcctctgtcttccttccttctttcaccgtttcagcgaagctgtcaatatttgctcccctgcttaatataacaccagtttagcttggcttcggtttaaaaaacaaacaaaacgaatggcgcaagttaggctacagagtatacatagcaggaaggcaccataattgtgatgctttcaagagttcagataggaagaatgaaattttgtcaccgtcatacgatttcaagttaaattttggatcaaatcatagagaaatcacttagagatggtgagatgggcatatctccagatggctgcttattatttgtccacactctctgatagctttagtttgcttaacttagctttctgctcttgcagttgaatcacacattcttggcacacctggaaaacggccggagaaccctgaactctcgagccatctaactgcttctagtgtattgtaaaatgcctggcatttttagtttaattactccctctattttatattatgaaaatgtttttgatttattacatgtcaaatttctctaagtttgactaagtttataaaaaaatgtagcaaagtagcaaacaccaaatcagttttattaaattcaccactgaagatgcattttatagtgtatcttttatgttaaattgttattatatttttctataaattttatcgaacttagagaattttgacttcgaattataatatgggatggaaggagtacatcaataaacaaaaaaggattaaacttctgttcatggaaaacaatctaggagcaattaatggctaatacttgtggtactgaggatcatctcaggtttggatagagcttcttatggtcaagtacatatcaacttttttttctccctttttagagcagcacttgatctggcacgatgtactcaatagctaagctagcatgtgcatacaggactagagaatgctactagagtactagatggcaaaaggagacacaagaatgaaagcacaaccgttggatataggagtaatccaatccaagggcccagattaattcatttttgccattttcttctaggcaagaacagataggagtatttcacagtcagctttcatctctgtcctgtactgtcctggcatggtgtgtgtgcagtgtcgccaagtgttgggtgctggtggccgcttgtctcctaccaccacaatgtttcagactttcaggatggtccaaaattagctcacagaacatcaacatataatcttttgatattatgtccaatcaacagcatgaaagaaaggaactttaacctctacaatacctgcatgccatgtgcacttgaaatcctgaagtatgggcaccagtgtgttccatactgttctcttacttcctcattcctaaaatataagtatttttaagtttggcacgggtattaagaaagtatgtgagaatgattgaagaaggggtgtgattggttaaaaagagaaagtaggtgaaaaagaatggttgtgattagttgagaggagaaggtaggtagaaaaatagctttattttagaacaaagtactgtgtagaaatagctatatttttggacgaatgtagtatctctcttctgaagtctgaacaatccatatcattcttggaatcttctgatccatctatccaacctagcacacaagctggaagagattaggtttgtactttaagtggtctatccttttttttttaattgatcacctggaagagattactagtataactgtcctgatttgatgacacaagcatgttgaaagatttgggagatgttagcctaggaagttgtggtcaaagtgtcacacaatctggtaagttaaaatatggatcggagcaaccctaggtgaatgcatgggtcggtcacatcaccatactttgttgcttgattttttttaacgactctcacggtgcgaagttttattgatagaacaggaaaaaattacaagattacaactttagagggtcgtaaccaggaaaaagaaaaaatataccaccacccacacaccgacaacgcctaacacaagtccgggagaaggctagcaccggaccagtcgccgttaagcgtgaccgaccgccgctagactaacaaaggaatacaaacgagatcgccacacagcaagagggtgccaaaacgacgtcttcaagaagagaagcgacggaaaaccgccgcgccgtctgtcaaggctcaaaggagccaggactgggctttcgccggcaaccacccttgagaggcgagacagcacgtcaacgtcctcaggaggaggaattaaccatcgttgtcggtccggccaaggctgggttgggttttcacctgccgctcaccacatgcgaaaccatggctgacacactgatgctccaccaccaatcaacctctgctgacatgtgggacccctgcaccagcgccctctgccggctggccttcgtacgccaaaaaccatgccacacccacctgcagctcctccactcaccaagggaagctttggatgctagtttccggccactgatgattaaactagttaatcatgcaatcatgcatagggcaatcactgcctaatattttataaagactgtctgctctatgttaataataaattgctgatacaatacgcacagatactgtattttgcatggactggcctatcaagaaagttaattttttgcttaagcgttgtagatacgcaacctggtaccatcaaaagcgtaaaaaaacgaccaattaagtactgtatttcaatgacctaatcgcccttatattttctttctttctttgagataaggatgatctaattatttagctactaggacatgaacacctacctagcctgctaagagcccattgtagcttttgggccgaaaggacagtccacagcctaatagtagcctatttcagtacagccaactgtttccaaccgtttgaacattccagcccatcatgggctttgcaaatgttctctcctctcgtgtcaattaacttgacagtagtagtttcttcatcagttcaggcatctacgactgcaattaattaattagatgtggttttggaaacagaaagtacacaacagtagaaagcatactgtacttgatcatatactctctccattctaaaataaacacatctaatacaggatgtaccacgtcccatactgtgttagtttattttgagactgagggagaagctgggagaggcaatcaaaatgagcagttgattatttttttaaatttattgtgaaggacgttgattaattaagatttggcactgaagtgaaaagtgcatatacgtacacatgaatgcatgtactatatagatgatgaagagagaacggcatgcatgtgaaacgccaacgactttcagttaaagaaaggtaacaagtaccttaagttgggtgcctgcatctgcatgcagctggtagtgttgatcgatgatatgatcatggcatgcatatggccgatggatggtcctaaattgtgtgtcttcgttaatttctttgaccactttaatttgagagattatgcatatatattaatattcctctgatatttgcatatggtggtggtgatccaggaggtaaaattaatataattaacattcattcatattttttcttctcctcatcacgcagtgtgcatgcatgcatacccctctctctctctcagagaggaaattagaaatgcatgataattaaccatgcatgtatatattcctagataccagtagttctagtatattttgggtatgtttggggagctttaaattctgagaaacagctatttagtagccagcttctgataatctaaaaaagctctgaaacccagcttctccagcttctggcttcttagttcatttttcagaatctgtaactacaaattctcaggatctgtggactgtttgaggcagcttcctacagaagcagcttttgggaaaagctgcagttgagacaagctccccaaacagggcatttgtatctcttgtaccgattttagatagcttattaattagcttctttttgaaagattcccaagtgaaggagtgagactggttacacgtaagcatttacgtcatgcatggtggatcgatatggtgctacgattcacagagagattgatcagtaggactggaactggaaggggagtggtgcaacttttaattaattagccatagatggtcccggctggccgagtgatcgatcatccatcttgctgctgatacgcacactacacattgtgtaattcgtagtgacatatgggtctcgtcccattctaaattgcttcattttacaacagagagagtaaaaaaaagttaaatgacttataatataaaatagaggtagtatctgatagcaatagtcaatcagttggcgtcacgtaattaacaatgtaacatatgtatacaaatgatcgatccaaccatatatatgagatctctaaaatgcatttaattatatgtgcgtacatacaaatatagacgcctaagaaagagagaagaagctatagcttaattactcccttccttcgacccaaaatataagagacttttagatgtactccctccgtcccataatatagaggattttgggtggatgtgacacattctagtacaataaatctggacaaaccgtctgtccagattcattgtactaggattataggacagagtgagtatatcgacacagaattcagatccatagtattagaaattatcgcggtctgtattagttattagttgcgtttatatactttggtgtgacacgtgctttgccaggtcatcactggtcaggatactgcaagcctagctaagctactagtagctactgtgtactagctagctagtagcaaacgccatggccatggcacaggatggatcgatggatggatggatatagagggttggtgttgcctcgccatggcgatttggcagccaagttgcccgccctattcccggaaactgatgtatgactcttttgcatccaccttgctcatccatcgatcacatacgcaatgcaacgcaacacaagctttaaataattttctctatctctctctctttctttctctcagatcatgtatatatgcaattctagctagctcttttgcctgcattgcatgcagtgactgacccagccacttaaaagcactgtagaaccagcagctagcagctgctgctgctttcgccattacatacgtatacgtatacgttgcttttgactgtcactagctctgccctgaccgaccatgacgacggccaacaacaatcatctgttaattgtttgcaatgtgtgtgtgtgtgtgtgtgtgtttgtcgatcgatgatgaaccaaggacgacactgcagctttaatttgttcatcaaacggtcatgccacatgaaagaatctcgcaaccaactctcatcagctcaaagaaagaaagtaagaaacggccatcagttagtttgaacgaatagtactatagcgtatacatcgctacgtgcctcatgctgtacgttcaaaagaagccaaacttttgcttctttgcttttttattttttttgtttaaaagaagccaaactttagactgtgtaatgctagctagctactgtatgactgtatctctcttttctcttttttgatcgatcagagtgaagacacattgatcgatcggcaccttttaaacaaactcaagttttggaaaagctagccaagaacaacgtacacaccatgcaattaattaaaagcactgcatttccattgcatttcaaactcatcgtcgaccaacaagtagcttaaaattaattaacacaccgcatgctcttcgctaattaaccaaccgattcaacagcacaccacaccacaccaacctaggtaattaagctaagctagatcgcgatagatcactctgttaattaattatatctacaaactcctccttgagatagattaaaatcttgattaattaattaagcatcacacattaatcaatgcaaggtagggatcgatggatggatcagagccagagggcgccggcctgcttgaggagggggacgagggtgccattgatgtggcacgccatcaccttctcgacgccgccgaggagcctgccgccgacgaacacgacgggcaccggcggctggcccggcgggaggagctgcgacagcgcggcctggatgtcggcggcggcggcgagctggtcgagctcgtagacggcggggccgacgccgaggccgaggaggaggcgcttgacgacgtggcacatgcagcacccgctcgcgctgaacaccaccaccgcgttcccgctcgccatcctcgccaccctctcgtacaccgacatcatcgccgccgccgcctcctcctcctccaccgccgccgtctccaccacctgcatcctcatcctctcctcctcttcttcaaatggcacgattgcaatgtaacacaaacacacaatggcaatgagaggaggaagaagaaggtggatgatatatagatggagaattggtgtggtgcgaggggggtcaaaggagtggcgacatggaaggcttttttggtagtggatggtcgcgagctcggcgaacacacgctctgacatggccactgcctagctgagctgagctgagctacccagtacactcctttcttcctttccttccaccacgatacggttaccagagagagatgcaaggtgtagtaagcaaaagcaagggaggaggttaaagtgactagtgttgcttactagaaagctggtggctttttgataggggaaaaagattagtaaaagaaatagaggagctctctggaatggaatgaagagaaatggagctagctagctagtacatgttgcatgttaaaacagtttcccagaagtaattaaccatccagtgaaacatatatatatatagcaccacatacatgaggtaatatatgaactatgttcattttcaagagatcttctagataatgcagctacaaaccgttcagatattctcgcacaaaatctggagagagattttatcgtactcgagaggtacaaaattgtaagtatactccctccgtactcataaagaaaatcgtttaggataatatttaagtcaaaccttgagaatataaatcatgaataatttttaaattgttgaatttgaaaatataaaaaatatatgaatagatttgtcttgaaaaatactttcataaaagtatacatatatcacttttcaataaatatttttatagaaacaaaaagtcaaagttgtgttttggagaccgtgtcactgtccaaaacgattccctttatgagtacgaagggagtatatatttcgctgtccagtgtggtgcatgcatagattttacattgctagaaaaatttaatgtggtacatttgataccctgcatgacagaaattatggttaattaattatccgattcttttaaagattcctatcagctgaatattctaattaactaactccccaaaataggggcgatgtgcatgcttttttcgtttctagaagaatatatattcatgatggttgtatgtatacataatgctccatgtgttttgagtgatattgccactagtacagtacggggtatactgtacagtataggagcagtagtatactactctactagtatagctgtacttggagacggctggaggaggcgacatcacgtacggacggccactgtgtgaagcgccgacagcccgacagcataacggcggggccctctccgtctcatctccgccgtcgtttgactcccccgggcccaccaacgcaacctccctcccggggggcaggtgggccccggtgatgacctcctagtcgatggatcatggatcgtcgacacgttacatcacgcgtaaccgtctgatcgtaccgcgtactactacccttcttgccatgcgttccaacctcatcggacggatgggagcatgcatagatgcatgcaggtaaatgcatgtctcgttttgcttttttttttcacaataaaagcaaacaataaaggaactaaagaatactccattcatcctaaaatataagagatttggttggatgggacacatcttaatccagattcatagaactaggatgtgtcacatcgacacatccaacctaaattcctggtattttgggaccgagggagtatattaaagatgatcagtgatttattataggacaaaatagtttttttcctaagtatagaactggatacatagagagagagttatatatgtccgtatgccttggacgatcgacacacatattataactggcggaacaaattacgatatcgttgtattgagcttaattcagaaagcggcccttattagatcaaatattattttgattttcgaaaattttagctcgaggttttaaaccttttctacctgcaagttaatttcgtcttaaaatctaaaaatattgtacttagatcaggatttttcaatcgaatctatgaatgtttctagcctaactcattagttttcaattgatgcaagatcgacttgcagaacaccatggagtgggagagtgtggatctcacgcatgtggctcaatctgataaaaaaacgatgaggcacaccacaaaataagcatttcatcacatggaaggaagaagggacactggcgggaggatgaagaaagagaggccaggtttcctggagcggtgcatatgcttattttgcgggcatagacaaaaaaaaatggaaaaccaaactgtcaaggaaattggaggaaaaaagatcgagtagcggataaggtgttcaccggattcttattctagtgagcgttcgccagttaggttttctgtggttccgactacttatataacgcgattgagcatgcgattttaagctggttttaattcacagtgaaaaagaaacacacaattttaaactagatctaattcatagtgaaaaataaatgcagaatgccggaatggccgaatgggtgatgagcggtaaaaaggtgaaagaatgagctaggtgagagagaaagggagggagtgagaagggtagcatcggagagtgtgatgcaaaaatgcggtcaaaggagggaggagaaatgggctgatctgatctgatatcgcgaggttgtgcttttcttgctttttgctgcattcatgcatggctgtctgcacgggatgttgcgcaggcagctgttatacgtacactcttctgattcctctagctatattaatagcttcttttaatttactgtcaattgattaactataccttaatttgatgagagtaaatttcacgaaattatatgtactcagatcgatctatcgtaaaactataatttttaatgaagtgtgtatcataaaaatttagcaactactccctccgtttcacaatgtaagtcattctaacattttccacattcatattgatgttaatgaatctagacatatatatttagatttattaacatcaatatgaatgttggaaatctagattcattaacatcaatatgaatgtggaaaatactagaatgatttacattgtgaaacagaggaagtaattttttttcacgaaactacgtatttaatccatcgtatcaccaaattttagatttaatatcaattttattataaaaatgtagctttacataaatgccttaaatctatagttttacttgttataaattctattttaaatctgtagttttgtactcctacatacttaactttgtattttacgatagtttgacagttttatatatactcttatcttaagctagtatacctacagtacaaagagatgcataactgcaagtgtataagagatcgagcaacgactggaacagggaagctagctgctgctgcaggtctcaaattacttcttacttttgtcgatggatcgatctgcatgcgcgagcggccgatgctatctctctcaaagctagctttaaaaggcgatcgatcgatccgtgccggcctgaccatgcaagcacgcgagcctgacttccctgactgactgacactgcatgcccaagctatagctacctcacctcgatcacctgcatatatatgaatatggatgctccctcttttctaaaacataaacatttcttaattagacattaatttcaaatgttttggagtggaatctaggcaattttaaaaattttaaaaaccaatcattgagttgacgagaacggaattcttttcctcgatagatcgaattaagtgcttatattttaggatggagtggtatatatgccgcattctctgtagcttaattctagagcgagagtggtgtagaggtttctgtttgacgccttgtgcttgtactcctctgtggagtttgcattgttgcacccaatgcaactgcatgcaaagtactcctttccaatttccacgacgactactacactacagtactgctactgtgcctacacaacacagtgtacaaacacaaacacagagaaaagctatagcaggcgtagtacgtcctgtccaggtgccaacatcaacatgcatgaaccaacatgcattgcatgcttgtcatctacactgtactgatggtgtactcttctatactaccttcgtcctatattacttgtcttttttagtttttgtttgtcaatgtttgatcattcgtcttatttaaaaaaatttaaaattattatttattttgtttgtcatttgctttattatcaaaagtactttacatatgacttatctttttttatatttgcactaatttttcaaataaaatgaatggtcaa

SEQ ID NO: 80306 - DNA, 8214 bp, Oryza sativa
ctcgtcagtacctataatataaccaccggtacgatgaggaatatgaacccgaaacatgaaagccccacttctcctaccttcgctttttcattcattacacgtaccgtgacggctcacactgtccatacagctcgctgcctgattctgacgctcgcctgaatcacaagcttgggcctgtccggtggggtcgctccttaccggcgaaataaaaagaaacacagggggtgtttagatacaatgaataaagttttggcgtgttacatcatgtattatatagggtgtcgtatggggtatttagacactataaaaaatttaatcacagaatccgtcagtaaatcacaagacgaatttattaagcctaattaatccgtcataagcaaatgtttactgtagcaccatattatcaaatcatggagcaattaggtttaaaatatttgtttcgcaaattagtagcaatttgtgcaattagtcatttttagcccatatttaatatttcttgcaggtgttcaaacgtttaatgtgaaagggtaaaaaattttaggggtgggatctaaacagtcccacagtcaaaaaaatttagtactccctccgtcctaaaataagcgcagccataagtttctgtgtccaactttgatcgtccgtcttatttaaacttttttataattagtattttttatgttattagattctaaaatatggacagtagtttatacgtgactcatgttttttattttttaaatttttttaaataagacgaacgattgaaactgtgcacgaaaacttatgggtaagcttgttttcggacggagggagtatgaaccggtacttctctgttccaacaagcaaaaatctgtcacgcaaacgtgtcgactaggcatttcttgggacctgtaaactctgtttactgtgttcgatcgctttcctatgtaaaatgtcccggattcgaaaatgcccgacaatggctatcaactgctacttccgtccgaaataaatttatttttcacacgtctcatgcataccaatataaaataaaaaaaactaaaatatcatactttatcaaatcacaatgtaactattttttattttatctcattgctacaaaattaatttttcatagcgtcaacctatttttttcttaagtggccatacagaaccactgtcaatgaaaatgtaacaaggggtagggagttacggtccaaggataaaagagccgtcagcaaaaatattcaaattttcacatgcgaactacttgacatatccactgtgaagattaaatttcacaagcggcaggttaagagcaccgcctgcctaaaaaattccttaaaataccctcctctcccttgcggccacacgccctctccttaattattcgctggcggttggcttaacctagccgcttgtgaaaatcgattttcacaagcggtgaaggtccgcctgtaaagatgttgattttcgctggtctttaatcgatggcggggagctgagccgcctgtgaaaacacgttctgaccgcctggaaaaactcatttttctagagtgaatcctcctaatataattatgtccctacatttataaactccggtgtaataattacgttacccaagaaataaacttattttaaataaatgaatggatcttaaaaaacaaacttattatagaacatttttcacttatctcatacatatcaacacaaaataaaaaaaataacattgccatactttatcaattcctcatacaattatttctctttttatctattatttctaatatatttatcttatgattttataaattttgatacagtgattattaaaaggaaaaagtatataataccctctaaactattatggtcttccgaattaccctcctatatcgaatacacgaagttattttagaatatgggaggaggaactgttaaggcttgtagtagctaagctcggtatcgtaacaagctgctcggctcggcttaactcaagcttgttaataaactcattaagagctttggcttattcatgttacctttacgaattttagagttctgacatatacaatttgccgatttatcatttactagtcataaacattattccttctataaaaaatataaagatttaaaaccagattcgtaagtaaaagttatatattttaaaacaaatgtagtagtaaatacgaatacaatagtttacaagtatttaaaggacttattattgactaagaagcataagcataaataaatataccggtctttcatactaccaagcttaacatgttctacacctgtctttaaatattacaagctagaattgaccgatggaatatatcttagtataataaatagtaggatatatctaatccaattctagatttaccatattttgaaacgaaggaagggagtagcttgagctatgctggagtaaaatcccaacacgaaactctcactacacgacgccactacgggttcaagccgatcttaagtcagaaacaaagtgaccttgttccaagccgcagtagcgagcatttctttatatttagaatctgtttggattgctacctaaaattttggtagggtaacaaaccaaacacctctattaaaatactacgtatgctacaaatttggttttgcccataaatttgtctcttataggtatatttttggcttcaatccaaataaacattttcaactctatcctaccaaaattttagtagtaccgaaacttgcccaagatttggcactaccaaaaatttggtagagcattaatccaaacatgccctcaggatgtgtccatttggattggtttggaaacctctccccttcgcacgcaaaacggaatgacgaaataacacatgattaattaagtattagcaagagtttgaaaaataaattgatatgattttttacaacaactttttctaatgtttttattttttaaaaaagacactgtttgtttagtagttcaggatacgtgcgtgtgggcaattagagaatagaggttgggaaccttgagtgaagaacacatcctagggcaaatgaaatggcgaaaccattataaactctccaggtgacatttactcatggtttatatgtcagtcaaatgaccatgaaaaaaattggaaaaaaataagatagattaatatgcgttagatcactctacaaacataacatacaagttaaatttctcacttttatatgttgcaaaaacaaaacaaatttgactctaaatatactttaactatctgtaatttatttttttcttattgcaacttataaaagttgaattttaactttctaaagtgatatatcacatgttaatacaacttcttattttttacaatatttttgtaactattttaagtgtcatgcaaactgaaaagacgtccccctcgagagtttaaaatccactccataatgaaatgccattcaaaattgtctgatggttcgagcagcaaaataagctataaaaaaaatttaacaaggcaacaaaaaaatttataggtaaataattattactagcagtttaaaagtagtagagataaaaatacaatcaccaaaattaaattataaatttctaaaaggaatcaaaccctaaagatgaatctgaacacacatatggctgtgtttagttcgcgccgaaattggaagtttggttgaaaattagaacgatgtaattgaaagtttgtgtgtgtagaacagattgatgtgatgggaaaagttgaaagtttagaaaaaaactttggaactaaacaaggcctatgtcattcatcgctggttttgatttttgattttttattttttgcacagagagagtataagccagcaaatagacttgaaaaccgaatctctgaagaaatctccgaggagtacgtacggcagttcccacgctagttgcattgggaagacgaggaaagccaagcagtggcgtcggcgaggcacctccggaacgtgtccatgctctccggcggcagagctatgcccacctcgatgccgccggcgccggaccggtcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccatgacgcgctccgtccacccttcccagtacgcgggctcgccgcgcaccgcctcgtcaatggcgacggccaccgcggcgcaggccgtgaagacgccgcccgcggcgtcggcgagctcctcatgggtgcggcgaactcgtcatgcctgtccggtacgtcgcggatgagcgtgcggtcgattacgggcagctccgggagcttccggtcgccggcgcaggctgcggcccaggtgtggaggaagtgcgtcgagcccaccccgtcgcaggcggagtggtggacgatgacgccgagagcgaggccgcggcgcttgggcggcagcacggtcacctgcagcgcgagcaccgcgccgccctcgggaagctccgggacgagcggcgcgatcttggcgagctccctcggctcgtccgtggcgagctcgtcgacgccgacgccgtcgtgctcggcgacggtgaacgccacgccgtcgccgagctggtagaggagctcgtaccggttggtctcgctgggcgtggggcggatgcggctggcgagcgggtagaaggcgtggatagcccggggcagcgactcctccatccgggacagcacggcgtcgacaccaccgtcgtcgtcgtcgtcgccggggccgagtcggtagaagaagacgcgctcgacgggctgggcgcggagccacatcgcgtccatgaacatgagaggcagggctcgctcgggcagcgcgggctcgccggcgggcggcgccggcgcgacgcgcgtcgtgcggaggacgcggaggccagcggcgtgagcggccggttgcgacgccattgtctcgccgcagaacaggtgtggtttgtgttgctcgtggttagctgcagagcgatggagctttgcttctactcctataatacttgcatctccgcgagtgacttcacttcactggtccatacccgaattacgcccctaagttattatgtgattacgaattaccccttgaactcaaaaataagatatctttcaccttcaactatcaatacaggatgaaaactcccttaaatagctttgagagcggttttggtcctacgtggtagttcagtcaacaattcttttatcaactaatcgatggggcccacccatcagatctctctcctctctctctcccctctcaaacctctctctcgcacgcacggatgccgacgacgaggatgaggcatgtgccggcagtgctgcaccatcccgacggcgctcacatgccgccccattgttgcctcagccacgccgccaccccgccgccatctgcccgccccgagcagccttcgccacctcccgccaccatcttgcccaccctgagctgcctccgtaccccgcccttgcttgccgccatctactgctgtcctcggcgccccaagcggcctccgctactgcccgccaccccgagctgcctccgcccctctgtcgtcctactaccctcgcccaacacaatccaccgctatcctcgatgcccgagcggcctccgccattgccatcgcgccgccacgaactgcctgcacccccgccgctgtcccactgtcctccccagttactgtcctgccgtacatcatagaaaacatgtaaatacactcaaaatttacgaaatatattgagaaatgtaataacacgttacgaaatataaggattgtatttcagtgaaatataatgaaatttacaaaatgtattgagaaatgtaataatacgttacaaaatgtaaatattgtctttcagtggctttcataagaactccaataccagaaaaagaactcccctctacataattgaggaaaagaacaccacaatctacctgatagcttcaggtcatccaaaccaacttcaaaagatgacccagtgaccctctcaatccacaggtacctgtaaataggtacctgtaaacctatagtaaatgaagttcaagcagcagtacataatcgaagtaaccgtaatttttttaatcatgttgttaatcacagaatatgggccagcggcatccacgagcttgaagtgtaactctacaataatcacaagagcaaagaccaattcatagctaatcctgatacaatttcagaaacatgacaaagttatactcctgaggaacctgaccagcaacttgtgatgcaccatttgtttgcaatcgttcaacactaacaaaaaacaaataaagttacaagacaaattgtatttaaaaatcaaagcaagtaattccaaagatatcaatattttgtttcctggtcatttaagaattcatctcaaaccatgaaaaaaaatagacttcaacaattagagcccatttcaaaagaagcggtttcagttctcacaaatataacaagcaatttgttaatcttaatactggtgggctaaccatataaaggctaacatggaaatgaagcacatcagttgaacttcagattcagtagtggtagaaaattggcatatttaggcattgtattataggagtagttttttgagcaaaaagaaactttcacttcatagagcaatatattactaactccacttcatgtagctagaaagtaacagaggagcttgataaaatagatgtgcaacgctgattagaaataacaggatgatgatgatgcttgatgataactcatccagataaagcaatgctatatgcagtggctttttaatattccactccatgattcacatgacctttttatcaataaaagaaggcaaataacagtaataaggtaatactgggaagggcaagtcaccttactttacatttgatagaacggactcagataattcttaatggcacatctgttacatcttgttatgtatggactaccaaatcagttgcagttgaacaataaagggacatatcttaaaataaataaatctcctttttctgtgggttaaaataaataaatctcaaaaggattttatatgcaactaaagattaaacaaatagatatactgcagccgagtccacatgtcccttgaaacactgtccaggattgctgatcgattacgaaatatgaatttatctgcaaacttttgactgcagtagaaagaggagacaaataaatctcagtcaagaaacaaagctattgtgttgggaatatcaagtaaaattggacatgttagcatatctatatcactattaacatactgacgtgactccaatagtcattaaaaagtgaagtatctcatagtaaatctatacactaaaataatagggtgttctaccctgcaaaaatgaaatatttgtttgcactatatgaagtattcgagaccaaggaacaattcaattttagtttacataggcagagcttcaaatcacaacatacagtgaaaaatagagtaaatatgagataataataaggattcaaacagtaacaggagtgcacctcgatcatgcatttcatcaaacagttggtgtgctgcccatgggcacaccaaggaaccaccgtgatagctgatctggaagacctcactgtaatggaagggtaccatccacagcacacagtagctgcagccgctaaaggcctaggtgcagacgttgaggcttgcctgcgcggcttcagcgatggcggcatggaattctacatatctatcgaacccaacttttaaaacaatctatgcacttgtgtaatcacttgaacaccatgtggatcagtttaatgataacaaaatgaaacacattatataatcttatgattataactaactgttaagtttgtattcttcttggtccctgaaagagaaattttcagctcctgcacttgaatcttgcatcatttacataggtaaaccaaattgacagctgcatttataatttcatttaggatttgtcatgtaaattcaatgtaaaagtgaaacaatacctcagaggtactgtcatcgtgtgcaaggatcaaaagcaaaaatgaccaactgataaattatgaaatttgggatctggggcaatgctttttgtagttgattaagtacccagaatcaatgatttacataaaaattgagcttttcattttatataattttcatagcataatcaaacattttatcaattttgttattttcatatctattggaattgcattcta

SEQ ID NO: 80307 - DNA, 49737 bp, Oryza sativa
  unsure (1)..(49737): unsure at all n locations
attcgtttaattaacaggagataaagacctatagtgggactgccttgtgtctgcacaaatgaatgaacaaatctagctaacaacaaaatgttaatcggtaaaaattgaatgttaaagaatatatgtgtaacttcaatgaatgtctacttattatgaataaacacacctagaaaacaaaacagagaaacactcgtggaaatgtagtttagttgtagaagttatacgacgaatttataaggcttcagttgtaaaaactgcatgacaaatttaggattataatcatccttaatggcatatattctaataagtgctgacatattatagtttgtgtataataaaatgttgcttcatttttaaaataccatgcagttagttctggtgtgatgatccaccatagctaaattttagtgctagatctgccattgacacaacatattaaagtccatgctacaaatctgtagtcctctcatcttttattttttttccgcatgtgtttatatttgacttatttttttccgcatatatttataagtgacttgcagcctactatgatacttgctctaatacacttccctgattgatggttacaactagcacttgcatacggcccacggccctaggctgtcactgccaagaaattcgagtcaccaatgggccgtattgcagtgtaatatctccgtctcaaattatttactccctccatccacaaaagttacacctatttcacatttgatttttttcaaataagttgttcctatttgtagtctttatgcattcaagacttaaatgaagagataaattaaatgttttattagaacccaaggagtcatctaaatactcattggttgcatgcttgtattcactccttgattttacaacatccgaggtgatttaatttctccttggtcttggtgttaaaagtaatatgtataactattgtggatggagggagtattttttaaggttgtttggcatatcctaaagtttaaaacaaatgactataatacccttataaaataatttatggttaagaacaaattactataaactttataaaataatttatggttgatgatagaaaggtggttgagaggtataacagtgaaaattttgaatggaatgtggatggcgccggcggcgtccgtcaccgcctccaccgcacgtcgcgcctggtactgcgcatccacaaacctcacaccaccaccatcactagctcaacaacaataaaaaaaaagtgcagtaatcaatcaaaacgatgatatataattcacctcgccctcggcgtgtgccttcccggactcgaaggatcgctggatgttgctccacacgcctgctgccgatagatgatttgttgattgattactttctttctgctagcagtgtaaatctagacgaaaaacaatcttcttgcctgctttgttatatcctgattcgatttgtcaggattttgggtggcgatccgtgaatcaatctccgctagctagctcattcttaagttagatggcccataaataggagctgtaatcttttcctttacatcccatggttttaatcttataatttttcttctgctctatcaataaaatttcgcaccgtcttatgcgagtcgttaaaaaaataagaaaaaagtacgaattatccctccccctgaacaattgcggtagtacgatttaccccctaaactacaataccggacatttgacaccccaaactcttaaaaccggataaattataaccctaacttgattcaaagcggttttaagcctacgtggcacacacgtggcgatacacacagcaaaaaccgctgggacccacctgtcagtgttttttttcctctccttctctgcctttctctctcggtgaacagaggaggcggccgcgggcggcgggcgaggagctgaggccggcgcggagcgagtgcgcggaggcggccgcgaccagcaggcgaggagtcgaggccggcggcaggcgggtgtggaggcggctgcgggtggcgggtgaggagccgatgatggcagccggtcgaggcggaggcgggtgcgggtggcgggtgaggagccgaggacggcagccggagggggcgaaggcagggtgacgggcaaggaaccgaggacggcggtgggacgtggagtgaggcggtggcgggatcctccttcccctctatcgcagcggcgcgggctcctccttcctcctcgtctcgtgccgccgcccactgaccgcctgctgtggacagttcgtccgtctcggcttcctctctgcggtgtgggcgcgaacggcaacgactcggtggtggcggcggtagtgggggagaggcccatgggggcggcgagggtcgtcgctgccctgtacgacggtggcgctcgcgctgtggctgggtggcatccgaggagaggggggggggtatgataggtgggcccaagaagggttttttttggctgactggattgctatgttggcgccacgtgtgcaagctcaattcaaaaccgctcaaaacagtattgaggagggtaattcgtccggtattaaaagtttagagtgagtaatatctggttttcggatttagaggggtaattcggtcgaccgcaatagttcagggggggcgataattcgtactttttccaaaaaataaataaataggagctgcaatattggattggagaatatgaatattcacatggccctttcgaaagcttggttttaatcctgttcatctttttcattcttaattttcctactcggataaataaataagagtaattaaccgagtgggctgtttattcacatgctttcaaattgcttacattaatctacattatctatgtctaatccttacagaaaatggttggttggttggtttgttacaagctcaaaattcttacattttttagaataatctacatacatgaacaaatcattaacatgcagcagggccgggtcctcaggctcaggcctagcccaatacggaaggccgtaggcccgaaggcgaacagatgcgccaccagaacgcgcaccggcgcacgcgccatgccgcgattgccaccgcctgccgcccacgtcttctgatctcctcctcctcacggcgccgaaatcgcgtgcaatccccaggtccagaggccacgcatcggcgccgactccgcggctcacggcttcccgttttccgctgctccgcgcgacggcagtagccagtaggccacgaggtgctggtgcagccgctgccggttgcctgccgccggctcccggctgccccctcgagattggacaaggaggattctattcaggtgagtgcaacaccaatacatcaatacatcatcactaattttgtaacattgtgattatatctgttaacatgtaaatagctatatatgtgcccgtgtactgatgtatagtcctatattagggcaattcagttgtcccgatagttggacaaactgacgaaggcactagttgtgtttccggctcatttgcggtgcgcatctggacgctcgcgataaactatttggtaagattctaaatttagatttgtaattttgtagtgtaatttatatgagttaaagtactataataacttttgaggtaacatatgttttttatataaatattatttctaaatgcaatttaaatgttaacattaataattcagtatatgtatctattgattattattatatagtatgaaagggcctctatatttactttcgcgctagggccctgaaaagttaggaccggccgtgttaacatgcaccgcagaaaaaaagaaagaagaaagaaaattaaaagaaagaagaaagaaaatggacacagctagcttgctctttttttttaatggaaccaacacgagagtgtgccttttcattgaatatagtgggagaaaaatacagcccctaggggcaaagaaaaggcaaaaaccaaaaactgtacactatacaaggtgcgggataagctcgcgcaatctcttagcacccgctaacgcccacatgccagcttattcttttatttttgcaatgaggtacattaatgttgtggcctctttgtgctcaaagattcgccggttgcgcacattccatatttcccaaacaatgtggaggatcagggtgcgtaaccccttcttggggatgcccgccgaagcggctagcatttcccaccaatctttgattgtctgggtcatctcccaatgccagagattgagctgaacccagtccgctaccagtctccaaatccttttggaatatcgacattccgcaacgaggtgaaacgccgtttcatcctctcccctatagagggggcgctgcccgttgttctgccatcccctgtttgtgagccggtcagaggtccatactctattctagatgatgagcatgcatgaagcttacattttccagacacccaagctctccaaattaatgggtcaaaggtcgtgtcaagcgtgccaatgcactgtgctttgtaggctgacgaagccgagtactacccgtgagttgtgaacttccatgtgatttggtctggttctccttcatccagatgcatgccatggactgcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtccacaaccaccgccgccgccggagtgggggcttgggcggcggctggtcgccatagcttcttcacggcgatcacggcgcgcgtgcgggggagctgatcggcctttttagactacaccggtggcgcccatgcccaccatggagcacaacccgaagcacggcgggagcacgccgccgcacagcccggcattgccgtcgagctcgtcggggttgatcgacagtgggcagtagctgctgctgttactgctcccttctgacaaggggattattggttctttgtttggcacatgtccccagtagaatgtcactgctattaccacatcagattgaagacaacaaaagcaagtaattaaatgggttaatacaactaaggctgccaaaactgtcaagaggataaactgctagtggttagcgattagaagtaaatttggactgctgggttgccatatgtctacaagctacaacaggcgcacaagggaaaggagcactttattctatatttcatcaagcaaaaaacccttgcatgttcaatattctaaaaatcggcgcagtcatcacctcggtggtttttaggtgcctgatggtgagtccctgctgccctaatttttctcaccgtcgagcacctagctaacagccaccgatgcagcaagggctctcaacggcgagagatatgtaaggagaaaaattaggccctaatcggcgtgctaggcagggtagccgcatttacctctaaccactactacaaaatcctaataggggacgtgtgcagatttctaaaaaaccatcacatttaacctcttcacaatcttcacatgagtctaagattaaaaaacgatactgacatgcctttataggtgcaagtttaattaaaaaaaccagcacatataaatacatgtgctattttttttaaaaaaaatcagcacctagaagaatatatgagtaccggttttctaaaaaccgacacgtttgtgaaagccgagccgatgaaaaccgagctgacctaatttttcttctcgccctcctcacatatctctcaccattctcactgctctccgatccccttttctgtcctcgttgcctccgccactcctccccctctcttttgctacctccttgcctccgccgaccctccccctctcctccacctcccttcccctgtcttccgtcgccccttctcctctcctcctctctgctcggggacggccagatccgccgccgcgtgcttagggacagccagatccgccgccgcacgctcgggggtatccggatccgccaccacaagcacggggcagcccatttaacgactactgtggctccctcaactccctcaaccaccgtgtgcttgggggcggccgaatctaccaccgtgcacacgaggacggcctactcacaacagcggcttcctcaactccctcaatcgccacaggcacaggggtggctgctcaacgacgacggtggctccctcaactccctctttgtgttctcctctgtgttgttaattttgctcttgaatgttgattttataattgtgttcttggatgttgatcgattttagggatgatggagagttgcttgatgcatcggctcgaatcgagcaacctttgttttggattcgggactctcaaagatgtcggttcctaaactggcacctaagattcctcctcatcagtgccacctatgaggtgccggttggaaaatctggcacctacgtaggattcccaactggcacccattagggtttatgtagtagtgaatgtttaattattagtatatatcttggtttgaaagtaaataattgtatgtaaattatgtttatgcaaaagttttcaaaattgaatttgttgaaactcctacctttctcaccaacgaacaataggttggcacttccaaatgatgttttgcatggacaagattggttgtgaatgattgatctacgaatgctaaaaggaaattgtgcctaattaggagtttgtaaggctgttttagcaagagataaattcttataatcgcaagaaaaaatctgcacctgatttcttactcttcttgccatatagtacctttacatgtttgactgattccaaattaattcccaagacgcataagctttccaattaatctatactactactacaaagataaaatatatataaaaaatgtcctccgtcccataatatatgtgcttttgggtggatgtgacacattctaagacacattctaaagaggatgtgtcacatccaccaaaaaatccctgagtactttcttagtgtttctatattatctaaaaaaaatatgctatttgttaatctgcactatatattaactgcagggtcatcgatcatcattggacaccaattaagcaacagcaatggcgtcgaggagcatatcaagctgcacaactgagacggcaaaaggcatccacaggttcgagatcttcagttacagcatgatgaacaccgaagccgaagacgactccatccggtccggcgtcttcaacgtaggaggattcgattgggcgttgctttactaccctgacggcatcgacgacgacagcaagggctacatcggcgtctacctcgagctgatcagcaagaacggcgagccatgggcactcgtcgacgtgaatctgatcaaccagctgcaacccgggcaacctcgtcagctgttcaccaagaccgatgtgcctaccccgttcagatcttcaagctttcaggagtctaccttggggtctctcaagtgcatgaagaggagcgatattgagagcactccagggttcatcgtcaatgactgcatcgtgatcgaatgcaatgttactgtcatctatgagccaaaagtgtctaaaaccagggcattgtgtgacgctgaaactagttcggcattgcgcgagatcgaggtgcctcctatggagatatcgtcggatttcgccaagatgttgaaggacggtgtaggagcagatgtgacattcagagttggagaagacacattccgtgcccacagggcggtgctagctgcgaggtctccagtatttcatgctcagctctgtggaccgatgaaggagaagaaggagacacaaatgcaggagataaccatccaagacatgcagccatctgtcttcgaggctttcctctatttcatctacaccgattgtgttccaagaatggatgatcttggcaatggtgagaagatgcatttgatgatgcatttgcttaaggccggtgaccggtatggattggagaggctcaggatcatgtgcgagagatttctagctacgaacctcgacacggagcatgtatctgcgatactgggtctagctgacttgctagatctcaagaagctcaaggaagcttgcatggagttcatggtcccatctgagagaatggatgccgtggctgcaagtcaagggtaccagcagctgaagagagcatttccctctctggcgtttgaagtgtgggagaggaggagccgtgttcgcaggaattaattaacatcttcttgattcagaagatatatgtgcgcgatgtctggagatttcctttttggttatgtttgttttggtacatttgatgatctgacgaatgttctctcaacaatgtgatgactgatacggtgcacgcgtggttgcaccttaatgtaatgtggctatctggatcatgcaaatggttttacctttagatcgagttgttttttaaaccttactctcttaccaactctcttaagtttttatgctagaaatttgccccatcactcctttttatcttaaattgcccatgagttgctactcgtgttttgatatcttgtgtgttcactttgatactatttttaaccttgctaaattttgtcattattaaaattcggcaatgtagcaaaccaaacacactatcaccaacatattcctcccaaactgtagtagttttattaattttcgctataaaaactctaaataaatttggtaatgtgcctcaaacatttttttttaaaaaaaatgtgtctcagaaaatgtgctcaaacatttagtttgtctttagcactaccagagtgagacacacacacacacacattttggttttccatcgaattattatccaattccatatgaatatcgatctgatcgaacttgtttgattaatctattgcaaaatacttggagtcctccgtgtcgaatggaccaaatctccatatatatagccgcatctacaaaccacttttttatgagaaaatgtgacacacacacacactttgctttcccgtcaaattcttatccaattccatctgaatatcgatctgatcgaacttttttgattaatctgttgcaaaatacttggagtcctccatgtcgaatgtgacacacacactttgctttcccatcaaattcttatccaattccatctgaatatcgatctgattaaacttgttcgattaatctgttgaaaaatacttggagtcctccatgctgaatggaccaaaactctccatatatagccacatctacaaaccacttttttacgagaaaatgtgacaaacacactttgctttcccgtcaaattcttatccagatccatctgaatatcgatctgatcgaacttgtttgattaatctattgaaaaatacttaggagtcctcagtgtcgaatggaccaaatctccatatatatagccacatctacaaaccactttttcttatccaattccatgatcgaacttgttcggttaatctgttgcaagatacatggagccctccgtgtcgaatggaccaaatctctttatatataaccacatctacaaaccacacgtagattgaattggtaacaatggagacggcgccgtcatcgtccatgtcaccggccagcggcacgtacgtcttggacgtccacggcttcagcggcctgaggaggcagcactgcggcggcggcggctgcatcgtctcgccgacgttcaccgtcgccggcctcgagtgggccatccggtaccacccggagggcgacgccgacgaggtgaccgacgacgtggccgtgttcgtcgtgctggtcaccaaggacgccacggcgtgggcgcacgtcgaattccggctgctcgaccaggccgccggcgagatggtcaccttcttcggggagaaggatccgatcttgttcgactccggcagcgaggacctgtccacctggggcaccggcgagctcgccgccaggagcttcctcgacggctcgccctacgtcgccggcgactgcctcaagatcgagtgcgccgtcgacgtctgccgcgaccgcctcacgttccaccacgacacgccgccctccggcgagccgttccgccagtaccccgccgacgacgagccggccgacgtcaccttcaagatcgccggtgagaccttccccgcccatgtctccgtgctcgccgcccgtgctcccggcctgctcaacaacacgacgtcgcaggcggcaaccatcaccatcgacgacgacgacgacgacacgccggcggcggcggcggcattcggagcgctcctccacttcgcctacaccgacacgctccccgtggcgagcggcctcgacggcgccggccacacggcgctgctggggcgcctcctcgtcgcggcggggcggtacggcatggcgaggctgggggcgatctgcgagcgcgccatgtgcaggagcctcgacgcggggacggcggcggacacgctggccatggccgacggcacggcttcgacgcgctgaggcggcggtgcgccgagttcatggcgtcgccggacaactactacttcgtggcgggaagcgtcagccatgggcgcctctccccttcactccggcgagaggtttggaacaagtactatgacacgtgttgcagcagatacgaggagggggcccacattctgacagcaacaaagattaagctaagcaaaaaaaataatacagcagacaatgtggttgatatatgattcagaaattgtaaatatgtagaaagtagtagaatttcttatttacgatatagcgttattaggacaaccaaaatattgtttttattggtcaaggacttttttatccaccactttcaatggtgagttactaataggcaatgcttaatgtgttttttttttttgctttagtacaccatgctagtatatttctatttagtagagtatacattgtttgcttagagggtgtttagatcgcgcggggggggggggtggtgttaaagttttgagcgtgtcacatcggtcatcgagtattatttagggtgttgcatagggtgtttgggcactaataaaaaacaaacaaatttattaatcctaattaatccgtcattagcaaatttttactgtcgcgtaccacattgtcaaatcatagagcaattaggcttaaaaaattcatctcacaaattagtcataatttgtgtaattagttaccccctccatttcacaatgtaaggcattctagcatttcccacattcatattaattttaatgaatctaacatatatatctatctagattcattaatatcaatatgaatgtagtaaatgctagaatgacttacattatgaaacggaggaagtatttttttagcctatatttaatactacatgcaggtgttaatcttacttaagatgaatttggccgattacagaactacctaagatgaattttactgtcttggttttttttccctttgaaatgtggctattgagtaatactaatcaatataagtttggcaattaccgcttgcaaagtctgctttgtttttgtagctgacttgtaaaaattatgggcagtagtatttttttttccttgatgaattgcaccgcacaatctatagactcttcgtgcacctcaatgtcgtgtaaaaatgatggccaaactagaagaaagagagggaaaaaaaagagagaaaagaatggacgcttcggcttcgatgtctgacaaatacagttaaattctctcgacccctcttgttcttcaattttaaaaaaattcaaaaaatcttcacatcttgagattccaaacttgctactagtatataaattcctccatggtcatcagctcgatcggtcactctcagcaagctcgatcagattcagagatggcatcgtctcgccccatctcggagagcaccatcacgaggtcgacgtgcgcgacgcggacggcgcgcgccacgcaccagttcgagatcgtcgggtacagcctcaagaggtgcctcgccgccggcgagttcgtccggtcctccgccttcgccgcctgcggctacaggtggtccgtccgcgtctaccccggcgggttcgggccggcgcaccgggagttcgtgtcggtgttcgtcaagatgatgaccaacaggggcaaggcggcggcgcggttcgacctccggctgatcgaccgcgccaccgggctgccccgctcggtgttccgggcggcgcagccagtggtgttcgactactccgtcaagcacaagaagtgcaagggcaagcggggcacccgcgcgttcatgcggcggcgcgacctcgagtcgtcggcgttcgtccgcgacgaccgcctcatcgtcgagtgcgtcatcgacgtcgtcgtcgccaacggcggcgacgacgacacggcggccgcggcgtcccccctcgccggcgtgccggcgccggacctgtcgaggcacctcggcgagctgctggagcgggcggacggcgtgggcgcggacgtcacgttcgacgtcagggggcaacccttcgccgcccaccggatcgtgctcgccatgcgctcgccggtgttcatggcatcgctgtacgggtcgatgagggagcaccgcgcgccgcggatcgccgtcgacgacatggagccggaggtgttcgacgcgctcctccgcttcgtctacagcgacacgctggcgctccccggcgacctcggggaaggcgagtacaaggagatggtgcggcagctgctggaggcggccgaccggtacgccatggacaggctcagggtgatctgcgagctcatcctctccaggagcctcgacgccaagaccgtcgcggcgacgctcgccatggctgaccagcacagcactactgcgacgcgctcaaggatgtttgtgttcagttcatggccgttgggttggatgaccacaattaatgattgatatttgaatatgatactagttgagtgcccgtgccttgctacggggcaaaaagtatgcatccattttaagttacattgaataaaataatgttaagtaatcattaagtgtaaattataacaaaaccttaatatagccccacattcaaagagaccactcaatctccacacgcttaacctacaaaattcatgtttatgtaacgttgcaaaattgataagaaatgtatacattaccaaattggatcatctagccataaatgacaaaaacaatgtatacctttcatattgcccttccattatatcgatcacaataccttttaagaactatcaaccatctgaaaccaatgaaaatttaaagctcctcgcaacactaagaacctctatccaaaatagtgctacaaggggatagaacggcatataaccttataggtttcccttattggaaggaagtgtattttttgcaactcaaggtgatggttatttgcaagtgcttcaaattactgcgcctaagttgatctagatcggctatggcactcgagcttgtcaatgaagaaacctttaggctgagttcgtttcaaagggttcccaacccctgtccctcctccgcgcgcacgctttttaaactgctcaacggtgtgttttttttaaaaaagcttttatacgaaagttgtttaaaaaatcatattgatccatttgtttaaaaaaatagctaatacttaattaatcatgtgctaatggaccactccgtttttcgtgcacaggagatttgttcccaacccaccccaacgaacacagccttagaatggtatcgaccaactatgggcttctcaatgatttgtataactgctagacaactcactcataccagggtctttattctagatgctcagcaagaaattattagaacaaagcttaatattacagtccaaaaaggtacttacctgtgtaccataatgatatgaaaatccttgcgctgcaaacataatacagaggaacattgttaaaatctacaataatgcatccattgttaagatatacaaacacaggatgtatcggtgttaaaactaagggactcaaataattgtttaccagataacatatttgtttgaatcatgtacagatgacatcgccagttctcaacaaattaaagtaaagattctagccctagcacttggggaaagcatacacagaacagatcactcctaattaagtctcaactttaaggaagccaatgtttatgtaaatacataatgtattaaagacattttccctgggttacatctagcattctggcaaaagggctataatattcagttgaatgactaataaaaacaaatattttcagtgctgtaagcagaaatcctttggtagtaatatagatatgctggcacgatatcttacttttcaaaaaagtgacaaaagattcaatgtttatgtaaatacataatgtattaaagacattttccctgggttacatctagcattctggcaaaagggctaaaacattcagttggatgactaataaaaacaaacattttcagtgctgtaagcagaaatcctttggtagtaatatagatatgctggcacgatatcttacttctcaaaaaagtgacaaaagatttaatccgagataaggatatactgatatacagagctctaaaacaatcaaagagaaaaaaaaggagatcactcagctaacacctcatttttgccttcaaagaggtggagaaatcaagcaataaaacactgcaggaaaacaagccactacactcttactaccttttttgttcatgtgaagaagggattaggccattagggaaagtcagaaagagataaattggtggcaaataaacttactcagattttaacatgaaaataaaccaaagaaacaattttgccaaaccatatgctattagcaaaattgctctaacatatcagcattacacacgtacgtctcagatgtttaggtaaatatccaaacttatcccctataacatgcagtgatacaggcaaacatgcaggagcaaaatatttccaagccattgacttacagaaaatcagccaaccggtttgcaagcaaatctctgctgctctactgtcactccaatgcatcagttatcaattcaatctgaaatacgtgcagcatgagcataacttgatgaacaatatataggatagataatctgcagcctatcagttgctttccattgtttatttcatatgtagcagatgtagaaaaaggaggtaggggtgacaacagcgcaagaaaattttggagcagtagaacaccatcgaacacaacagcaatgactaataagatggactcacattcatggtgctgactctcttcctgctctatcctctggaactgcctaatttacctgaacaaaagaagaggaattaacaaagagaagtctattaagcataaaagataccgaactgtggtggaggggatggcgaggaacgacacaccggccagcagcccattttcaggcagaggattcagatcgagcgtcagcggtcggacttggagatggatgatttgcctgaatgccaggacacattgcagcctttcaatctagccgcgtgcgcaaaccctagggtcctctccagccgccgcagtggtgcatggacctccgcgtgccagtgtgccacggtgctctagcgaccatactaaaatggtaaaacctcaccgctgcccactcaaggccgcctcctccatcgttaccgaccagatgaatggagcaacggtggcgacggtcagggagatgcggcatggatgccacgagcggtgggttgtggcgtcggcgacgaactccactcgtgagcgtagggcacagcaaaaatggcgacgatgccctgttgcggtggcggcggcggtcgagggcggcgaggagggagcacggggcggcgatgaggcggcgcggtcaagggacgcgtgggagggggcgcgggtcgcgggggcatcgaccctttttacgcttttttccttccggatcgcatgtacccttttttttatttttgtcgctccaaaacgtgtggatgtacgtttctatgttggatcgtgtgtctattttagcttcaccatcatcaatccgaatttttttagtagtagatatttgaatttacttttctactataaagattttgttgctataaatatgatctatgagaaaataatagtttagaagatggtatcaaattaaactgtggccttctatactgtgaaacagcgtaactactcaggaattagagtttgaccgggtcttataatgtctgacaaaggtcctacttagtactccgtatatgaataaaactctagtatatgtttgtcataccgaataaaagtaattagtttctatctatatctctaaacttacttaaaatctaagtcacatatatgctcttatatataccggcctctaagattcaatacaacaagtcaataagtccaatattttcggtataactctctcgatctccctatattattcaacactctttatagtactcacggcgctgctaaaatcaaattgtgataggttgatctagggtttccttaataattaattaattaatctctcccacacctgcatcgcaacgcgtgaatcgatcgatctcacagcagcaagtgatctgattagcaatgcccatggagacgacgacgacgacggcgacggagtcgatgagcaagatggagacagtaagaggaacgcaccggtttacatttcacggctacagcttgtgcaagggcggcggcgccggccggtgcattcgctccggcaccttcaccgtcggcggctacgactggtgcatctgcttctacccggagggccagggcggcggcggcggcgaccgggaacacgtctcggtcaagctcaggctggtcacccgctgcgccacggccaccgcgttctacgagctccgcctgctcgaccaggacaccggccgcgccgccgccgtcgcccgggcctccggcgcgcccagggtgttcgcgtcgagcaatcccggcacagcgtgcttcggccgccgcgcgttcatggagcggagcaagctggaggcgtcgcccgcgtgcctgcgcggcgacagcgtcgtcatcgactgcgccgtccgagtcgtcgtccacgaccccgtcgtcgccgccgtgcggcgccgcgaggcgccggacgacgtcccgccgtcgaacatactccggcagctggtggcgcaggtggagtccgagggcgccgacgtgacgttcgccgtgcagggggagacgttcacggcgcaccgcctgatgctcgccgcgcggtcgccggtgttcaaggcggagctctacggcgccatgaaggagaaggacgccgaccacgtcatcgccatcgtcgacgtgcagccggccgtgttcaaggccctcctccatttcatctacaccgacgacatgccacccgacctcggcctcgccgccgctgacgacgacgacaccgacagaatcgacatggcacgccacctgctcgtcgccgccgaccgatacgccgtcgagaggctgcgggtgatctgcgagcgcgtgctccggcgaagcctcggagtcgagacggtgatcgacacgatggcattggccgaacagcatagctgcggcgagctcaaggaagcttgcctcgagttcatcgattctcatagcaagcgaatcgtggagagtgatggttacaagaacctcaagagggcgtgccctttgctcgtcgcagacatgtgggagaggatcgtcctatcacgtctagagtaaggctgtgtttagatctaggggtgaaaagttttgggtgtcacatcggatatacagacacacatttaaagtattaaacgtaaactaataacaaaacaaattacagatttcgcctataaactgcgatacgaatttattaaatctaattaatccatcattagcaaatgtttactgtagcaccacattgttagatcatggagcaattaatctcaagagggcgtgtccgttggtcgtcgcagacatgtgggaaaggatcgtccgatcacgtcgagagtaaatattaaaacattgctcatgcaatgttgagggtgatatagccatgaacattaattagcgagatttggttcggtccaacaaaaagtatctttaaggtaccggtacctcacggtaccaaatcgtttttgatctttggatctaacaatgcacatcttgcctagctagatctaatgatcggaaacgatttagtaccgtgactccgtgaggtaacagtacctcgagaaactttttgttggactgaagcaaatctcttaattagcgatgggtttatcaagctcttttgatttaattcattttttttctaaaatggattaatttgttcaactgagttagagtaaagtatatatgatggcaaatctgctgcaaattttaagttggtatttgttgtttacttcgtagttcatacggcacactagagtgtgtcgggatggaatcggaactacttgacaaggtgtgacaagctcgataacaataactctcgaatgttctcatcttggtaatgtggcgatgatgacttctatagagttgggaatgatgacttgtgttgactcacatcgcatgcttttttaattttcgcctttctacagagtttatcggttttccctatggttttaatttggtcagctttcctcgttaactgatcgccctttttttctctttagtgggtttttagttctttgggtgtaaaatttttgaagtatatggacgcacatttaaagtattaaacgtagactaataacaaaacaaattacagattccgcctgtaaactgcgaaacgaatttattaagcctaattaatccatcattagctaatatttactatagcatcacactgtcaaatcatggcgtaattaggctcaaaagattcgtctcgcaatttacatgcaaactgtgcaattggttgttttgtttcccacatttaatgctccatacatatatccaaacatttgatatgatgtttttggctaaaattttttgtgatctaaacaaggccttaatacaaaacagaaactctctaagctcctaagtttaacaaatcctcatatggaaccattgttaggatgaaaataagttaaatacacaatgtacttcgattataattgggataaatatacggggacacatttattgaaattccatcagccaaattcaacccaaatcagactaaatgaatcatatccgtgctgaggagaaactattactctcaaggggacatccactcgtttgcatgtcatccaaatagttatgaaaaaaaataataaaatttaacaagatagattaatatgtgataaatctgatcaaatttaacttccacgagttgcaaaaaaatcatacattaactagccaaaaatcattgtttgctagacactccctatacattaactagccgagactaattgggcccaaaacttccgtactcagttcggcccagcccagtaaccaatgcctccaaagtccgatccggcctccctcatcgtgatttgtgacgtgcagggtaccaagacactattccaaattccgttccgacacgtacttaccgtgcgcgaccaatacatacacacatctccgccacacgtgcacccgcacagatcgccgccgccgcaaacctcgccgccggcagcgtcgtagctacgcatcacgtaattaatgatgatgatgtcctccgcggcgccggctggccatcacgccggagaagagccgccgccgccgtcgacgacgaggagcaccatgtcgacgtgcacgatggggacggtggagggccaccaccggttcgcgatccgcgggtacagccgcctgagggcgctcctcgccgccggcgagtacgtccggtcggccgccttcaccgtcggcggctacgactgggccgtcgtcttctacccgcgcggcgccacgcacgccgaccgcgaccacgccgccgtctacgtccagctcctgaccgaccgcgccgccgccgccgccaccttcgacctccgcttcgtccgcgccgactccggccggccgctgtccgtgcacccgccgctcgccgcgccgaggacgttcagcaccgtactccgctcctcctccgccgccatgtacggcgtcaaggtggaggcgatacaggcgctccaggccaactacgtccgccgcgaccgcctcaccatcgactgcgccgtgcgcgtcgtcgggaagccgcgggtgtccgccgccgcgccgctgacggcggccgacgtcccgccgccggacctcgcggcgcacctcggccggctcctcgacctcaagtcccacgccgacgtcacgttcgacgtgcggggagtgcagttcgccgcgcaccgggtggtgctcgccatgcgctccgccgtcttcgccgccgagctgttcggcccgatgcgcaacaacgccggcggcgccatcaaggtcggcgacatgcagcccgccgtgttcaaggtccttctcggcttcatctacaccgacacgctcgccgccatggacgacctcgacgccgacgaggacgacaggcgagagctcgcccgccacctgctcgtcgccgccgaccggtacgacatgggcaggctgaagctcatctgcgcggacatgctcgcgaggagcctgacggcgcagacggtggcgagcacattggcattggccgaccgccatggctgccgcgggctcagggaagcctgcgtcgagttcgtcatcgccatgggtatgaacgatgaggtggtgataagccggcatcctgaccagctcagctgtatctcgctcttcaaatacttcttctaccagatcggcagcttactcaaaatccactaaactgtgtttaattagtgaaagattcagagtgattgtgttatttcaacttctactactgtcgatagactcttaatcttttcttaattagtttgtccactaaactgtgttactagttagactcaagagtgtttgattgttccaacttctgatagagtcaatagacgcttaatcttcttaattactacagtttgtggctaatcttcttaattagtagtttgtggttgtttactgaccaggtagcttttttgcagttttgttgatgttctgatatacctttatcaaaatcctctaaaaactactcctcacgagtagtttgtctccccagtagcttgttgagtatattaattagtcagtgagcttgatttttctaacttctgatgctgccaatggacatttatatattctgaattagtttgtggttttttactaaccagtttagttcatgttctgatatgcctgagtttgtaaataatttatcctacaagaaaaggacgatttttcatacaagagtttctatgtggttttaccagtgaaacaaattaacagcgtgcttattatttttacttctggtactatcaatgaacgcttaatcttcgtaatcagtttttgtttgtttactcaccacttaattattcatagtttgtgaaggtttactgacttgtaggtactcctagctcagttgtagtttagttgatgttcagatacgagtgagtttgtagatattttttcctgcaggaaaagaaataaagctaatgcagttcaggtccaactattcactctgtaattttactagtgaaacagaacaagatttgctctgaaaattctggatgaacaacaggcacttgtcccctctgataattctgaatgaaacaacagacaaacatgcactaaagttctgaatgaacatcataacaaacagactaaaatttctgaatgaacagcagaacaagcagattctgcacaacaagcagaacaaacagactcagaaattctggatgaacaacacaacaaacaagttgtgaacaaaacaacaatcagattctctgaatgaacaagagaaacaacacaacagcaggctctgcacaaaacaacaatcagattgtctgaatgaacaacagaacagacaagagtactctgaacaagagaacaattagacacaacccttcaagtctgatcaacaaaaaacaatcaggtaccactaccacatgatgaaatacagtatatcgcccctggtttgtgtaatcagtacaccaagtagtaactgattacttgattagccatctgcaacacaagaataaaactgcatacttgaaaacttcagcaacaagcataaaactgcatacttgattagccatctgaaacacaagcataaaacttcagcaacacaagcataaaactgcatacttgattagccatctgaaacacaagcataaaacttcataaaccatacaggaataccactctacaagtacagcaaaggacataatcaatttctcaggtcaaacaggtgattagtaatctgcaacccaagctgcataaaccatacaggaataccaccctgcaagtacagcagagtacaagaggcatcagatttgaatcaggagacagagacaaaatttcagatcagatctggccaagaaacattcacacaaagtactcatccaaatgctgatgaatattttcttctcggttcataatagatagattcatagatagatcagacagtgcaaatccatggcttgtctctcaaaccgacccaacgaaacaaaaagattaaaccactccaagactcccatcccattacatagaacgacgacgacgacgaaccgatagatccatagctttcctaacgagatctacgactactaataagatagaactgatcacccgctgctcggtgattcagtgagggagggggagcaaaacgcatcatgggagggagctggatctgacgccgcgagcagcgcctagtaggtcttgctggggcactcgcgagcgatgtggccggtctcgccgcagttgtagcacccgccgccgccgccgccaccaccaccgccgcggtagccgccgccaccaccaccgtagccaccaccgccgcctcctccctgggagcagtccctggccatgtggccctcctcgccgcacttgtagcacgcgcggctgcctccgccgccgccgccgccgtacccgccgccgcctccgtagccgcggtcgcccccgccgtagccgccgccaccgccgccgtagccgcggtcaccgccgtagcggccgccgcctccgcccccgccgtagccgcggtccccgccgccgctgggacgggatccgccggtgagcgccccgccccccggcgcggtgacgtccacggccttggtgcggccgtcgttgccggatccgacggagaactcgacgacgtcgccgtcgttgaggctgcggtagccgtcggacttgagcgaggattggtggacgaagagatcctcgccgccgtcgtcgggggnnnnnnnnnnnnnnnnnnnnnnnnnnnnnnnnnncttcaccgtccccttcaccctctccgacgccatctcgacctcgccctcgccctctcgccgccgccgccgccgcaacccaaaaccctagaaaccctagatcggtgtgggagtggaagcgaatgggaggagaagccgccgccgggtgggctatttaacggcccaaaaaaaatctttgcattaaattactacctcgaaaaaaaatcttttcattaattgcctctttattttggaatatttaccgagatattccccgcggcatcggcccatcaaactcttcctctcccgactgacatctcggcccacttaggcggcccaacttcatagtttcggtccgacacgttcaagggaagggaacagagatggattttgtttcggacttgatttgtaaatttgcacgaaatttatacaaaattagcggtggattcggattagtgcgcgtaacaagagttcacacgatggcgacggagtgcacgacgtcgacgagcacgacggcgacggtggaggggcggcacaggttccgcgtcgccgggtacggcgccaccaagggcgccgcgcccggccaccgcgtggcgtcggggaccttcaccgtcggcgggttcgactgggccgtcgtgttctacccggagggcgtcacggccgccgacatggacttcgtctcggtctacctcgagctcaagaacgccgccgccgccgctggcggcggcggaggcggcgcggtggcgcgcgcgttctacgacctcaggctgatccacccggccaccggcgagccgcggtccgtgcgctggcccatggacggctcgacgtcgcgcgtgttctcccaggcgttcccggcgtgggggcacctgaggttcatgcggcggcgcgagctggaggagatggggttcgtccgcgacgaccgcctcaccatcgagtgcgtcgtcaacgtcgtcctggaccccgtcgtcaccgccggcgacgcgccggagctcgaccatccgccgtcgaacatcctcggccacctcgccgggctcctcggcgacaagggcaccgccgacgtgacgctcgtcgtgcggggcgaggagttcgccgcgcaccgggcggtgctcgccatgcgttcgccggtgttcaaggcggcgctctacgggccaatgaaggagtccacggacgcgaacgccggccgcgtcgccatcgacagcgtcgagccggcggtgttccgggctctcctccacttcatctacaccgacacgaccgccgccatggacgacctcgacgacgacgacgacgacaaggcgcagatgatcatgcaccttctcgaggccgccgaccggtacgacgtcgagaggctgaagctgatctgcgagctcatgctctgcaagagcatcgccgtggacaccgtcgcggcgacgctggcaatggcggatcagcaccattgccagaagctcaaggaggcgtgcatcgagttcttggccacctccaagaagatggaaggcgtcatggaaagccaagggtacgagaagatgaagctatcttgcccttctttcatggtggatttgtgggagataataggcaggaagatgacctcttattctgttattcccaatatctatgcaagagacaaggactaattttcttgaatttccttgcaaattcgcatcaaaatgccagcatgtaaccataaaccattgactgattctagtttggagataatgatcacagtcttgctacttcccgcgatcctcaacatcttggcaaaaatctgaaatgtttgaagttaaggataagatttgatcaaaaatttaaaatttcgaccatcaagtttatcagtttatcaaatttaataagtttatgatataatgatattgctttttgatgcaaatatatgtataccattttttttgtttttaagctaattaaccatttaaaaaatattgattagaattataaagttttatccgattcatgacataaacaacaagtatttataaccgaaggaagtattcagtattgacaactaggctagctgagcaacttgaagatacatagccgttcatatgatttgtgttccggagttggtcagccgcaatgttgtaactcatctgctcacatctcgtacgacatttcaagatatggaggcttcttcttgttttggttgacacatttctgttctacgctctgtaaacaacaggatgtacactgcatgcacaccagacgaatgtatatatacgtgagtggccgtgaacagacacgtatatctcatcaaaattttgattgatcactgccataaatccacaaccgatgtttgagtgaattcgacttgcaatctttctgtctgtcttttgtttctttcttgttttgttttgagtttatgtgtaatcattatctaaaaaaacaatctgtttatatttctgtttgtgtttcatgaaacggattagtaatgttctcagggcccaggtctaacccgaatccaggccttcgagagggcctatctaaaacactatattatcgtatgatccaatttcatggcgtacgtgctcgtgctggtcttcttcgtctccccaagttctcatctgctattgcgcaatgggcgcctgcgcctcagcttcgcggccgccgccgtcgccgcgccacggctgctctccgccgacgccgacgatgacatggacggcgtcgacgtgcacgacgccgatagcgcagggcgcgcacgcgttcaccgtctaccagcacggcctcgtcaagaggaccaccgccgccggcgagttcgtccggtcgggaaccttcgccgtcggcggctacgactgggccgtcaggtactaccccaacggcgacagcgccgccgaggcggcgtgccgccagccgtcggtggtcctcgagctcatgaccgccgacgccgcggcgtccgtggtctacgagctcaaggccgtcgaccaggtcaccggcgagcgcctcgtcctccgcgaggacaagacggcggcgttcgacaccaggaacggccagttcagctgctccggcgtgcagttcgtcgagacgccggcgttcctcgccggcgacttcctctcgatcgagtgtatagtcacgatcttcggcgagccacgcgtctcaaagacgaacaagatgccacagccgccgccgccgccgccgccgccgccggcggagacaagcgatgtctcatagacaataaagaaaaacaactatactactgtattgctctcatgtcatggtttaatacaaactggtcaaactactgtgttgctctcatggtttttgtctctgatgaaaacaattacaattgcttacattaaacgaacagtaggttaagcagaaaagaagctgtggttcaaccatgttcttctagtgtagacaagcattgggtctgaacagattaattccaggtttatagctgcattacctctgtcgaagacgaaaattcgccgttgatcttacacatcatggcatcatcaatctccaccctagtccagagctttggaaaagaataaggaatcgtaacagatgcaacagattcttggttgctcaattcattcttctttccaaacagctgcgccgcaataccagagcagatcttcagatcaacctcactctgtgctcttatcatcttagcaaggagctcagtcatctttgcacctctctccatttgctgcttgatggataacttgacaggctttggatggtcatctggattttggtcaggagggttgtcatcctcgtaggtgcttttgctttctagcaattcctttatcttctggtccaaaatagtagcaatcctgtcccggaagccatctgcatttgcagagtccgatttcagcctcacctttgcctcggaaaccaatgtttccatcctctcttctgaagaagttgcttcaggttcaggttcatcagcagcatcttctgtaagaccgaacgtttcctccagtaacccaacattctgtgtatacctttcatacgcttcattttcagcatcgatgtctccttggatatgttcttttagcttctcaaacctccacttgtttatgcccataacatcctgtaatataaatgcttaactccttaatcatggtctcatcatggaagaaaagaaacgaaactaaacaatgaacaatcgcaaacaatggaacagctagaacctttttggcaagggacttctttgttcggagggaattcaggaaatgatggggaagcctttgcagagaagccaaccttgatgaactgcagcagcaaatttcaagcaagcatcagaaataatgacagattttaccataagataaaactcctggttcagaaggttacccggttgaaggtatattagctgatggttgctctgacagaggagctgttgacagaggtggcttatctggcaatgtgttgttctgtttcagaactgtcatgattggtgataagaggtggttagtggctttttcaaaaatattagaaaaatacagagtccagacaaatcacagaaaatatgtagacaggcataacatcatagccataaatcaaaatttcttgtatgtaaccaaatgttgctaatcccttatacaccagagagaataaattttgacagcaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtcatgggctcatggcactcaagtgagtcattaccacagtcactagatcatgatacaatactgtcgttcctgaacctgtcccagtttgctggtcacagttgatgcaggtcacctccaggccgtgtttggttattagaggcatccaaatcaggtacagaaacctacctgattttgattggggcaacagtggccaggttcctcgccattcaggtggtgctggcatgtgtgaaggtgtgtggtggcacactgcaggggataatccagcagtagaagatggggaccaagttgctacaccctgtgatctcgtggccctcaaggttctctgtcgccgatgcaagacaagtcagcagaagaggggaggaggtttggagaagactagggcatttgcttataaaagatggtggcaagggtgtctgctgaaagcctgaaactgcatcgatggcgaggatatgagattatgttagaactgaggagatagagcaacagaattgtgtggctggatgggtcacatgtctgatgtctctacaacccaaatatttatttgtctcatttcgtgttcccttccttgtagtgtaaaactgattatcttccttgggtgtttgtgtatgacataccataaagtagtagtaatttattttataccatataatttattttgacagaccaagtagcttgttcatcgacctagattcattggttcaggttcagggtcacatcccacatcctaaactacagtcctgaagaaaactgccgctgtttgatccaacctgacaaacatactgaaattcttctctacaccctttccctcatttccttccctaaaccctacaaaatatgaagatcaaacattctgttgaccaacatcatcccactatttgagcagcctgatggagaagcattaattggttgttaatgttgttcaattgcacgcgacaacattgtcagtactgagaaaaataaaaatccaaaatggaacaaaacgttataataatgcatttctatacctgtagtttcccttttagatgttgaaatgagcatgttcaaatcttatcattataagtttgatcaacggtccataagaaagtgaccgtaccttaaaattcctccataattgaagtatcccactaccccacttacaagcaattgtcctagctttgatgctaagtagctaaacgtgataagcattcccagaataaattgtaaacaataaaacaggtaaatctccaactgccaaacaatgagtaatagtccacagaaaggtaaaactgcaagaccaaatcacgcctgtcaaaaaaattggttggatcaaatgatcgaataagtggatgtacaggtattcagtcagcggcttaatacaactaattacaagcacaattcgttgcacaggagcagatatatactcaaatggtactagcattacacatacataccatgaatgtggcaaggattctgagccttgtagcagcagctcttacaacactggaacgggcacctgaaaggccaagcattacattacacagaatgaattaaaaaaaatatccaggagcgacatgccgatacagcgcatcgatttctcttagaaaaccatcactacaaatccccaaaacaaaaaaaaaaaaatcttaccgcgagcgcgcaacgttgccgcactggatgcacttgggcttgttgaggccgcgcaggttgggcttgggcatgtcgaaggcggacgccgggggcagcttctgcggcgtcgtcccattgccgttggcgaccgcgaccgcgggtgccgacgagtcgctggccgccttcccgctggatgccggcgacgacgcggccatagcgaacccgccgtgaaccaccccgcaactccgcacaggaccagcggttgggattccggggaaccggaggcctcgacggcggcggtgctccggcgagctagggtttcttcttttttttttcttttgtgtctctcctgcttttcttttcttgagtcgagtcgaatccaatccaatcgtgcggtggcttcccgagacgaacggtttgatgtgggctgacaaggtgggcccggtggtgtaattgggctgggcccaattgaccaagtctattctaccaaggcgatgacgccggcgagttcgtccgtatcgacgccttctcacttcgcagccgccgccgccgccggcgccaccgaattcaaccccaacggcgacggcggaagaagaggattttcgccggcgacggaggtgacggaagtgtgccctttttttaagtaaatttttcatctacacaaaccgttggccccattatttcgcttatcttgtgcttattgtccagcttactagtagcaaacaaaaaataatttgtacgtaaaatttttatatgtgtgtgtctttactgatataaaggccaatgttgtaaaataaatcacgatgaaaaaatccacaaaatcaacttcataattaagtcttaaaattaacttgacttatggtataaacataagtgaaacaatggagacacattttttaaaaaataatggttaatgatttcatacagaaacagttccaaagtatctctgaaatctaagttcaaatgcttcgattataaagtggcttggctcatttttgagtcatcaacaagcatacagaaaagttccatgcattttttttcttttttcctcttttttcagtcatggtagctacaaaaatcataggcaaacaccagctggtgttcttcagcctagcacacactgaaacacatagatacagtcatacacacactaatcatcaatcacacaatcacataaaccaaaacaaagctctctgctatgcttactgagagagtaagctagaattatccccttctccacatttttttaacttcctactgggtgctgtttctgacatgcacaagattcctcagctcttcaaatgcatccatggtctctggatcgaatcccccagcaaactgcaaaaatgagcggcaatttagaatatgcagctgacattaaggtttaaataacacatcttaatatgtcataacaagagttaacagcagaaaatagcacaaacgtaatgcagaaataaccataatgtttctgaaggacataaaacatatacaagcacctgtggaaaataaatatgtgcaattatatacggaatgggaatcaggaggcagatgaaacaattatgagatgtggtataacataattgcccaagtatacatctaatcagaatggagtatgcagtatgcacaggggaattttctttttgtggagttcctgctagaaatgtgttacctgatgcattctgaaggcaaatctcacagcctgaagtagcatatactccaaagctggatctttgttcagaggtcccatgtattgaagttccatagcaactcttttcatgtacatctttgctaatttgacagaagaaaattttatctgcagttatcaaggaaatagaaagacaacgattactccagttaatagaaaggcaatgattaatccaacaggatgtaaacgatggtctaggtgatcgttgcaaactgcttctgttttacaacctttttgtggtatcaacataatctgcaaaatgttcacaagcaaacaacagtggtacctatgcaaagcgtaccacattcctaagtttcagtagatgaaaataaccttagatactatataacaagcacctcaagttaaccaataggtacttgaaaacttatcctggtagtctccatgctatctattctgaatactggtaaccaacaaattttactttttgcaggccaagcatcataattctgactaggtcatttcctgtatcatatgctgacaacaatgtagcactaagaaatcaaaccttcaaatacggaaaattatagaacatataccttgccaataagattgttgtcgagcatccagtcagtaggaatattaaactctttacactgtctcatcgtagcatcccttgtcctcagaagattgtagacactccgctcagtcctgaattaagaatgcaaatgaaaatatcagtattcccatttaagtttaccactatttctgttaaatgtatgtaatctgtatacttatagtaaatttagtcgtacttttctgatattgtaaccattttcttcagtgcaatgtcacatggaaggcgaggatcatctttatagtttgaaacttcagattccaattttttcaggtcttggtagccaaaagctgcctctcgtagagtatctgccttcctttctggccaatcaaaatgcttcagcactgctctctcatccaccttcaagtaatgcaattacatgagtgaaaaaacaaagtaaattgctcagagtatagtgctactgaacattcataccaggaaaccaagctcatcatcaagccatttcacaaatgcaaccacatcttctatatctttgtaagctgcattggtcacctccttgatcaatgatttcacaaattcaccttgagtctcaacatcagccttgatctgaaaatgaacaaagagtaaagtaaatagccatacatcagtgcgagaaccagctagcttttcattggtatctacaattctacatatgtccaataatctgagcagaatattctacttacagcctgcaaatgcgaagaacggttctcaatttcaccaatcatgctactccgcacatttgctgagttagcagtttcacagattccactcccagaagtatccttttttgagtcccttctcataagtgaatggtaaagctctgcaacttgtggtgccctcttcatgaccccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatccatactttgagacttgcatacttctgacttgccaagaagaaatcttgagctttcagatcgaccaaaatcatacttatccacaagaagttcacgcttctccctgattgtctcatccttattacaggagattgcctcatctgttgcttcaggcaggcagataaaggtatcagattggcgcctcttcacaatgctaaactcctgagcacatccttttggtccacctagtgagtgcctgcgtgtcgggcttctgcattctgcagcttcaatccatgctctgtcaagaagggcctcctttttagatgcttcacaattcttatcattctgagaccattgtttgatacgctcagcaatgctgaacttcttgtgatcagaactgttctgatcaagtcttgcatcaccatcacaatcatcaacatgacaagcaatttcatcattataatctgcatctgtcattgctctagctgcttgatctgagttactgagctcatgacgtagacaagaattgatccaccgaagataggcaagctcctcaacttcagttagccgactcatttgcagaccctcaacctgcttgctcaagtttgcatttgtgtgccgcaataatgaagcctcagcttgaacctttgcaactatctcactctggtgacaataagcatggtatagaaaaggttagctggaaacaaactacgactcaacccacctgaaaaataatttagtttaagtaatgttacctcggcattcttttcaatgacagccaatttggactctgctgaagagagtttaattgcgaggtttcgtttctgaaattgaagctctttgtttaaacgtcgcagttcaacaacttcaatctccaagttttctgaagaagatgcattgcccccattcatactagaaacccgattgccatgcccatccaaccttgcattttcttcatgctgctctaccatacaagatagagctgatagctgttcagaaaggcttgttttctcaacttctagtgaagttttaagtcgcacaagcctgtcaatttcattcttccttgaatcaagatccttttcaagttccgaaactctaggattttctctgcattgccgcaactctgactgtaatgctagttccctttcctttgactcacgtagttgttccctgagatgatccaactcaagaaaaagatcatgagatgctggggacctgatgccatggcaatcaaagacatgggggtgaacctgagcaccagcaggtgaacaagggaaatctcccataagagatctcttaaccctagaatgatatggaatctgttggttgctggtgttaacattttccacacttgcaagaggtggcttcttgcttgcagcagctgctgtcttcttggtctttttgtcagctgtgaaccctttgacaatttgggaaccccaagaggatccaaattttggcttgagcacatttatattgcttttggagtcaacccttgatctgcatggctttgtttggttgtcaaacataatatcttctttcatcttgtagcgattttgcctgacccagaacactaaccatgcagaggtgactcgacttgattaaaatgttccagtacctgtactaacacctgcaaataagtgagaaaaacatgaattgagctagcaaccaaacatcaataacacagatgaaaacaagaataaagaaaaaaaatgaagaaccagatatgaatgccttttaaaatggatgccttcaaaaattgtccataaataaggaaataaagcatcaattcaggagtactagactaaatgaattctttattgcaatgctacccagaaccatatcaaaccacatctttaactacttccatggagtccatttgtgtactactctgaagagagcaacatttaagcagcattacaactgcctttatctctctctttagaagcatttgtatgaagcaaataaataacatcaaggtctgagcaaatcaagcttaatacttttttgagattatcgtttccaaaggctaaaaagaagcactgcctttcaatttttttgtggccgtacagtacacatttgtagcatcgaccatcaatgcatcgtcgacgaagatgaaatctcccgaaacctaatcaccaaaaagcagaaaactgctaactgcaaacaagcatcctcttgaactaactaaaacacgaaggagaaggagcaaaatgccccaagatccaactccctagaaccaaaatcgaatgagaacagcaaatgggaccaaccgattttggcgaagatgataaacacaatgccaatcaaaacccaaaagcttccacaaaaatcaagcatttgaacacagcgagtagactgaacccacattgggctcatcatcaagaaggacacaacaagtaaagcgcgactcttacctcccaccacccaccatcgatttgtacagatcgaggtgaaagcaaactcccccgtccacaaaagaacccagccgttctgcacaccgagcgagctcaagacgatcgccaatcctgaaatcccccactaatcaaagccttctccctccttttgacctcctcctgaccgcaagtccgcaacctatcatcccccgctccagcaagaacccccccaaatcagctcgatttcaacttaagaagacgaaaaagaaaaaaaaatcaaaaaccccgcagtgccgtgccactcccgacgacactaccaccactactcctactagtagtagagccaacatcagccagtggcagtaaacaaagaagaataggaggatgaagacaagtgcggtggagcttcggatgctttcaccttcggcctcgctcgccttcgatcgccgcgccccgcgcccacgcgcggatttttctacgagctcgtcgcggcgagttcgaggattcggttgctctctctctctcctctcctctctcttgcgctctgcttcttctcgggagaggagaagagtggagtggagagtggaggggggtgggtgtgtggtttgaattttgaaatggggataggggttttggacgagacgagtagccgtagcgcctagggggggacaagacattggcagagcaggtactgacaggtgggtcccactgagcagtttctcgcctttttctttttctctctccctggtttcttgtcgcttttgtgagaccgagcgtactgggccgccagcaggctactgggccgggtacttctctctaaaagtctgagtgttaggtgtgggctgtcttgttatgctggaaataaaaaatggaataagttcaattgaggtccctagatttgttgactgagtctgaaatttatccctaaactgaaatactagatataatggataccccaatttgcaaaactagatcactcgaggttctaggcagtttatgcccggttttggttgatgtggcaagctgggtcaacgtgggacccacgtgggcccccgtatgtcagtagctagcactttcttccttctcttctcctctcttcccaatcccctctagggcgacgaccaacgggaaggacggcgcgatgggtgagattttgttggcgctgtctcctctccccatcccctgatgctgaggagacgtcaccaacagagcgactgagggggtgattgatggtgacgagcagtttacacagctctcggatcaaccgcgagtagtgctctctgttgtcgttgttgtcgtcgctgctggccccaccatggcaatggaaactcgagcaacgaagtgaatcaaaggtcggaggtggaagatggtggtcgtcgacgtagaagatgatggtggccgttgacgtagaagatgacggtgccgtccacgtagaagatgacggtggcaggggtccaggtgatggcataggagtgggcggcgactatggggtcatcgaaggagaggaggtagcgctcctcattggcacgggtggtgctatcgttgcctccatcttcgccccttccccagccaacgatggggcatggaggaaatagatgggagatggggaatagatggagagagaggggaggctagaggtggagagaggccttacatgtgagccccactcgccacgtcagctaaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgacaggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgattctcttttccctattcaattacacggaagacataactgtaagtgtatctcataacattagcttataagctgtagataaattcatattttggagcctaattttaagctgggttgagccaattaagagcatctattaaagcatggctaaattatgttcccaaaatgcccatacgtctagctagccaaaagattatattttttaaatttttatatttgaaacggactctccaattccaactctacatatggtacagcaaagagcaatacttcttccgtttcacaatgtaagtcattctattatttcccatattcatattgatattaatgaatctaaatagatatatatatctagattcattaacatcaatataaatatgagaaatgctagaatgacttacattgtaaaacggagggagtacatccttgatcgagaggcgaacttggaaaaaccaaacacaaaatccaaaaatcatgggtcagatttggggggcttttaactatttgcccctcttacgagtggtgcttaacgatttaccactagacctacatgtcatagacacatgagggcccatatgttatagacacggtgtggcaaatcgttaattgccatgtcacaagagtggcaaatagttaaatttccccagatttggcgtattcaattttctattctacaatgttttggagtgacaaacgatcacccaaaaaatcacaatcacaaatctctgaagagcaatcactgaaacaaccatagatgtgtgtatttgtgtttgtggttgaggagtggagcttcaggaggccaacaattgcgtcgccttcaggcttcttctccatgccacacatgacacacccatgccctcgttgcaatccagcgtcgctgcgccaggagacgaggcgaccacctgtgaagagacgcacttcagaaacgggaacatgttcaggaaacggatcaggtattcaggcctagacattcagcacatttttttatatatactccaacaggtttagaacagtttcaattcacaaaagcaaggagcagcaacaacaggagcatcaagtcatgtactccctctgttccataataggttcatttttagctcttatttgtcccaaaaatagtttattttattaagtaattattgcatcagaatttataaaagtagaagtatagtataaatgtattggaagtagataaagagaagaatcattgtattatgatttgataaagtggggatattatagtattttaggttttgtattgatatgtgttggatgagtgaaaaatgaacttattttaggacagagtgagtacttcttaatagatccactcttggatgaagattgatctgattatattagagtggagaggtaaaatgagccaaaataatttaggggcttaaagtgatccaataaaattgttcaggagagtaaaatattttgtattaataaaagcttttctgtgtaaaaacgtaagcatggattaaaaacattagaaatggccaaaataacatgttaaatgatctagatctatgaaaaagatattaaattggactaaatctctctgtccaaactccaaactaaacctagaaattgacatacatctaatactacccttaaggcatccataatgttcggcataagatagaccttaaactctaaaagcaactagggactatttagatcccaccctaaaattttacagcatgtcacattgaacgtttgaacacctgcatgaagtattaaatatagtctaaaaaataactaattgcatagattgtgactactttgtgagacgaatattttaagattaattgctccatgatttgacaatatgatgctacagtaaacatgtgctaatgacggtttaattaggcttaataaattcgtctcgcggtttactgacagatattgtaattagtttttctattagtgcccaaacaccccatgcgacaccatatataatacccgatatgacacgccaaaaccttttacccctggatctaaacacccccttatatattgtgatatattgtggaacagtttgcaagtgaccttaagggtgaaaagaaatcaataatatttgactctcttccctccaagtctctcaccagcaaaaagtagtactccaaggtgtgatgcatagtaagattttttttaattgtgtgggacccagtttagtgtttttctttgccacgtactctctctgtcccttaacatagggatgttgatattttgattatactgtttgaccattcgtcttattaaaaaaaaattagaattaatatttacttttttgacttactttattatccaaagtattttaagcacaacttttcattttttatatttgcacaatttttttgaataagacaaatgatcaaacagcacaagcaaaatgtcaaaatcccttatgttgacggagggagtactatagtacattgcaacaattaccatatagctaaagttagacccagcttatggctcaataagactttatacatctaaaataacaaatagccataaaggcatcatattcataattgaaggagcccctcctattattttcaacccagactcgtcatttgcctgttttacattatatgattcataatggtggcgtcatgttccaaagttgcaactattatcactttcactacagaggctaatcagtccttgaaccccgatgctacagtggcacgtactggagagtagtactttatattttctcttaatttgcttggaatatttttggatttcgtacatgtaagtctttgcaattattttaatatgcgtatccaagcacgatacattaataaactaattgactaattatacactagctgtaaagctagtgcattaacctggattggaagcttagacctagcttttcttaaggtctaaccgtccaacaacatacacatgcatgtggagacaaatatgtcaaatggattgtactagtacatgtatgacccctttaaccatttgaaaataggagttagcattttttttaaattatgaaatgtcacttatgttatactcctatactccataacacctcatgcagttagagctgcttggacatacaatgattaccttatagctatgattatttgtcgaattagttgatgcatgcatgtggtgtgcatgcacacatgaagtcatgaacaatttgtcaatcagatgcagggtactagtagaaaccaacatgtgtcgtgcgccctggtttttttgtttcttcttttttttaaagcttttcttttcttctttggtgccatcgaaatgatttttaaatatttccaacatcttgtaggagctcaaaaaaataatccaaatttataaaatttatatccttccaactgttttcaaaatcctgcatttcaatccttgcaaaagaaaccctgcatttcatcgctttctccgtgtataaatataaaatattttttgaacgactataaatttaaaagatgtttgtctataagttgaaatttgtggtttcaagacatgtttttaccattcctcatctaccaactttatactaccccttcccaaactaaagtttgtagtttattcctcacctgccaatttatgtgcaaatttatttttctaactacatgtcttatgttataacttgttgtgtcaataatttctcattttttttaaaaaataatactatgatttcctaggattcgttcttatagcaaagcaaagatagaaaatatgtcgttttgtacgcatatgcttccaaaacagctaaatgatatgttttttttggcaaaaatatccattaagaaagttgcttgaaaaaaccatattaatccattttaagttgaaagtaataaatacttaattaatcatgtattgatggctcaactcattttgcgcatcttcttaatcttatttttttatttcaaacacaaccttagggcccctttgatttggaggaaaaacatagaaattttgaaggatttcaattctataggaaaaattctatgaatgcctttgaaatagaggattgaatcctatccaatttttgaaattcatatggaatagaaaatcctatagagattttgaaagaaacttagcaatagcttaaagctcttagaaaatttcctttagtctatctctcgcatccgattcttgtgtttttttacggtcattcttgtattttttctatgttttgaatcatttgttttacactttcattcctgttagaaccatatgtttttcttatttctttgttttttttcattcctacgattccaggagcccttatactactccgtatttaaggaagaatagtagagtaagggcaagtgctataatgctagatgtattgcccctaaacatgccacataagattgaatgatgaggtggaagaaataagtgatcaaagagaaggtgagccacccctcatgcgaggggcaacctccacacaaacccgaaggaaaaggagatgaaaggaagagtagattagacaaacaaataaaataaaattatttgggttagtatgctagaggtagttgtagatgtgatgtattgtactccctctgtcccataatataagggattttggatggatgtgacacattatagtacaatgattatagagagacagtttgtccagattccctacaatctcttatattatgggacgaagagagtatatatcatctcttattttaaatagataaaatagatatggcagccaccccttctataagatttgccctaactctttggttaagttaaaaaggacatctactcataaacaactgttaatcaccatttgattgggatcatcaattacatctgtcaggagggtgtctcctcgtcagaaaatgcagattggattcgacgccgacctgccttccgctgctgcttttcgagattgtcgacatgaccacatgtaaacaaaggctgtggccttgtttagattcttcgggttattaaatagcccttcgaaatcttgctatttaagattattaaacgtagattatcgataaaactgattccataatcccttggctattttgtgagacgaatctaattatgtatattaattcatgattagcagctgattactgtagcaaatcatggattaatatatctcgttagattcgtctcgcaaaatagcctagtggttatggaataggttttgtcagtaatctacgtttaatactcttaaataacgagattccagagggctatttaataaccctccggatccaaatagggcctgtgtttagttggatccaaagtttagattttggttgaaattggagatggtgtgactaaaaaattgtgtgtgtatgacatgttgatgtgatggaaaaggactgaagtttggatccaaactttgaatctaaacacagctaaaatcgatgcttgtgcattatacaagctcataaatgcaagaaaaagaaagatgagagatgcaatgcaagatgctgcggacagcagcaagaaaaaaaacaggttttccggtgacgacagattcccaacaaactccgataatcaattcagaaaacatcggcccgtgtgggagaagctcaagtgagtaggtagagggtgaggacctaaaaaaaactggattttctacttattaatttatttttaaatgtagaaatctatagttgaagatttttttaaaaaaactgcagcagccagagttcaccaaatatggccgtcctttcaacggaaggagataaatttaaattttaaaactaaatttgacatttattttagggtattgttattatactttattttacttattgtctttaaaagctaaggacatatttataaaagttttactaacataaccaatatatctatatcttctatatatagttacagcttctaaacatctaaaactcaacatacaaatatagtaattattagtatcttaaaacttaacatgcaagaataccacgccaacccaccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgagggaggagagagagagacatgaaggaagctcagagagagagaggccctgtttggcacagctccagagctcagccaaacagtttcagctccaccaaaactgggagtggagttgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttcctccagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtacatgattccgctaaacaggagggcgagtcagactaggggtggtagatctcgatgccctttctttctctttggttatttactgttgctttagatatatgtatatgcgtctaaataatgttgttgcctttttgatcccctttggcccttgagcatgtgtaccaaccaatagtggcattttttttaatgtttagtttgtccatctaatctatgtgccccatgaaggaaactgttttttttttaagaattgctccacctgaaaaagctgtccttttttctttgccatgggattcacttggtgtacaagcacatgaacacctttcagaggtcatttcacatgcatatgtatgggctagatatttcatatggcaagcagtagtgtgtcttttgatggtatgcactattgccagcagtgaagaatttcttagcaaaaattccttttcagtagatgatcccagcccatttcttctgccttaagtaatgcttgttatgtgcacattaagatttcagtcactacacagataggcaagttgaactaaagctattaggtgcaatatttcaactgaagtcaactaagacatgcaaccatatcgatcttgtttttggtagataaatctttaagcaagcagttgccactttgctgatatcgcatttcaagtcaaagccagagtttgcttgctgtgtagtttcattatcaatgaggactggttcatttgtttgtgcggaacaggggatccatatatctgacattaattaggttgctcttttgtttgaccatgggtatgctttaatttattcaactgttgtaatggttaaatgtttggtcattccctttatgttgtaagttcatcatgttgatagggatggagtacttcgatgctaggcggaagcctcataatgttgggaaagttattgcagctctggtcctcacaacactatgtatatttattttgaagcaatctcctggttttggtggcagtagtgtggtaagatgtctatatttctttttttctcttcttcttctttcatccttattcctttaaatctgcttttaagatcagcctttcctcacgttttcatgttttgatttgtaagtcactttctgctacctataggtttaacttttggacttttctcaacttactttctcttatgtttttcttgttacacaaaaagcaattttaattttgagtatcacctgtattatagaatatgtccttgtataactagcataaaacaaaatgatgactgctattgtagttgtttcaatacacatatcttcatttctgctctcagtgctaacaagcaggtgaggaaagtgacatctctccatccaattgcctttgttattgcaatgtctattacattagttcatgttccaacttgatatttcaatacacatatcttcattagttgtttgccacttctcgttgcggcaagttgatgcctaaatggcatcctaacaaactgtagctttcagccacgagaccttctgacagctaatcaatctgcataataattttgacatgttcctgttcaagaaaactacgatatgatttgcagatgtaaatatatcacatctctaaaactacaggctaactatccagttctttagaataaaatgttaagagactgttgcagagtgaaggtcaaacatagcacattacttttgttgtctagaaacatgtataagctgcgatgcagacctagtatgtgtatggctaaacttggatatgttccatctgttttgacttctgttgcttaatctttcaactcttcatgcaaatccgcctgttatgtttcttatgctgcaattattattatgccattcttatatttcccctatttttaattcaactgtataactgattgtggggttatgtatcttgcagttttctcgccatgaacctggtgttactcatgtcttagtaacaggaggagctggctatattgggtcacatgcttcattacgcctgttaaaggacaattatcgagttaccattgtggtaattaagttttcctttgtactgaatttctgaactggtttgttcttcaaatgccacccttgatggttaattgtgatttttaggacaatctttctagaggaaacatgggagcagtaaaggttctccaagagttgttcccccagccaggaagacttcagtttatctatgctgatcttggagatcaaaaaactgtatcctcattttgtacttctaaattacctcctcgtaatttttaaaatgttcaaatgccagtttttcacttaactggctcccaggtcaacaagatctttgccgaaaatgcgtttgatgctgttatgcactttgctgctgttgcctatgtgggtgagagtacattggaaccccttaggtaagtcattaccttattgacagtttgtcagttccatgagcttgggggacctcttattctactaacccctacagacgttaccattgtacacacccttgtctaatggcctaattgtagtgctaggggaaaaggtccttatgataaaaaacagttttcactattaatccatggtacttggtatgctacaatgttaactccataatcaagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatggcgtctcatggagtcaagacccttatttactctagtacatgtgccacctatggagaaccagagaagatgcctattgtagaaaccacacgtcaggtaattaatttatgatggcctcaaaactgcagtgtttggattgtgctgtgctatttcatcttgttgctggaaaggcaaactcaaggctgatgtgtaaatattatgtacctaattggttaataatttactctgttacagttaccaattaatccctatggaaaagctaagaaaatggcggaggacatcatactagatttcacgaaggggagaaaggacatggctgtgatgattttaaggtatgttgtttttccatggatataggcttgcaatttctgaacacaaaattggtatgtactaacatgtcaccttttgcattagatatttcaatgttattggatcagacccagagggaagactaggtgaagctcctagacctgaactacgagagcatggaaggatatccggggcatgctttgatgctgcgttaggaatcattccagggctgaaggtattttctcttatactttgactgtacagtacccctggtgtaaagcataatttagtgtattactaccatatatcagctttggatgttgataatagcaatatgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtacctcagcaggaggccaggggactatgctgaagtatacagtgacccaacaaagatcaacacggagctcaactggactgctcaatataccgacctcaaggagagcctgtcagtcgcttggagatggcaaaagtcacatccacgcggatatgggtcaaactaaatatagcttgctgatcaataattctgctgaatcgtcgatatattgatttttttagttagtggtataggatcttggtgcgataccgcttccacagtcactcatttgttatttttttctctttttattttcaaaggtttgttgttattttctagcaaaaccataagcagtgatcttgatatgctggaaatcctggaagccttcctgtaagggcaaatttcattgttttttgacacaaattgctgataaaaagaagtgtacattgtctcttaccattctgagatgcaagcttgtgaactgaactatagactacaaatatccctgtgttttgttatctatggaatgctcatcaccatttcgtgccaactgttgggtacacgtgtattgttaagcagtatcaaatcaggcgttgttcttgtgcagcctcacctgctacgcattttcaggcaaccggtttgacatgctcatgttgttttgtcagatcaggcatgcttaggttgtcattaacaaactttcagtaccaacttgatttcccatgaatgagcctgggggttgttttcaaattttgtttggtctacatttgacttctgtttgaaggtggcagcatggcagagttatactgttacaaatcatataatccctccgttttttaatagatgacgccgttgactttttctcacatgta

SEQ ID NO: 80308 - DNA, 3300 bp, Oryza sativa
atgtggaaaagcaaacctgggataatgccggcagatggcaacagctttgctgctgtgttgtaaaatcattcatcgatgagaatactggcacaacagaaagaaggcggggggtgtgcatcaacctccgcggtaggagtcatctctcctcgggcgtgtagataacgaagaagttgcacacgatggagaggaggacggcagggatggaggttgtccggtggcgtggagttgggcagtgggcgtccggctccggggcgtcgagggtgaagacaactaaacatggcgcacggcagggatgcgcacgatgaagacaggcgatgagtgcggcggaggaggcagcgaatgggaaagacctcgcctccggttcagtgcgcgacggcggcggaaggggacgacctcgtgggtagcggtgaactgtggcggcggcggtggatggggaagacctcgtctccggcggcagcggatggggacgacgtcggctccggccgcgactggggacggatggggaagacctcgcctccagcggcggcggatggggacgacgtcgactccagccgcggcggatggggaagctccggcggtggctggggaagacctcgcctctggttcagtgcgcggcggcggcggaaggggacgatgacgcgagaagggttcggcggcgtcgcaggattcgggtgacggcgatctcggcggcgtcgaatggggcgatgcgacgcgatggaacgacgacgcccctcacctcccctgctctgctcacgactcgcgagatggggatcggattcgattccgtcctgactggcgtggttctagggtttcgccggtggtggggggaggggaaaggatgggcggaggggcgcgagcagcggccagcgggacagcgacgacggcggtagggcgatgatggcggcggcgcctgatctggaggaatcggtggcaatggcgatttgtggcggcgtatgtggcagatcggctggtggcgaggttagggtttgggcgccgatgtggagcagctgtcagcagggggagggggatgcgggcgctgggggatggggaggaaggaggattaaggcgacgctaggacgacggatatcggcggcggcggcggttgatacggaggggatcgaggcagtggttgagaggaagacgggagagaggggaacgcttgcgcgtctgcgctctgcaggatcagagcgttgcggaagcgatatgagccattggattagacaatctgacaactcatattccgcatgtatgatagggttggagtaacggccacaactacagaattttaaaagtagtaaagaaaatgtcgatgtccttatatgtcctagccttctttctatccttcattcgatctagcgcatgtgtatgcgtctctcctccctcacgcgcgtgtgtatgcgatttttccttgaagatgccacatgtcctcccctcacgcgcgtgtgtatgcgtctctcctccctccccgtttttctcaacggtggttaagatctaaatcattattttgttattcattttaaataaaagttctatgggtagatcatagccgaatctcccagttacgggtgtcttcatgcaagcctacatgaatgcagagacatgggctaatatatttgtgatcgtctatgaacaactttttataagttgagttgtttgatgattagtctttttttttatatcatgacatttcaatcaattatttaaggtgcacatggactatgatttattgtcaaataaaaaaaatagtgtgagccctatacctgcacgttatacattttattacttcctccgcttttaatatattgacaccgtgaactttttttatatatatttgaccattcatctcattcaatcattttatacaaatatgaaaaaaatagttcatgtatatattaatcacatatattttgttttttaaaatgagactaacggtgaaacatatccatccaaaagtcaaaagtgtcatcccaggcccaccctcctctctcgtgctcgggtctagcccggtcatccaaatcctacatgacgtgaccctatcaaacgggcaaggcccaaatacatcaccttggcgtatgtggacaaataccaaattagggttaattatgcctccgtgtgacaagcttgccgttgcatcgaccagaaattacataagcccgacaggcatgcatgcacgaacttaaaaaatagtagctggattttatgatgagagagactaccccatggtataccgtcaaagcaacgggatacatcgtttatgaccctcacgttaaatcagtttccacgtagtcaagtacaaccatgcaagatgtcagttggtcattaaacaatcccgtcgggacgtgatcccgttgcctagattttctcttttatgattgataaacaacataaaaatattttaaaatcaaatcaaatatatgtgattaatactcctaaatattctctttacaagttaaagaaaattctaaaaaaaggcagacgtaatttaatttatatacggttatatatgtattgtcttttatagcgacttaagttttctccctttttttttatggaacttcaagaaccagctgccttaggtaccataatttgtgaacgtgatctgcagtaggtaattttataaatgacataattaaatttatcatgcaatgctaatggataaattcatgaagaaatcatacttttaaaatccaatagatattattctgttagtatactacccttacatcgcgcgggctatcttcctggttcatttttaaaaatctcaccaaagggatcagtatttcatttgaggtactgttcacctcgatttgcagttgggatttgctatctatcagtggacacgtttcttgcttcaaatcacatgattttcgaccttacgttaaaacaaaggaacggataggatttaaaacgcacaacgaacaaaaattgcacccataaaccttaatcatgtgaactaataaatttgactgggccagcccaattaaagtaaacaagctagtacaaatcagttacgtatcaaattacattgtaaatatgatgtaacaaagaaatgagaggctgcatcaattcacatgaaccgattctttgacctcgattacaattgcaagaaatttcataacattgtcatgttctttattcttgtaacctaagatcaatctcttattctcatatatgaatactgcaaaaaaatgatattaagttctaaattatcaaaataaataaaagcctaaaacacaaaaacatccatcgatacagtttccgaactctaatcatttgaaaatgacaactactccctccgtt

SEQ ID NO: 80309 - DNA, 7832 bp, Oryza sativa
taataaatataaatatttagatataactaaatcacacatgtaactaagttgtaagtgcaatataactacggtgtaactaatgctattttttctgtaagtgcatttaatataaatatataaaaaattatgcatcatgaaatgattatttgccattttcataactgtggcaatgaatctgaattttcagccgtaggaaacaaagcaatggacgagattaatgcaatataacacaaaagacaacaaacttgtacatattgatgggtcatccaaacttcaaaattaactgggtaaacaaatatttgtattgaactgaaacaaatcagaaatatgcttgttaacaccaattgtagtctattgaatttataccatcctatagtagtctgaagaatataattcagacaaacaatacattttcacataacatattgcttccaaaaaaactaatatgccattgaatttagaaaatgtaagaaatttcaaaatcagggttcccaatacacgctaaatggatccattagaacacattcacaacaaaaatatagaaaattacattatataaccaaagttttagatagagttgtaactaaaatgtaaatgcagtataattactataactacatttgaattgtggtgtaagtgaatttaaacctaaattcattactacccatacattagaaatatttgatagctatatacttcacaatgatcaaaaaaataggttggaggataatttgactaggaatacatgtgatttttgaacataagcagaattttgttgctacttgaaaacataatctatttgatagttaaatattaacagtaataaaaatagggtggattatagtttgaccacagaaacatgtgacattatactttacttaaactcacaattaaatcatagtagcgaaaccgtagtctggtcattgggatagaaaagcagatattgagatccttcagtcctttttttttctttttggcagaacacacttaaagatcaaactattccacctgttaccaattatgtactttgtatgtatgtacacattaacaagatatattgatatgtacaagaagtccaaaggacagacaatcaatcacaacaaatttttcaagacctgcattgcaggtgaactattttgtccttcactatgctattatttattgtttcacaaagagaccctctatagttacaaacattattaatagttaaactttagaaaggctgatatatcatattctaggatgttaataaaaaaggaacggatgtagtactttaaataatgggcaaaattggaatgacaattgaaaaaagggaactactacacaattcatttctttcgcaaatgctttagtgctctacacaataaatttcttcttcacaattgtccatgctttactctggctgggatagtggtgcccattcctaaccagttcttacaggaaatagtcccatataaattgttgattgttttattcagacaagtttgtaggtacaacaaggtggcattcaatcatgtttgggtgttagatacttcatacgtattgcggcgtgagtgctaacagaatattacttgaatacaagccaggaagaacacagcttcaggtagaaaagcattgcagcttcattcgtccttccatttgttgcacaccaatagttgcctttctatatttttgtatacctctcatttgctcatttcatttcctttgccttcttatgttgtgcagatagtcaactaaagagtataaactactgcaatcaccttttttcaggaacataactttcatcaaagttattctctcctaggcctaattcagttaggactgacaatttgccaacccatactgtaaaatggtccataaaaagcatttgttgatatagtattttgagcaagtgttgaaagataaggtaatttccctgacaaactgtttgttgacagattaagaacctgcagatttgtgcagttggctagcactatggatgcaagttagaactatagatccagacattcgtcttgcttgtggttaaaaatatgtcgcatagaatctgagatgaatcatacgtaattgttagtaagactgttcatgaaacaagccatcaagcaagaccattttatgtagcatttttaccatcaaattagcatttttgcactatcactgcagcggatttggatttggtaaagaggcatgaagccttgcgagatacaggtgaggagaagacggggttctaacctactttctagtgatgatggaaatactattaaattttattagtagagaagagacagatatatgaatatgaatatggatatggatacagagtatgaagactttgcgtcaatagattcatattgtaaagcagttttgtatactatatggcagattataaacattatatattgtaaggaaatccatgaaaaaaatgttcagtttggtagatcgcaccatgtcaaaagataacattttacattactcttctcttctattttagtttcgttttcatgcgtgctcacactaacaaaaaaaaaaagagatatttttgggacacgcctcttgttttttttgcaggcagagagtaagaacgtccgtatgtaaaaaatagtgtgaaggtgcctagttttttagataatggaatttatatcccggcctttactcaacagagctacagccaattattacaaagtaccactcatacaaagagtgtgaaggtgcctagtagagacccacttatgaaaatccatttttgtaggtggtcctcttaacatgtctgtttgtgaaaataggattattttcagaggcgggcctgttaaaaggtccccatgtaaaaatcctttcacagccccacttcctctccttttattaactcttctctcctttctgtctcctctaccttttctccctctgtccctcgacttctccttctccacctccgcctcctccctcatcccctctcttcttctcttgacggttgtcgttgcgacgggagtagacaaaggggcggcgttgaaatgggagcagcctgccaacagggtgacgccgcgataggagcaaccgacaggcgatgtcactataggggatcaactgcctccggccccacatcgcgccatgccttggctcctctgatctcgcgtcgcgctgcgcctcgactccttctccaatctcatgtcgtgctacacctcggctttttcttcagcaacaacggcgaactcgcgacagctggatccggtggacggccaaatcctatgacggtgaccccgagacgagcaaatccatcagcgactgcgcacagatcgtcgacaacatcccccaccacggtggcagcgggtcttggccacagcagatccattggagttgaggcgcagccaggggcgacgccacgttcagcttgccaagtgcacaggcaccagggaaaaatttagtttttagttattagcatctaatctccaccttttgtgcactccccagaaaaaaatatgtgcaccaccttcagctgcccagcaggctgcaggcagcccatgaaggcccaatttcttacgtgcagcccaaactgtccaagtgcccaacagctacagcccatgcgtaaatgaagtgtgcattctggtccttcgtgctctagattcgcccccgcgcagcgggcttcgggcagtggtgttggaggtgcggcgtgcttcgggcgacatcaaggagctcagggacaacagatccaccggcaacaacaatagaagcggcggatccgctgcctgcgggctgtcgggctccattcgatggtttgcatgttcttgatatgtatgggctagggtttcaagatttttttttcttttttattcagaaaaaatatttacaagcgggtaccatatcatgagaatctgcttttgcgggcagccctcctagagaagctgtttgcgaaaatggtttttacgcgtggctgtgacgcccgtatgagaaaaccgtgatttttatagctagacaactttggccagacgggtagagcacccgtttgcaaaaacgacttttgaccgtttgcaaaaatcaattctgattgtcacttcttttctattcatttgccgtgtttactcgtcaagctttttctagtgaaaaggcgtctatcatagttactagttcaaggatacagattttttttttggaatgcgcacttgattatggaaaatcttaactaattaaaatattcgtaattttccttttgtcacctctctttttcatccgtgttttcatctgtacatcatatcaaccgatttggttagcaatagcgatggaaaaactgcaaaagaaaaaagaaaaagagaaaccatcagcggtcaccgacgccaccaccgccgccggagggagaagagaggcggcggagggagccgctgctgccggatccgcccgcggtcaccaccaccgctgacggatccacccgcgaacgccaccgccgccatcggagggagaagagaggtggcagagggagccgccgctaccggatccgcccgcggtcgccgccaccgccgccgctcgcggggaggggggagagggcacagccgcagccgctcgttgggaaggggaggggggggagggcgccgccgccgctcgcggggtgcaggcaccttgtcgccgtcgctctgccagaaatcgccgccgccatcgccattttagcctaaggggatcgggagagaaaaaaaactaaaactagggttagggtttggtacaagccgttttgacgaattcggaaccgatctgagccgttcatcaaaatgagcgactcggatcaatcccgcatcgagccggcctccatctttgggctgcagcactattgggccgcgcgcagcccatgaagcactagcagcgtccgattgaattgttggaccacattcggtatggttagtctttttttttaaagcaacaagtccactttgcctctctcaaatatatctcctatctaattcatagggaaaaactaaaaataaaaattacccaacaacatacaattacccaacaagagaaagttagtcttttttttaattgctacaaaaccttagttgatgttaaatctggtaaacaagaaatatattgttttcaacatgttgtttattggcagatttatatcaagaataccatattctaaaaggacccatatcacaaattaaattctaaaaatatttattgtgattttagttaaaattattccgttgcaacgcactattgaataataatttattacgagctactatatatttctctctatcatttgtgactttttctagcgagcaaaagtaccaaagcagtgtgaaaataacttcggttaaaaacaaatatttttagttttaatacaccgtagcgaagcacgggtattttgctagtaattataaagtgtctcctagatacactgtagggttacgatcgaaggacaacgttactagagtgtttataagagcgagctatcaaatgagttgccgcattcaggacagtataaacgtcattaaacaaacagcagagaaacccaccgccatgactcgttcaaggatacatttgtttacgaggatatgctttattccattatcttaaaaaaaaagctctatttcttaaagatttgaacctttgtatttcttttaacaaacgaatgtgtagtctaaatttatttattattacctacggagactcttgtactttttttttcaaacaaagagcaaaaatttgccactctaaccctcacttccaaagtgcgaacggtacactgtgtgatgaggacacaactagctcggatataaccgtgagtaccttatgtattaatcaactaaaggtgcatatgttttatattagatttacttgttatatatttggaaaaacgttgctacacaatgagttttgtgtgttttcgtttgcagagttacttgcttgggcgaaagaaaagagaccgaacgtaaggaatgcgtggatgattgaagaagttgattggtgacaaaaccaagaccttttccaagtcttctttcatctcaccacgtcacttttggtccatagaagacaagagataaagtttcgcatgctttggattcggactcgggcttcctgacagcatcaacttcaaacggacttagccgctgatctagaaggaattttggggcccataagtacttgttggaaagcttatgaagtctactttccgatggttttggtcccatgtcaaaattcttactgagctgccaggaatctgcaaaacaaatcatgtacctcatccagtcctaatctgatttgggttttgggccttataattgtgtcgtgggctttagtcccagggggtgcgcgtcctaggctaaccctaggacgtccctaatcatatttattcagtagccgtcatcggttagagtcgggtttttcttagattattatgttaagaacagtttcgtcgctagatcggtttgtagaatcccaaattcgtgtgcttaatcatttatacgcaatttggttgcaatctatcttgttcttgcttgtgttcttcgattcgcatgcagggattagccttcttggcgaggtcaatcaggtttcggcatggttgataaccagaggagacgtggtgctgcgattgcggaactcagtagcgtgttcgttcagaagccagatcgagttgtgtcgccactccgcccaaatcgactgtttgtcaatacctatcggatgatcaggacctaacatcccctcatcagttggtatcagagcgcggttgcccgttaggtaatttatcttccaataaccagaaaattgccacacaaaaatatttattctttacctaaacaatttgagccgttgtgttgttctattagattttgctttgttgaattctagattgcatcgtcgtgtcgagtgctagtttagttttagatttaatttttagatttgagtattgtatctgttcatcacttaggtctaggtctagggttcatcactcaagtcggtgtgagttgtacgtcagttttggtcgagtttttcatctcgtcggttgttgccgggaccttgaaaagttgaatcgtctcgttgtcgggtttccgtttttgtagtttggagatgtttttgtcaagcggttttggagttgctcggttgctaggggtccggttaccgtgcttgtgtatgtcggtgtgcagtaccatgcgcaggtagaaaagagaaagaggaggttttcttttggttgggaatagcagatcggtttatgttggttgaggataaattatctaaattttcatgtgggaccaataggaaaccaagccgagtcacacagtggccaatccctctcatcctcacgttattttccccacataaaggcggacctctgttacatcttggagaatttttttttatgtcggatttgagatatttttgtaaaaaagaaaatgacatgagcaatccatttttgaggtgatccaattttagttttgtactttgctgagtcccaataattttcatatttacatttgagtccctgttcgaggtcagtggttagttactgttgaaaaaaaaaataataataaaagaaaaggcagaaggtgcaaagaaaaaggaagaaaaagccgcaccaagaaaaaaaaaaggcagaaaggtgctaaaaaaggcagcaccaagaaaaaaaaaagaaaaatcattcatcctttgagtatgttttgagagtgcagagttgtgcattgattcatatctagtccttagtattgtcgggtgcttgcttgagctagagttgggtctaggctaggccagcacattgactagtactttgaactattattgaactttgtattttctgattagcacaattgcgctcctttgctactatatattgtgcctcccaagctctacat

SEQ ID NO: 80310 - DNA, 10254 bp, Oryza sativa
tttctttagtcctggttgttgttacgaactttacacccggatgttctcaccaaccgggactaaaaatctgggggtatatatattcccggtgctccctcgtcttctccaccaacacttagacgtttttccatcgagatcgatctcggcttctccttcgccaccactgcctagggcaaccccgcgccgacgccgccgtcgtctctcgccgtcgcttggcggtcctcgccgcctccgccacagacgccgccgccacatctcttgggtgagagccgccgctgcctctctctctctctcgatctcgatctctctctccaaacctccgccgcctagctcgttgccgacgccactactacgccgcggtcaaacgccaccgccgacgaccgactttgacgccgccgcccccgcctcgagctcgccacgccgccgcgccacgccgccgggctgctacgccatgccgccgcgacgccacgccgccgccgggcccccacgctaccgccgcggcacgccgccgccgggccggcccacggcaccccgacgccgccgccgcgccgccacgccactgccgcgcgcgcccaacattgccgaacgtgattgaaacgtgaccgaacgcgaacgaatgtgaacgatacgtggacgactgtgaacgaacgcttaacgaacgtgaacgaatgcaaacgaacgtgaacgaaacgttaacgaacgcgaacgagcgtgaacgaaatgcttacgaacgtgaacgaaacgcttatgaacgaacgtgaataaaacgcttacgaacgtgaatgaaacgcttacgaacgcgaatgagcgtgaacgaaacgcttacgaaacgcgaacgaacgtgaacgaaacgcttacgaacgtgaatgcacttgtactaaaagtgtgagaacgaacgcgtttagactaatacattttcctggtaatacatatatgattatatatatgtaacttggcccgtttagactaatacattttcctggtaatgttgcagagaagacgttgtcatcgtccgtcaagccgaagtggtagctagccatcgaaggaattcgcgcaggcaagtgatgcaaagaagtgattgttagagatttaatataagattgttagacttagcatatatgattattacaattttaatataagatttgtagcgatttaatataagtttgttagacttagcatatttgattattacatttttaatataagattagtagcgatttaatataagattgttagagatttaatataagattgttagacttagcatatatatatgattattacaattttaatataagattagtagcgatttaatatgagattagtagagatttaatataagattagtagcgatttaatataagattgttatacttagcatatatatatatatgattattacaattttaatataagattattagagatttaatataagattgttagactaagcatatatatatgattattacaattttaatataagattattagagatttaatataagattagtagagttttaatattacggttagcaaatatgacctatagatctaacaaatattttttgtatgcacacatggctgatcgcgatgaggaacagatactatacgatacaaacgcagagggaagcagccagtactggaacgaagaagaggggaacgaggatccaaaccagtacttgaacgaggaggggaacgtggagagcgatgcggaggggaacgaggagggaaacgatgaggaggagtctactggaagtcatccctctgctggacagaagagggcacacggacaacgaggtgccgcaaagaagatagagggtcggcacatcgtaactgaggtggacgaagacggccgacctagtgccctagcagaagcagccaagaattttgtacaccacagcagttgggttgtgagggacaacgtgcctgtcagcacggtgtactggcgcagaacaagggcacgcagggataatgacagctttgtcccggactcagaaaaagagatgctgtggaccacaatgctcgagacgttcacgctacccgcaggtacgaagaacatagtgaaacagtggactctgaagaaaatagcagaacagttccagagcttcaagggagatctctacaagaaatacatcttgaagggactaacaccgaacttcgacgtattccaaaagctaagggatcattgggacgagttcgttgcttacaagacagggcaacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccgctaaatggccggatcgatcgaagttctggtactatgctcacggtggaacgcttaagccagttgatggctcccttgtcttcagtgatcagatacgcgacgctgccagtcgactaacggacgcggtggaagcctcttctcagggcacattccgacccgacagagagaaggaagagctgtcactcgccctacagattcccgagcatccaggacgaacacgagggaaaggcgtgattccgtggaagattggatttaaggaggacatccacacgtataggagtcggatgaggagcaagagagataccgaggcgaagattgcagatcttgagtacagggtatcgagctacgagctcagcatgcaagagaagatggcaaggaaggtggatgaacgtatggccgcacatcggtcccaggatcccagtaggacattcctctagcgatggtcagcccatcaggcaatagtagcagctgcgcctcaacggggtaggtaggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccacaagttgctgcttaggttgattactaatagataacctctcatcacatgaaggtggcgtcgggaatggccatcccaacggacccttccgggacttaccactgcaggccgattccagcaggatactcgagggtcgaagttgagctggtagaagccgcgtacaaggacctcgagttggactacccaggaggagacggtgagacgcatctacgagacacaagacacgccattatactatggtgcaagcggtacatcatcctccctgggcgacaagcggcatctcatgcaccatctcctctggctccgccatctcctcctgcaccatctcctccggttcctccgccacgtcctcctgcaccatctcctccggctcctctgcctcctccgcctcctccacctccaccgtgtctgcctgcaccacccaagacaaggtctcgccaagctccaccgcctgcccgcacaagggcaacgaagaaggcgaaagttgatgccaccaaaaacaaggagccaccgtacgattgtagtcaagaggagcttgatgcttatgtggcaggagaagtgaagaggcaacttgagcctcggagtcctgaaaagaagatacctattgacccgagcgtgaagaactacttcaagggaatgtccgcaacaaacaaggaggccttatagatatcggactatgactgaacacttcagagagcctatcacaagaagtctaaaccagtccctcagcttggagaacaaccaaaccaagaggtcgagccgttggtgaccggcgaagattttggcataacggaattcatttcagacaccggtctaactgtggatcagctgattcgaggcgcaccaatcctgaaggcggaagtggcatacaagtttgaactcggtaaaccgcttgtcaagcctgagcagctgcagtccctaccgacatagatgtacaaattccatgaatggtacatggaaatgagcgccaagggtagagagatgttcggagcgaggatcagaaaccccgacttcttgcaaggagaagatattctctggatccatttcaaggatctcttcgatctgtaccatctggacgccctcgacgtctctcttctgagcgcatggattttgtgagtatctttgagttcgatttgtttcgttcaataattagctcctggcatatatataagcaataataatttcctttcatcgttgtagaatggagattcaaagggcccgacggcggagggtctacgatactgggttcatcgaccctcggaaaatcaacaccaaaatgatcgacaagtaagagaaagacacagaggacaatctcgtccatctcctaacatagcagcatttcaagacgtacatactactgccgtacaacacagagtgagtttttattgtcgttcgaacaaatttcgttcccatacatatagcatgtacattttcatatatatctcatctcatgcatattccagattccactgggtcctgtcattcttcgacttggacgcatgcaaagtcactgtgtacaactcaatgaataaagaggagaagatttttgacaaggtcttccaactgatagacaggtaatataatgccatctattccaaagtcgcggggaatctattgctattatgttgatctcgggtaataattaattaatcatagcttgcaactgcatatgtagggcttgggatcggttccgtcagttggtccgcgggacttagaaagaaaaacttggaaggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactacgtatgcgagtatgcgagtatgcccactgcctatcaaaccaaatatgcacaacacgagagctcgatgtacgtatacataaaccattcaaaatttcattgcgtatcgatttgttaagttgtttattaatttcatatattgatacgtcattattttttcgaatgatagcatattcacatgagggataatctcccacacaaggtttttatcatggctgttcaagaacaactgatgggattcatcaacgaagaagtccttaattccgatggtgaattctactacgacggatcgacaattcataacgtcggtccttcctcttctgacataacgccggcgtcgaagtggtagctatagctactgagcaaatgaattgtactatatatgcatgtatatatatatttatatatgtacacatttactttagtgttaatatatattttggtaacatatatgcacataaaatgttaagtgctttaaattatacatatgtgtgtaatatatgatttatacatatacacatatgcatatatatacatatatatatatatataatcaaccatgcagcaaacagggccatgcaaataaaaaaagtggtgcaccgatctttagtcccggttggtaacacaaccgggactaaagatggttcggccgaccacgtggctgaccgatctttagtcccagttggtaacacgaaccgggactaaagatcgatctttagtcccagttatttcacccgggactaaagatagctatctttagtcccggattcgtagtcccggtttgacaaccgggactacaaacggtttctccaccagtgccatcgtgagccactctgacggtctaaggccatctacaatgggtacccctaggtcgtgtccctagcaccctccatcaatttttccgtctgcgtcgttccctcgctagtccgcgcacaccctagctaggggtcgcgcctctcgcagctttttagccagggacgaagacgagcaacgcattgcagcgaccggttcctatggccaccgtgtctccagcgatagattccccttccacccctctcctctctctctttctctctctcgcccgttcccctctcttgggccctccgccgccacagcaaccgcccgagcagtggcgaggagcgggaggaggcgacggcaagagcggcggcgaggagcgggagtaggcggcggaggtcgagctcggcgtcgtcgacgggctaaggagcaacggaggaggcggaggatggcggaggtcaagctcggcgccgtcgacgggcttgaggtgcccgtgctcgcggccgagcagcacgaggacgacgtcgtggtggtggtcgtcacgctcggggatggcggcgacgagatccggccaccgcgcgccttgcccggcctcctccaccggtgccgtgctcgccaccgccgtccgccacctcgcactcgcagtccgccgcctcacgctcgccgtccgtcgcctcgagctcgcctcgcgctcgccgtccaccgcctcaatgcggcgcggccggcggcgctccatccaccggggggccagatccggccacggcagcgccggatctgccgcctccggggtcgccgccaccaccatcacgggagagagagagggagagagcggcgggagagagagtggcgacggcactctcacgtgcgtgcgatggagaaagagagagagagaaggggaagagaggggtagaataggaaagagaggaataggagagaaagaggcttttttgggttggggctacccagagtcctagacgtggcctgcattgtaaaggtgagtacgcctagagtacctcagttagtgagggtactctaggagtgtctcagattgtggatgccctaaccagtaaaatactccttgtttcttctttcttcctgccttggtgagtgccttcggccgtagagcaaagagcgagctctgttctttcttttttttccctcatatctctctccctacgtcatttttttcttaactactactcactcttctcttttcttctgcagttctactgctgctagcgagctctccttgaactcactggttggagggaagctatttccgatcgagctcgtcggttgtcgggggtgagatatgtgttctggtgaggaaaaggaggccagcttctttattttgtgcttggggtgagcgcggtcgccttctttgagcgtggagcatgtgaggatcatgtagcggtgccgtccaaaggctaagtatgcaggtgtttgcccccattcagtgttgtcagctccgacagtgtccatctccggcaagcaaacaggagccgataaactgatcgacttttgaatgtgttctcatgtctctacatgtgttctccatgccggtcagggtttcatgccctgccgctgctgcgcgaaccccgctttaccgttgtctttgctgccgtcagtgtcgccttttgttgttgaaattataagcacataatgatttaatttattccataaataaatcatgacattgcagatgtaaactagattgaacgcatcattagatctacacatgtaaactaagcagtaaaacatgaacagatcaaatatgcgcaacatgttgaacacgtaccgaggtggcggaaagacaggttgcacggcaggaactactcgcggttgcgagcgtcgacgaaggcgcgaagcacacgagcggagaggaaggcgagccgtcgcggacgaacagggagcagtcgcgcgaagcgcttccaaaaaacctcattgccgccttctcccggtgcaggacgtcgaaggcagaggttccgaaaacctgctctcccgatcgccggtgcacgccggcgagcgggatggagtagtctatgagcgacggcgcagtatagagtaggaggcaaaccctagattgattttgcgtgtgttgcgtgaaggcggcggctcggtttatatagagataggtcgcttgatcagggcgcccgcacgatctccactccgcgtaaccgaaccggataagtcgcgcgtaacttatccggactccacgccgttttcacgcaccggattttttggaatgtttccaaaacaaaacaaatctgaatttcccgcagcaaaacaaaactgcaaaagcttatccggactccactccattttcacgcaccggatttttcggaatgtttccaaaacaaaacaaatccgaatttcccgcagcaaaacaaaactgcaaaaggaggttgcatttgcgcaagggtgaggagacaattttgtggaccatttgacgcgtacgtcgtgcacgcgcgtcgcctgtcctgccaggccaggcgaggcgaggcgaggcgaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgatttttcaaagaattaatcttcgaatgggccttagcccatatattaattccaacaatcccccaccaaatctcaaaatcccactaagatttgcctttttccaatgtacagttaatataccagcggttcgatggagaccgattaaggttgaacatccacctagaactccaagctacacttactcacaacttgaacaatggaatacgtcttgaattgcaagtcttgtgcaagaaagtttcactcagagtcttatctggtactagaccgtctgtagactacccctcgggtggagcgtataagtcatactcctaggtctttagtaagctttctagaagattcacccaaaatctccatagactgcgaccaacagtcaagcttacaaatgtgagttctttcaagaatgctctacaggacagcatcttcgctaattaaagccaacagaactcattaaggcatagccaacctgccttgcagctcacgagagtacatgcatcttcatttagagagggtatagatcggtactctcctctagtttactaatggtttgttcttcccaggttctaattcataggatctccgatcacatagactgggataccaccatagtataactcacatgtgtctcaaacccatctccttcgatgcattatctatcacatttcgtgatagtcccttcgtgaagggatctgcaggtttctagctgtttggatgtaatccaacgttataactccagagtttcttaatttcctgacagacttcaatcatcttttcacatgtctagacgatttcatattatccttaaaactattcacttttacaattaccgtttgattgtcacagttcataaggatagccggcaccggtttttcaacaataggcagatccattaatagatcatgcagccattctgcctcaacagtagcagtatccagtgccgtcagttctgcttccatggttgacatcgtcaaaatggtctgtttgcaagacctccacgaaacagcaccaccacccagtgtgaagacatatccactagtggctttgatctcatccacatcagagatccagtcagaatcattataaccctccagtaccgcaggatacccagtatagtgaagccccaattccatagtacctttcagatagcgcattactcgctcaagcgcacgccagtgatcatctcctggattagaggtaaacggtcaacttgctcacaacaaaggagataacatgcctagttgcactagccaggtacatcagcgagccaatgatttgggagtattccagttgattcctagcaatttttttgttcttacgaagcaacaagctaggatcataaggtgttggagaaggcttactatcaatatagccaaagcgattcaagatcttctccacataatgggactgcaagagtgtaatcccattctcacctctaattagcttaatgtttaagataacatcagctactcccaaatccttcatatcaaaattttgagacaagaatggtttaacctcatttatcacctcaaggtttgtcccaaatatcagtatgtcgtcaacatacaagcatagaataactccctcacccccaccatggcaatagtacacacatttatctgcctcattgactgcaaagcctgcagatgtcaatgttttgtcaaatttctcatgccattgcttaggagcttgtttcaaaccatacaaagacttcaacaatttgcacactttgccttcttgaccttcaactacaaacccatcaggttgatccatatagatctcctcatccagctctccattaagaaaagctgtcttaacgtccatttgatgaacaagaagaccatgtgaggttgctagggaaagtagcacacgaattgtggtcaatctagcaacagg

SEQ ID NO: 80311 - DNA, 1754 bp, Oryza sativa
tatgtccaatgtagataatgatataaaggcaatcggttgatgatgataagtaataatatagcaatataatccagtataaaccaatcggctagcaatatgatatagtagaacaagtattgattcgaaggttaaagcacacatcggctggaggtccgatgtcatgaaatcaacaagattagattaaacagtgaaacctttgttgtcatcggctaaatccaacttatatgtatttataatccttatgagtcgatcaacgtccagataactcaccggttgaaaccccgataaaacccttattggtaatcaagaagcaggctagagattatggttctaagcactacttagtagatcaaacttaactgatgcagcactaagtatgaaaagaaatataatatctagaaaatcaagccgttgacttagttttcagggtggtagatgtctaagctaatctaatctagcaatacgatttagccgatactggcagaaaccctaaaacgagaagcaaccaatagagctaaattgatatgctaagactagattaacagagacatatgataaataggtagacaaatatatcatccaaaccggagcaatccaagaggtcgaatgtactgatgcagccttgaacgacgccgacgtaaacgatacaatcgactgggccgacggaacgtagcacttaccccttcgccggagatcgaaagccgatgcagccccgcgtcaggttccaggttctgtcggatgataagtaaaaacctcggtaaagagggtggcgatgcaccgagagtagttgtattcatcgatagattgatagattataatgacctcgggtgtacatatttatacccacagggagatactagtccttgtcggacaagaaagaaactttcctaaagataaaaggaaaagataaagtccttacaggacactaaacacactttcctaaagataaaagaaaactaacaaactattcctaattaatagataacttgccgtgccgtatccttcttgaactcggactcttctggataaattccctttagttgatccgactccattgaggacacggttgctggcgatttaacgactcccatcggctgattctataactctgaagccgatactgactctaagccgatgatgactttagtcttatcaaatttcgtcgttaacagtatgtactctcctttttcttccgcagggccagcggaaggatgacaccggccgaaggcagaaagaaagagagtacgaagaggggtacatgacaacatgacggccagagcttgacagtacaaaagaagaacaagtccgcaggttggttttggagctcgcatcatcgaatcgtagtacaatattgcagcaaagctttcaggtacgaattaaatggtcatcccacgtgtttttacttgaaattgatgtacaatcaagtaaggtcctgtttagttctaaagtttttttccaaacttccaacttttcatcacatcagacctttcatacacaccaaacttttctatcacatcataccaatttcaaccaaagttccaaacttcagtgtgaactaaacacaatgctaacagaatctgcataactgacattacacagtgcattaatttcagcttcatgtcaatatcaaaagcgattttttgtaggcaccctgtaccgcacatcacaacaggcatagtacgtaatggcacccacttgtaccggttttgctaattggcgcgcgcacgccaaatccgtatctggcgcgcgtgccc

SEQ ID NO: 80312 - DNA, 4772 bp, Oryza sativa
tttttggcgcgattttttccctattgggctccctcccctcggtgtatttttcatctttttggtatactttttgattttttttaaatttgaaagttttaaaatctgagttgaaagttttcaaatctcgagttgaaagttttcaattctcgagttgaaagttttcaaatttgagttgaaagtttttaaatctcgagttgaaagttttcaaaaattttcttgcaaattgaaaattttcaaagtctgagttgaaagttttcaaaatttgagatcaaagtttaaattttaagtcaaaagttttcaaatgtaactcaaattttttcaatctattagtaaaaaagttatcctaagaaaataaaaaatctattcttaattacagtcattatccttgactaacagagttagttatggtaccgcgtccttccaagaacgtgctccgcgtgcgcgctagttctgctcgcggcgcgtacgcgcgtactaggaacgccccgcttgtataggaacgccccgcttgtacagtacatcagggtaggcgtaagggaccatatgtggaaaccaattttcacatgtaacatatgaaaatgcccccatttacacagtcttaagtgatctccttacgaaatgtttgatttttcaaagcagtcgcttaagatatatagccgcttatgaaaatgatgatatttatgtaatcaagcatattaaactgaccgccttagagaatgtgtttatcgagatggcgctcttaactgtctgtatatgtcctgtcttttcatctacttcgcgaccttcaacaatcatgcctaatcagtgtgtgcttatgcatcatcactgcatttcttggtttcaaagcccaagaaaccaggaagaatctcaagagaaaactaaactaattaaacaagaaactgattaacttgtcatcagacagacagagcgctgctcgctgaaattaaatcaatagtattaagagggggacagtggcagaggccgtatctaccccgggacggcctgcgtcgggaaaggagcacctcctcctcctcatcggcgtcgagcagtcgcccggacagcgaccggaccagaccggaccagggcgccgcggaggcagcaagggaagggaggagagagagggcgcgccgccgtgcgcgccttgccggctggccaccgccgctcactgcagcaggggagggaggagagagaggggatagtggatttaggaagagagagtagagagagattgagaggatagaggggaaagagaggagagtcttataggtggggcccacactactttttttaaaaaaattttgctgactgtactcacgtagaactgaaactaccccgaattaagccggaggttatttgtccgattgtatagttaagggtgtaaaatatccggtattcgagtttagggagttaattcaatcgcccatgatagttcaagggtgtaattcgtaccttttcctagcaaaacacacaacgtttaaccatttgaaaagcgtacgtgcggaacacgatggagaggagttggaaccaaggatttaaatctccggctatagctgccgctattgccggagatagccgctgggagaagcaaccactaagatatgtccaatttggcgctacacattctatggcgctattagctgctcttagctggctatagctgctaaatgggcccttaaatagcggcagctaacttggtgggctgagagcctaaaactaaacaatggggcatatagaaacaattcaaccctaactctatcactctttcacagtcactctgtcgctcaccctctcccctcgaaaaacaggcacagcggctgtgcctggaggcgacggcggcggctgcaacctgcagcagcgacggcgatgaaaacagcagcggctgtgacctgcagctccacatggaggccgcaacggtggcgcccggaggcggcggctgtgcgtatgccagcaccaagcatctgcggcggctgtgatgggtggtagctgcaccaatccctccctccccactcttctctattctccctcaagctgctacggaggcagttgtgccgaagacagtgagggctgctgggcagcacaaatcctctccctattttcgctagtttttctttttcctaacaagagacgtgcaagatttttttgctatgattctctgatattgaatgtggtattgaactattcaatgtaatatcaagtgtcttggctctttaaactgtacaagaattgcaaaatttatgttagtttttgtaaaaccgctaatgagcttagctgcagcaatagccagctatagctggttgttgacagttcgatcagtttcgaccgtcaatattactaaaataggggagaactagtgatgcttgcaatgcataaatatgttagaataataatattccactagtattaggtatacttaccttttgcagagaatgacaataaagtggaggagaatcaacatcaactcagatgataaatcaatcggatgatgtcgagaaccagacttatgtatgaatgggccaagaactcagaaataacacgacacattgggccaaaattcacaagtctacggaggaggacaacaaaggaggccgccagccgaagatgggttggggccgaacccaccgcagctccgtttgatccagggttctcctggacggctgagattgctccccaatgacggttggagggtattaccgactattccaaccgttacaaccgtcattgggaggctataaaaggagcaatcatcctcacttcactcacacacctcaagcaatagctctctcatttatctcaagtttagtttagtagtatctagctggtggaataggaacatagtagaaatcaggagtccggaagccttcggaagagtttgggtatggctctagtagcttttctcttctcttttgtaagccaagccttgtacttttagtagaatactcttctaaatacatttatggtattgaaatacattccgagtatatgagtacctactttacattatgttcatcttatactgaatatacggctagcttatctgggagatgctttggtgcgggtataatgtttgcctatgcaattactctatgtcatgacgatgatattagagtagtatctggtagtttagacgtggtgtctagattacgggatatcattatttggggttatatattgcgaatgagaggtgggctgctgatagtgacagctcagtacgggtattcctccgcgccggtatataatcctaagttaattccctagggaggatactcctccgtatttagccccggttgtatggtcatgacgggctgtcgtaaggaactcggcagtcaggagtggcttctcgaagtaccaggagggcatcggatagagggtattagttagtatatcggttaactagaatgtatgtatactatgtatattagaaatataggaatagattttcttttcttttctttccacttagcttaggtgatatattatgagaatgagtagttaatgcttgtgtgtcactctacccttggattatcttaacccctgcttagaatatgattatcacaagtaatatataaattattagtcaagttctctctacatgatctttccacgggataaaataaatacgatacccttggaatactctcgggtgaaacactacaatggtatatctgtgggcttgcggatgaactctgtaaccataatatatcagaagtacttttgcgccattgctgggaattatatttctagtaatgtcgttaagaaatacgaacaagcatttctggcgccgttgccggaggagattcataatagagactacttgaactaatattttatatttgcctctgtataatcattttcctttgcaggctaaccttggttgttttcacttttgttgtgaaaacagggtagtgcatgactggtttcaacttgccgaaaaacttcaaagaaaatccagaagctttctttcggagcattaggccgtgagtcgctgctccgcagaaaactctaccgatagataaaccagccgtaccaacgccgccgaccttcaagactatggctaataagactctccgcgagttcgctgctccctctgctgacaatgtggccattgggccgcaggtcaacataggggacgtggatttcgacttgaagtccagcctcatcacgattgcgcaggcaaacccgttctgtggtgagcctaatgaggggtccaatgctgatctgcaacagttcctggagatctgtagcacgtacaacatcaagggcgtcaatcccgacaccgtcaggctgcgactgtttccgttctcccttctcgggagagcgaagcagtggttctatgtgatgaggacatcaacaccaacgatacatccacacttccacaattacaacttcatggtcctattacccacgctcgtgcatgtcaactcaactatcaggaacaatggagaggatcaaacggggagaggattcgcgcgggatggattcggactacagcatagcacaaacttctgacggccgccacgacttcctgcgaactccgatttgggcttgtaagtacttcatggaaagctgtcaagtctactttcaaatgaatccagcctcatgtccatatcagttctgggcagccacaatcttcattttactccgagtccttttctgtccacggtgccgcgtcacctctttgggcccaatgggcagtgtattaagttgggtccattagggacacgtcgtagggtgagacaacgaccccagcactcctgtggtcgtcctcttcctct

SEQ ID NO: 80313 - DNA, 15357 bp, Oryza sativa
cacgccgtgctagatcgtccgactcgatgttgttcttgtgatatacgtgtcggacctcgatcccatcaaatcttttttccagcttcctgacttctgcgagatacttagacaactcaggctagagcatttgtaatctttgtgcacctggtttgcgactagttcggaatccccttttacgattagtcgcttgaccccaagtgcggctgcagctcttatcccaacgagtagcccttcgtactcggctgtgttgttggtcgccctaaagttaaggtgaattgcatgcttgaactgatctcccgaaggtgatgtcaagatgaaccccgcacttgctccttggctgttgagcacaccatcgaacgccattgtccatgtttcgttgtcggtctgactgtctaacctgttttcaggcatagtccaatcggctacgaaatcggcgagaacctgggacttgatggctgttcgtggtacaaagtggacgtcaaactggcttagctcgactacccatttcgcaatgcggacgacaacgtctttgtttctcacgacttcgccaagagggatggcggagataactatgaccctgttggcttggaagtagtggcgtagctttcttgacgtcatgattaccgtgtagagcagtttttggatctgtgggtaccttgtcttcgcgtcgtggagagcttcgctgacgtaatagactggtctctgcaccttttctctttcaacaacaatgacagtactcacagagtagggcgtggcggcaatatagagaaataactcttcattaggttggggagcaacatgtacagggggatttgacaggtagcgcttgagtgcgatgaacgcctcttcggctgcctgtgtccatacaaatttgtcttgcttttttagcagagcgaagaaatgttgtcctcgttctcccatcctagcgacgaacctacttagtgccgccatgcatctggttagcttctgtacctccttgagtcttgtgggcgacttcatgttctcgattgcattgatcttctcggggtttgcttctattcctctgccagagacgaggaacccgagcagtttgcctaacggtaccccgaacgtgcacttcttaggattgagcatgaggcgatatcgtctgaggttatcgaaggtttcccgtagatcatcaatgaatgagtcacctgtcttggtcttgacaacaatgtcatcgacgtaggcctcaacattgttacccagctgatcgctaagtgccccttggatcgtacgctggaaggtatttcctgcggttatcagtccaaacggcattttaacatagcagaatacaccgaacggcgtgatgaatgttgtcttcttctcgtcctcttttgccatgctgatttagtggtagccggagtaagcgtcaaggaagcttaacagctcgcaaccagctgttgagtccactagttggtttattcgagggagagggaagtgatccttggggcacgccttgttgaggtcggtgaagttgatgcacatcctctatttcccgttggccttccgcaccatgactgggttagctagccactctggatggagtacctctctgatgaaaccagctttgagaagtttatcgagctcttctcgtatggcttgttttcgatctggtgcaaatctccgcagtttttactttactggcttggcatcgggtcgcaccatgagtttgtgctcaatcacctccctggggacccccggcatgtcggacggctgccaagcgaatatgtctgcattgtcgtggaggaaggtgatgagcgcgagttcctatttctcgttcagtgatgctccgatcttgactgtcttgtcggggttggcactggagagtggaacgattttgattgtgccgtctgatttcgacgtcttagtcgttctgatcactttcttgggtggctcggctgtggcgggtgggctgggcgtgtgctcgaccatgtcgaggctccgcttgtcgcattggaccgccagctttgcgttcccttgaatagtgattgttcccttcggcccgggcatcttgagtacctgatacgcgtagtgagatgcggccatgaacttcgcgagtgcagttcttccgatgatggcgttgtatgctgtgtcaaactcagcaacatcaaatgttatctgctgtgttcgtaagttgctcgcttggcggaaagtcacaggaagcgtgatcttgcccaatggcttggacgaaaactgagtgattccatggaagggttgatcggtaggtgtcaacacgctttgtggaatccccattgcgtccaaggtgctggcgaagagaaggttgatggagctgccgccatcgacgaggactcgcactaccttgttattccgaatagtgggttcaaccacgatcggatatcgtcctgggataacagtagccttggggcggtcctcatctgagaactcgatcttctgttcagaccacttcatcttgggtgcaacccctgtcacaccctgaaaattcaaaatatataaattgttgtttaaatggaatttttagaaataattttaaaagtcttgaaaagaaaatctaagtttaattaataaattccaatataaaaaggggccagataaaatttcattaaatactttgcttaattctataattcctagatttttctgggatttatttgagctaagaaagtatttttaataaatggaattgcatttaaggaataatttaaattgaaaaaggttttaaaaagtctcttttggctttgggccgaaagtcggcccaaaaccgttctctctctcggcccagtccggcccagtccgcagccgcccgcgcgagcgcgctgtcgcagacaggtggggcccacccgtcagtcgtcgtctaccttcggccgccgccgcccgaaaccctagtttcgcgccgccgccgtttcctttccaaatccggccgctcctttccttctccggccgaatcaatagaggggaaatgatcctcgggatctcctctaccttttctcctttggaatctttggttaaatcgctttggaaagctttggaatcgagttcgattcggatcggttttccctctctccaagccgaaggtttccttcgccgttgccgtcgccgtgggccttcgccgccgcctctgagcccctttaaaaggacccccggtgtctcctctacccgtcgcagccctcgccttcgcctctcgtcgccggagtagccctagcgccgtgtgccctagctttgccttcgccgccgccgctccagccgtgcgccgccgtcgttccagccgtcgccgtcgctcgggaagaccgccgtcgtcatcgccaagtcgccgccgtcctcgtccgccccttcgcagccgtcggaacccgccggagcttcgtcgccgtcgacaacccgaaggtagccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgacccagctgccgagccgccgccgccgtcggtgacgtcatcgttgacgtcatcgggatcctctcccgtgagccggtcgtggaccgatcgatcttggccgtccgttttggattggatcaatctcggccgtccgttcgtgtgaaccgccgcccgtgcgccggtccacccaaaccctagcccgctgacgcaataaatccccttttccttttcaaaaataattcattattgcgtcataattcaatttaaaccgatttaagtgttttaatccgatttaatctttaaaaaatcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgatgaagacgagccttcaatcgacctccgatgcttagaagaactagagtgacttgttaagtcgttgtcttagatcgttgtgttagtttgcttgcttaaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagttccccgttttcccttcttgtgccctgtccatgccagatggtgaatactcgcagcaacgggaatggtcccaacaaccccaataataacaacaatggagagaatcccactctggcccaagttcttgctcaacagacacagcttatgaacatgatgatgcagcaatttcagaatcagcaaaaccaaggaaataaccatgcacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattaccctgatttccagaaattagtggataaggctattcgtcaggaggacaagtacaattgcatggagcagaggaaacgtcggattgctcacttcaaggcacaacaggggagtaatcagaagccgcgtcttactttaggaccccagtctatgccacagggaggttcttcgtctgttgttcgtccgcaacgtcagttcttcaacaacaatgttggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgacgcgtgaaggttgtccctgcccagaataactctgctgtatcagcatccaaggctcgtgtaaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggtcagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcatgctcgccaagtcgccgccgtcctcgtccgccccttcgcagccgtcggaacccgccggagctttgtcgccgtcgacaacccgaaggtagccgtcgcttccttctcatcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatgggtcactgccgggcaccagactgagaagtggcggagataagcccacgggggtcgctggggagtccatcccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacattgactcccagtccgacgtagtaatcttggaaatcggcgctgatgaactgggagccgttatccgttatgatgcggtgagccaatccatatctgcaaaatatccccttgatgaatttgatggcgttgtcagccttgatttcccccgtggatgttgcctcgatctatttgttgaatttgtcgattgccacgaataggaatttgtagctgccctgtcctcgtaggaatggaccgagtatgtcgagcccccagcatgagaacggccaagtgagagggatggtttgcagtgcttgcgctggtagctttgtgtgtttgctatgaaattgacaaccttcacaccgttgtaccatgtcgcaagcgtctttgagggcggttggccagaaaaatccttgtcgaaaggcttttccgaccaatgtacgaccgacggcatgtgacccacagacccctttgtgtatgtcgaggaggaggtgtttgccgtcgtcggacgagacgcatttgagaagtaccccatttggcgccttcttgtatagatcgttgccgatcatacagtagatttttgcttgacgggttattttctcggcttctgcatcatcctcgggtaactcgtcgctgcttatgaatttaatgagtggggtccgccagtcgtccgtggtctcgatgtcggcaacatcgcgctctgcctctgtagcccccgagctgatgtcgggggtgactgggctatcttcgtcgtttgcctctttcactgatggctttgtcaggatgtccagaaaggtgctgggttcgagtggctctcgtctggacgcacgccgtgctagatcgtccgactcgatgttgttcttgtgatagggtaccgagctcgaattcggccttatcgatcgatagtcatcaatgccgtcg

SEQ ID NO: 80314 - DNA, 60944 bp, Oryza sativa
cgaggtcggcggcctcgaaggtggtgccgtcgctggagaggaactgcccgagcgcgtccatggcggcctcgcgggagaagttgtagatcttgcggttgttctgccagtagctgaagtaagggttgggccagtagatgctggagaagttgccgttgtcgtagaagagggagagcatggcgtagtcgctgaacccgaggctgtagtagccggcggagagcagccggtcgcgcgacaccagccgcgtcgccgccgtcagccgctgcgccgggagcagcgtgtcggtggggaagtcgaagctctgccacagcgtcttgccgcaggcgtcctcgaccaccaggttgccggtgtcgtggagccggacgcgggcgccgccgctgccaccggcggcgggggtggaggagttccagaccacctcgccgccgtagtcggtgaggacgagcgcgccgcggcgcgcgtcgagcgtgacgcgcgcgcccttgctgtgcacggggcgcgcccgagccgcggtccagacgacggcgcggtcggcggcgcgcgcgaaccagacggagaaggtgaagacggtgggagacgcgtcgtagaagccggcggcgaacgtgccgtccggcgagcgcaggacgtcggtggcgtggtcctcgacggcgatcgaggcgccccgggcgagccactcacgcgccgcgtcgacgcgccgtggacatggacgcggcgacgagcttagcgtgatgatcacaagcaacgcgaaggttgcaaggcgagagttcatcatggcacatcaatcaggatgttgattctgacaggactgagattaggatgttgatttggactgtatagtgattacggttaatttttttgtcacacaagtcaagaattttgtgcgttccatcgcctgggcaccagtgactaccactaattaagatagtaatatggtaatagactagtgttagtgaaagcgatttgacttagatctgagtattgtatatgcataacgaggtgtacatgcacgttgcgtccaatggagtttgtgtgcatctgaactctgaaattctaaacttctgcttaaagaaagctgggtgagaagatagtagttctgttcacagcagtaattgggactacgattgattaatagaattatggggcaatttcatttttcccccactttcatctctaatattgattttgcccctactttttagggtttttgtttttgcccccactttttgaaccgaaaaatacttttgcccctgctttggatggaggagttaacggtgttaaatatgacatttataccctctcccatatctattcattaattgtgtttttgcccctattatgcatggctttggaaaattatttttgtgaatatgtttaaaattaaatgattgatttggacagattttgacattacaattgggacataatttgaatttgatggaattttgacaaaatttcggcagcattttgacagaaattgagcaaaaattttgacaaaatttcaacaacattttacacaatcatatgaagtcatatcagccttgcatcgttgacaataccacacttggcatacagattaatcagggcattgctcacatgcgaattgtccaccaacacaaccttttccgcatacacatgaaccctcctcccaagagcaagcgccccaatctctgcacaagcggttagaacactgactatggtgactccatctggcgcaaagttgacgcccagcatctcccggaagacagtgagaacctcgttagggcgcccgttggccgcaaagctgttgagcatcgaattccacgagacgaggttctgcccatgcaccggcatttcatcgaacaccttgtgcacgctctcgaacaggccacacgcgccgtagagatgaacgggcgagttttggacgaacccgttcttggcggcctcggtatggaggcactccccttcgcggagcgcgaggaggcgcgagcaagcctggagcagcgacgggtaggtgtgcgtgtcgggcggcgcgaggcggcggcggtggagctcgagcgcgacgcacgggcggaacgagcccgcagcgatgcggtgcacggtgttgagggggaacgggtctagtggcccgtgcgggaggaggcgggagagtaccgccacggcgtagcggagcggcggcgcgcggaggacggcgaggtggaagaggaggtgcttggcgaggagcgggtgggaggtgggcacaccggcccggagcgcccgcgcatggatctgcttggcggcagcgagggatggcgcggcgaggtggacgggatcgcctcgctcctccaaccaccctatcagccaccgccgccgccgcccaacctagccctctccccccagcctagccctctcgccgccgccgacccctctcctgctcgccggtgggaggagctgtgctctagccgccgccgccgcctgtagactcgagagagaagcagcgagattgggggaaagaatcggttctctgttagactagtgccaggggtaaaaaagtagaacacaaattcgaaaaaaatttattttactgccatatagctggtcccactaacttccatccaaaccagggtaaacgtctcttccggttaaaaaaaagtgagggaaaaaataaaaaccctaaaaagtagaggcataatcaatattgaagatgaaagtgggggcaaaaacgaaattgtccctagaattatagaagtaatgtttgtatcataccagcagctgtgcagtatcaaatgcaggatgagctgagcagacaggaaaggttttgactgtcagttaatgttgggtgattttttagtcaacacttggtttgatgatctgtaccgttgactttgtaaacaaatgatctatattctactgtatgataaggttgaggtgctttgcggacaagcattaatcagccatcaatcaagccaatggagaagttccatgtagtttcaggattgggacacctcacagattttcagcgagtaaatgcatcatcacagcagctacaataacagactataagaatatattttaaggagataaaatagtgagcagagctgaactcagctgcgtctggagaaatttataatatgccactcaatagaggtactctaaccgaatgtcactatttaggatgttcttataaaaatgccactcaataaagataaagactcgttcttaataaaatgtcactttaggctattttgaggcttttaatcgcaaaagatgtgcggaatgacaaaaatacccatgtgtctttccctgcggcgataacgactccttctcggcgttggcgctgcggtggggcggcgggacggcggtggcggcgtcggcccctagcgcgactgagaggaaatcggccgtgcgtggacgggcgacgccgcgacggtagcacggccggccaggggcgcgcagacgggcggcgtcggcccctagctcctctcgactgcgcgcggtcaagtgacagcgacggcagcggcagctgggcgagcgcgcgccgacagggcggcggtggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccagtcccctcctcccccgcgctctccctctccccatcacgccgccgccgccgccgtcgcgtcgccgtccccgacgcctccgcctccctctcccgccgttcgccgcctcctttgccgaccgccaccgccccgcgccgccttccccgcctccgcctccgcgcatcgcaacgcaacctcaggcgcagaggcggcgacttgactccccccctccccgccctctcgctctagggtttcctcccttccccgtcatcagccgccaccccaccccctcccccgccgggcttcgccatgtacggtcaccgcgggtaagccaagcccctcctcttctttcttattcctgattaatctccgcaattccatcccgccgattcatccattgctttctttttttcctacaatacttgcttgcttacgcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaatgatgggaggcgggggggtttcggatgggtacgagggatcaaagaggccacgaatgatcgaatccaatccatacttcgcagtgaccgcaggcagtcccttggatgtctcaaagagggccaggatgatggaaccagcccctccctatttcggagccatgggcagcagcgctgctggtggcaccagtgccttctaccagccctacggcaccaacttacctggtgcaggggctaacagtgccatccagaactttccaggggtccgtctacgagggctcccctttgactgcgacgatcttgacatctgcaagttctttgttgggctggacatagtggactgcctcttggttcacaagaatggccgcttcaccggcgaggcttttgtcgtattcccatcagccatgcaagcagagtttgcactgcaccgcaaccggcagaacatgggcaggaggtatgttgaggtgttcagatgcaagaagcaagagtactacagtgcaatagctgctgaagtgaaccagggcggcttcttcgactcggagtaccgtcactccccacctcctccacggcccaagaaaccagctgaagacaagagcagcatggagtatactgaggtgctcaagctccgtggcctgccctactctgctaccactgaagacatcatcaagttctttgtggagtacgagctgacggacgaaaatgtgcacatcgtgtaccgtccagatggtaaggccactggagaagcctatgtggagttcccgacagcagaggttgtgaagacagccatgtgcaaggacaagatgaccattgggacaaggtacgtggagctgttcccatcaaccccagaggaggccagcagggcgaaatcgcgagtcaggcaatgaattatttgatccagtcatctactttgccctggccttgagcagctgtgttccagtttagctttcgccttgcatgcttaaactgtatccctcgcctttaggtttgtgtgtgtgtgttttagtatgcatcatgttgctaccgtgccacaacccgttggtgtggtgactttataagaacccgaattgcatttttaaaagaagtggtggattatgagatgcctgcactttaacagcagttgcgcctggttggatgcattttatatggcaatggcatgatcattgttttccttctgagtttgcgacagatgttctactgtatccccttctttttggtgaagcaggggatgaagctcgcactaactctgttccaaaagttggttgttaattaatatgaatatgcataaacataacgaggtgtacatcagtacatgcacgttgcggcccatggattgtgtgtgcatctgggatacggttttcccgattcctatgatctatccaatatgctaactctgaaactctaagcttcagcttaaagaaagctgggtgagaagatagtagtagctttttaattctgttcacatcactaattgggactacccccggacaacgattggttaagaccctgtttagatgggactaaaactttttaagtctctatcacatcggatttttggacactaattataaatattaaacgtagactattaataaaacccattcataatcttggactaattcgcgagacgaatctgttgagcctaattaatccatgattagcctatgtaatgctacaataaatattctctaattatggattaattaggtttaaaaaatttgtctcataaattagcttttatttatataattagttttataagtagtctatatttaatactctaaattagtgtctaaatacagagactaaagttaaatctctgtatccaaacaccacctaatagaagcaatgtttgtaacataccagcaccagcagctgtgcagtgtcaaatgcaggatgggctgagcagacaggaaagattttgattgtcagttgatgctggatgatttcttaatcaacacttggtttgatgatctgtaccgttgactttgtaaacaaaatatctatattctcatgtatgataaggctgaggtgctttgcagacaagcattaatcagccatcaatcagccagtggagaagttccatgtagtttcaggattgggacacctcacagattttcagcgagtcaatgcatcatcagtcaggacaaacacagacatgaaaaattgatggagttcatcaacaatattgtaatgctagccacctcaagaatctcagttatctaaaaataattacataactgcgaaatggctatgagtaataacattcaatcaatagctacacaacctattctctataggatggatttgatacaacgtctgatctctattggatctgatacaacttatgatagaaccccctactcattgggtagtcacactctttgccagattccttggttgatcaacatcaaatcctcgaagaactgtcagatggtatgcgagcagctgaaggaacaaataacaatacactcagtaaatgaaattgtttcacaaatgataaagcataagtagaagttctggaatttgatgaaattaaacaattcaaacaatgtgcaaacctgtaacggaattatgttaatcactggctggagacagtcagcgacctctggaacttcaataaccctgcaagatccactagggcaaactgcagatgcgtctccctttgagcacatcactatcagacgccccttgcgagaaaggagctgctgaatcactgactgttgcttgctgcaagaggtgaagatgtttagaggaactccttgaaaaatgaaaagaaaatgaacgtgctctgcagtctgtccaaagcgcttacctgaagcacgcatcacgtgtagcaatgacgatgatcggaaggttttcatccactagtgcaagtggtccatgcttcatttcaccagcaagcatgccttcgctgtgcatcagagcaacctccttaactttaagagcaccctctaaggcagtggcatagttataacctctgccaaacacaaggagagactctgaatcgatcaaggaagaggaaagttccttcatctcggtatcaagttttaaaacctcgctgacattgcctgtgtagtaaaatagacaaatttggaaaacgttgttcaaaagaaacaatttcctagactaaataatgcatttgttgatctaacacgacatacttggaagattggaaagaccactgatgatagcttgacgtctaacttgggtggatatttgatcagatccaacagccaaggccaccatcaccatgactactatttgacttgtatatgcctgcaagatatgagatattgttaggaatcaagacgaccaaaaaagggttgaagcatgagaatagacagaaattaaccttggtactagcaacacctatctcacaaccagcattgatatgaactccacaatgtgttcttcttgatagtgtgcttcctacggtatttgttatgccaacacaaagtgctccattttctagtgcataatcaagagcaaggagggtatctgctgtctcccctgactggctaacgaaaactgcagtgtcttccctgtagatgggaccttgtctgtccagcaagtcacttgcaacctccatagtcacaggaatacctattgtccaaataatgcaaggaagaagtatctgggtcaagaaacaggtagctaatacatattgtcactgatgttgacatctaaaatttctacataaggagtcaggacaataagttggcataccagttaattcctccacaaaaggtcttgcagccaaggcagcattgtaacttgtaccacagccaatgaaaactaaccttctactgcgcctaatagttttgaggtactccttttcctttaatcctcctaaaagaacaccactatccttcactctacccctcatggttgttgttaatgaatgtggctgttcatggatttccttttgcatgaagtggtcataacttcctttctttatctgctcaacttccatctcaaggacagacaatgctcgttgcacagaagctggcttctctttctcatggtcaaacttaaggatagacacactgccatcctgcaatggccaaattgttaaagcttggacaaggcatcaaatgtaaggctaatgatgtcaaagaaacaaaagaactgttgcactagcgtgttcacatattatttcagtcaataaaaaaccagtgacacaataaaagtacaattgtcaaattggcagaaaaaatggtataaaggaaatagataactttaggtctagaaaagatagattgccccccattaaaaatgatctttctttctaaaaaagaaagtaaaggcaaaatagaacagataaggcaggtgaatcaacagagaaagctgaagagtaccttaatatgaacaatttcatcatcttcgatagccaaataattcttggtatgctccacaatagcaaataaatcactagagaagaataattctttgggcttcccgtttgttgtcagagctttgacatcatgaaatggtttcccactattttggccacttaattcctgaaaatagagacaacagttacaaatataaaaaaaatgtttccaagtcaaagggaagcagaatatttatagtatctataaatatgtgtaaaaaaatgattacacaaaagataacttctaaccaaaccaacatcaccataaaagaaaattatttaatctgcaagcaatctactgcacagtttctcacgtttgcatttttatagaacaaaacatgtggcagttaaccagagcaagtagttcgtagttactctattgagtgtggattttatcgcaggttccactctatgggaagaaaaaaatggtagttcttagcaccttttgacaagccaacatttgtgagaaaatgcacttcatgttttctagtttgacacttttacctaatacatgtttgaagcagatggagataagaacggtgaagagacaacagagttaaagttaacttttgatgttaggtctagtactacataataaagtcaacttgaacagcaaaagatgtagctcaagagcataacacataattcttacacaaaataaaaatcactgttttactatgcttgattagaacctagctgatagtttaagacaaaccaggatgcacttacattgacaccgagtatcagtgtgctgccccgtttgcatgcaatcaattcattggggtagtgtgggcttttaaagataagtgcgtaggctccttcaagctgcctcatgacttccataacaacttggctaaatgtcacatcacctgagaaaataataaaaagttgccttaactagaactagtacagtaagaccaacatatagaatctagttaccgatttcttttccttttgaattttgtaagaattctcctgccttgttaagagtaatgtattgcctaaataaaaatttctgagcgcgaaaagcataataaggtatatttattgcctcatctagttcttaggtggcaaatctagtttccaacatagatcatagtagtataattcttgctccaaagaaatgataatataattataacttgagaatgaaaggtttagctaaagatcagggagtacatcttgtctgttgtcaagaatataaataccttcttcatcatgcgccttatcaaaaacaaactttgccaacttagggatgacttctgtgtcagtatcagactcaaaggtgaacccgtgccggattagtgtctctttcagaacctgagcagatacatcagaaataccaagttatgatggaaatttatctgtttacatcattatcatctcttgctacattaatttgagatggtatcatgaggttacacatgatcatgaaaccaagtttgagatggttggctgattcataaatgtctaataaacttattgtgaattcagtatattgtcatttgccacttctataagataatattctctgcattacaacgacaataatctagcaaaatgagatagaactcactgatattctagttgctagttaatctacagcagttattttattccagtaaaagcatatgagctttcaactaaacggcagattatttaacaacaatagtgaggcgtctatggagattggagacagcccatgtgcagggcttggaagataacatgttggccaatagcataaatccaccatagttgcaataatgcatgtggattccccagctgtaaagatgatgagagaaatactatacaagaattctagtacaatatcagaacttcagaagagcaaggtaaacaagaacctcgtagtttgtgatgatgccattgtggacgaccaagaactcatcgccggcaccagaagattgggggtggctgttccttggggcaggcacaccatgcgtggcccacctggtgtgggcaattccagcatgcacattgaaggcggcgtccaggttcacatccttctcatcaacctctgaaaaatacacaaacatccaacatgacaaaagatagagtacaagagagcaccaaaattgtagccgagactaattgtatacggtataaatcgtcaggaaatccagagagaaaggaaatcagctctccaagtggtaaattgaataaatcaccgaaaatgccataaacccaagaagatttagagttgatccgaatgggtcaaattctaccttttctgaggagatccagaattttgggagctatgctatgccaatcccaaaaatgcaaagtgcgaacagaagaatttccctcgcaaggataactaaacccaaaatcgctaaacgacataatgatattccccaaaatgtgatatggatcccaatcaaaatccaaagcttttaccaagtgatacagccaagtcagaccacatagcacatggaaatcgtgcaaaaatccatcccaagaacccaaaattcaacccatttttcagcataatcaggagggaaaaggcactgaccggagtagacggatcgtacgaggttctcgatcttgccctcctggcggaacaccagcggggacgccccggcataggccggcaccgccgtagaagaagaagaagaagcgcaggagggaacgtcggcgtcgacggcgatgccggaggagtcgtagccgcggtactcgaggcggcggaggccattgaagaggacctcgaggatgtagcggcgctcccgcgacacattgtagttgaggtacgcgaagatcccgcacatcgtgcgccgcgccgcgctgggctgggcttctagaagcttccagaagtttccgggttcgggagagagagagagagggaggacgcggttacgacggcggcgaggagtcgccggccgaggcggaggaagaagaggagaaaaaggccgcgtttttttttttttgataggagaaggccgcgtatttgggtacgcggagtcaaagcccaaattttatactgatcgagtacagcaggacaggctgacgtgtagcctgtgacccagtagccgcacgatttggatcggacggctactgtagcgcacagctcttcgaaaggaaaaatggaaatctaggtgctccttactccctcaagttccatttctgtgcctaacaaactttgatcatatatcttatttaattttatttataattagtacttttattgttataagatgataacacataaatagtactttatgcgaaacttatgtttttaactttttttaaaaatattttaaataagacaaacaattaaagttagacacggaaaatcatggccatcctccttaaaatggaagggagtgagtgagtactcattacgggcggctgtcacttgtcatcacgtcaatgttaatacatgtgtagtacgtgttaaaaaaaatgctaatacatgtgtagatttgtcatgcttgtgccacgcgtcgcgtttctgattaatttggacgtcgatttttactcgtagttgcagtagatgacaactgagtgcgtgttttaagccatagtatggatcagatattttttggagagaaatatgcacacgtgttaggattttcagtcgtgttaatttgacactgagagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggattgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacccacagcagctgcacgccaagcccaagaggctctaccaagtctggaagggaaacaacgtacctgctctttctttctttctttctttcttgctccagcgatctggctacagcttcttcaacttcatagcagcgaggtagactgattttccttcattttgcagatattcctgtgtggtggacgccttattattggcccggatgcagcctccctgctgctttccatgtttctcatccttggcccggccatcgtcttcagctatcagatggagtccacaatccaccgctctcaacaacggatgcatcgagctgcacagctgatagtcatcatcacaacagcagcggttagtgaatccccaaatcatttataagttgcttcttcacatataattttgattgccaatccgttctctagtgacatataccaaacaattaatccgcatggtagtcacagtgatttcagcttcaatatctgaaactgaaatcagtcaatcaggggttcaagattccacaagtctaatttccactatacaacatgtctagcactgtacagtcatgtgaatttcaccttcaaattgcaggaccttttcttcctcttcatgacatcagccagggacccagggatagtgccaaggaacacaagagcaccacctgaagtcgatgaatttcttggctcaaccacaccatcgatggagtggagctcagggagaactccgcggatgaggttccgtaggtcaaaggatgttacagtcaatggcttcacggtgaaggtgaagttttgcgagacctgcctaaggtaccgcccaccacgatcctcacattgctccatctgcaacaactgcgtcgaaaagtttgatcaccactgtccatgggtcggccaatgcattggacttgtaagtaaacaatcaatgatgcagtaatcagtatagtcatcagcctaattcaatgtgcagttccagtactatttgtttccatagtgtttttagaaatatggtagagtataaccactatgcaatgaatttctcttaaaaaaaagctctatggaatgaatgaacttactttcaagtttccataagatgctggtaaatatgccaaaagagttcttccctctccaatggttaatgtccagccaaattccttccagtcatcttcagcatttgactatttataagttattcataaagctacagagcttaacaagacatttagacttgaatttgtgagttataactttactttttagctaaaaggactcctcaatcatctaagttgaattacaccaggctcaatgtaagctattttttaattacaaaatcatcaagaatgagttgttaactagttccactgtttgactagacgtgcagataaggttaggcacctatgggaacagaacaatgaaattttcagagcaagacctaaactgtacctaacatacattttttaggactaaagcacatatttcgaaaagaatttctcgcaattaatgcagtgaacctaaggtcaaggaataacttatgtgaaagagcaggttaaccaagcactaatgatcatctgaactctatatttcagcaactcacaaatctcttatacagaaatgatgttaaagtattcttaagtgcgtgatcaatcattgcactctcggatggtttccacttgcttatcaaaatcatgccattttctattttttcttgcagaggaactaccgctacttctttctgtttgtagcgacatcgactttcctgtgcatatttgttttcatcttttcatgggtgaatgtctactatgaaaggggatacaatggcggatccatctggaaggctttgcgaaaggaagtatactcatttgtgctaatcatatatacttttatcgttgtatggtttgttggtggtctcacagtatttcatctttatctgatcagtactaatcaggtaaacctactttcttctttagctattctagagactttgctatagttactggttctcttatactgtaattcagtaaatgcattttaatgagtagacagtattaagagtttgagatagttctgataacttcaactagcagctccatacacggtgtttagttgtgtactgaatgtctaactagatccaactgcaaattctgcagacaacatatgaaaacttcagataccactacaacaaggacaacccctaccgaaagagcattgcagcaaactttgtagatgtgttcttcaccaagatccctccaccccagaacaatttccgttcatgggtaggtgagggcgcactggaagctggattttatactccatatattgcgctggatttgactgatccaagggaaaagattgatttagagatgggaaacaaggatatacttgttgggggtattcagatcccaacagtgcttcagaacatagactatggttcctttgaagataatccagatgacaagaacaggaatgaagatgatagactagtgccttttgcttcaacttgggcacaacaagcaaatgaaggtgctcgaacatctgaaatagctactgtagaatataaggacgaaataagtgaagatggtggtaaggaaattattagttcaaacacaagttcagaacaaacatcaatagaagctaatgcagcagcatctgaggatgaaagcaatgaggacaatgctggaaaaagtaacagttcagatagaagttctacccaaaatttgggggatgtgaactatagctctgtattactcatctaaattgataatctgttcatatacatggccattatgagttgacattattcttagcattacacatgataaataaaaacagaaaatgaatgactgtatgcctcagccaaaatttttagaatgtattagtttacgtctagaagcccatgttgcactgttcacgctttcctgcactatatgtttctaatttctgtagcatgtgggccgtaatgtggacataaaaagaaaagagttctgttgattgattactaccttaatgatgcaacagttcagattgctctactgcctttatggtactacaaaggtgaagctaacgatgcagatgtggagcaagtcacagaaggggcttgacattcacaaaataatccataaagcaggaccaagataatgtaaattgttaagtaatgattccattgctcattatttggtaaaaaaaaatacagctgcttacagcttacaagctaaactttccagactaactgaaatctggaatttgaaagcaaattactggtcgctaaaaggcagtaccaaagattgcacatttctgcaaaaatgaaattcctcacgcctgatagacatctggaagctgaaggcctacactggcagcagatttgttcaatatcttcttcatctcctctgatcggtccacagctatattatacgagaatagcaggtcctgggcaatcaaacatgatttacagagttaacatggtatacagtgcatgaacaaccaatctaaactaggtgtgatgtactgggaagtgggaattagcaatgaagcaactgcgagtttgtatactaaaacacaccgaaggaagttcaattcatcacgttaatcagagtttgatttggggaaaaaaatagcaaggaacccaatagaaaggggagtttcagtcaaaaaaaaatagaaaggggaaagaagccttctagccatttcatcgaacacatttatctgctaaaacaatgcgcaaaacaggagaagattatacgcatctagaaatggctccaaccttgtggtggtggacgctggcgaggaggtaggcgtaatccccggcgagccgcagccgcgctctggcgtcggcgtccgtgccagtggggcggcggaactcggaggcgacgaactcgcggaagtgcttcttggagtccccccgccgacgtgcttctgcaccgccttgagcacccgccggtagacggccgccgacgtggccaccatcgatctgtccacggatccgccgcgagaggaggcaatcggacgcggagactgcgggtcgccggcctcgccttcttggccgtgtcgatcgaactggaactgtagaggaggaggaggaggaggaataggtaggcgtccccttgccggagattctcctctgcagttgccggagttcgccggagcttctccgccttcttcaggaaggagtaaaggacagagtaaagggactgaagtaaaaaaaattgcaaagaatgaaaagggctattctgcaaatatccatcttcatcctgagcctcaatctgaccgtccatcttcgatctaacgcccaaaacatttgcaaatcagaccatggtttggtttggattggactgctacgagtttgcatataaccaaaaatgcttctcgctcgaacatttcagcataaaataacttttttctttatttgaagatggcttatcaatactttattatatctattataaagctttaagtttttccagggcggatccaggaatgaaaaatagaaggggctcaacatacgggaaaaaccgacataaacatatcatgtctcatacaatattacagtatcaacaggtacccctatatcatggtctgcaatttcgattctaaaaaatttaggaattctgcaacaccatcccccaaggaaactatcacacccaaataaaatcatttttcttgtgaagtttaacaaaatctattcaattttggtaaaaaaaaaattcaaatatcgaaaaactttcttgcctaaaaatttcgaaatttgcagtactaatcttgaattcctagctaatctaagctccctgattcaaatattggccatctttgtttaggcttaaacttattggcttagacttttaagtcagcttattggcttatatgatttataagccagtgaatttaatgtcctaagtttagtggtagagtcatacatctatcttatataagccaaaaaaagcttctccaacttagcttttggcttaatagtgtaagagtggcttataactttaagaaagccaaacgaaaaaactgcttgtttgtttaggcttagactttttggcttataagttgacttataagcctaaacaaagaggaccttaatagtggaagggatcgccaatatatcgggttttacggttatgtgatacaaatcaaatcagatttgcccaataattgagcgagtaaaaacgaactttttcctactttttgcagcacgcctgatgatgcgtttgtgatatcgtgggcctcaaccaggtgccagcactcccgtcctgaggccatcgacgcttcccatataattttggcccggaactccaattccatcacatacaatatcggcccagtatgtttgtgggcttccggcccaaatcgccttgggctgtagcctacgggtactcaggtctctgggggagtcaagggtttaacccgtcctgcgacgcggagcaccggccgccgctcgccgacgcaagacaacgacgatgccgagcttccctccgcccggcaccgtcaccatctgcgagatcaaccgcgacctaggtgtgctatccactccctgctccccctctctctgctgtctccaatccgcttcgcttgctagctgggctgctcattccaagtctgtgcgttgcagttgcggcggatgcgctgtccgacgatggagccaaggatgcctacggggatgtcctcgtcagtacactcccatcttccccccttcctcctccgcctcgcatagtttcgtctttcttctttttcacaacactaattttattaggcctctaattgaaactttaatttgggatttcttctccagggaatggtcttcagcccgattcctttccagccggatgcgattgttgccacccacgagcctcctgctgtcactgaagctgctgagattgtccccagaacaagtttagcttccaccgtagctgagtccttcaaacaaatgctattcccttcttgcgatgtgagttggttctttatcatatcttagtgactcaattgcgaataattaatatatctccatattctgtttatgtcataatatcagttggcatagtatactgttagattgaatttatttatttatttttaatataagggaggaatatgcctctggtcagcgtcatatcatgacaatgttgcatttgtgaaatctggtacctttcctagaggttctagtggccaagggatgcttgtggacattctctattgttcttctgctgaaggtagtagcctagtaggaaaggatcctatggcttacaaaatattgtatactcgcttcaacaaattatagatatcatcgtcgaaaaaagtacagatatatttttcatccatatgatttcactaaaggaggtaaaattactgaaggcgtgcagggtattgaaatgaacactcaaagtcatataatggatgaaacataatttatgtcatactgagtgcatgcactgtatcgaaatgaacactcaaagtcatataagtgaccaaacattaacttatggcatagaagggattaagtgaaaacttagtgaaacataaagaacattctcttttaaatatcggtgtccctggaaacagataagtggtattttcaccagataaaatgtagaccccagaattttgcattccaaaattagttaccagtaatcggtcagaaattttaacatgagaaaagaaaaaagatctgacatataaaatacattaatacatcacaaatagatcataatgattgtagggatataatccatagggacatgcttcacaaaaaaagtatataacatacaatagttccaccacaaatgtggcaattgatttaattctagaactggatgtgagtatttctttttccttcagaaatgtaacaacaaataaacttgaaagagaagatgaagttggcatacttccaaagttgaatttaaattgttccaatcaatttattggtactggttcattggcttaggagcggcaactgatcacttaccgctggctgtatcatgactcctctttgtgcatattcaacactgcattatttaattttgtcttctaattaacatacttgctccatttttcagttcttccttaaggaccaatgctgtgtctaatttccataccctcgaggataagtcctttcttcgagttgagctggacgatctcttgcaggttgataacaaccattccatctccttggtggttgtagaagtgccccagttgtacctccatccagccgtcaccccgttctctcggatagctcactgtctcctctgctcgtcctacttcgcttctacccatgtcaagaggtgtctcttgcgtgcgtgggtgcagagagacggtgcgcttggcagacactacttgatcgtccatggtgatatatgcctcttgtgtccggcagtcaagcccgtatgatttatctgccaatttgaagatgagatagactatgtatcgtgtgttgggtgagagctctctgcagttgatgcggccacgcaaatggaaccagcagacaaatacaagcgcagctactctttcaaacctgaaacaaggagaaactttggtttttgtttaattatcgagaaaaaaaatcaaagcaaatcaaagaatagtatgtatattgaatttaaacactatctgattgagaatgtttattatagtttatttcttaatgattttgtatttctaaaagaagtgtcatgtatatgtgattatgtttgcaaaataagtgcttcagatttatcctccacgtttgggatgcaaacctggaatcgggtaagtagatccatctccagtaccgggcatcatccccccatgctatctctaatgatctggatgatagcaagtagcatttagctccgcttgttctttccaaccaaaaactctggatgcaaatgtgcaaattagtcgcgcgcattcatttacttagcatcaagataacaagaagttagcactaatattgaacaaaataatggattttccctggcaacattgcgtggagctagattgtaatattagactttgatttaatatacaactcgtagctcctcaatacaattgtattttgtatatagtagatttaagaatatagaattgaatttgatttacaactcttagtttctactttcgtaggtacaattatttgtatacaatacaacaaaagtgggattggaactaatatacaactgttgacatttatttatgtgaatacaattattttttctttaaaaacaactatattgatgtaacgacccgcctctcccaggccaggaccgcttacatatgacagctttcataggtcatatactatgaaacgttttatgacctattttaagtgactacatatggcagctttcatgtcctcccagagagacacaagtcttttatgcacactatatatgacagctttcatagtcttttatgcacactacatatggcagctttcataggtcaagtcttttatgcacactatatatggcagctttcatagtcttttatacacactacattatgcacactacatatggcagctttcataggtcacatgtcctcacttgtgcgcacccgggaggtcttttatgcacactacatatggcagttttcataggtcatatactgtcctcatagagacacacaagtcttttatgcacactacatatggcagctttcatgtcctcacatgtcctcacttgtgcgcacccgggaggtcacccatcccctcacttgtgcgcacccgggaggaccctggagttctttggagatcagcttctggaaaagaagttgcaacttgttaatatgagtactctattaagcaacttgttgatatgagtattctattaatcctattaagccctaggctagaatgttctggcagctttcataggtcatagactactctgtgtggtatgttctagcagctttcataggtcatagactgctctgtgtggaaaagaagttgcaacttattgatatgagtattctattaattctattaagccctaggctgggatgttctggcagctttcataggtcatagactgctctgtgtggaaaagaagttgcaacttattgatatgagtattctattaatcctattaagccctaggttgggatgttctggcagctttcataggtcatagactactctgtgttgtatgttctggcagctttcataggtcatagactgctctgtgtggaaaagaagttgcaacttattgatatgagtattctattaatcctattaagccttatgctgggatgttctggcagctttcataggtcatagactgctctgttctggcagctttcataggtcatagactgctctgttctggcaactttcataggtcatagactgctctgtgtgaaaaagaagttgcaacttattgatatgagtattctattaatcctattaagccctaggcaaaattgctccaggccaagcacgtttaaccctggagttctttggagatcggcttccagaaaagaagttacaacttattgatatgagtattctattaatcctattaagccctaggctgggatgtcacaattgataattctgcaccatcataatttgaatagatcaaaatctaatggtttaaataattttcttttttcaattaatatggtacggtttctatgccttccgagtgaaactaatgattttctttttcgagctatcttaataatataaccaatgaatgtttttttctcgcaaacttttgtgcggagctagataaaagtaggattagaatttgataaacaattcatatcttatgtttctataaatatatgatttatatatgatactaaaaatagtattagatttcatatacacctttatcttatgtttccgtgcatatagttgtaatttgtataaactattttaaaagtaaaaatagatttaatatataaatcttagcttttgtttcaggtactcatattttgtatacaaatttatcaatcaatctatgcttataaggctataacttatattttgtatacaattgtgttttgtttttctctccgactaatgcgaggtgtgatggttcttttttaaccatcttaactgtatactactccattaggttacaaacgttagacatttagggtgtgtttggttgggtggataagactggatgggagatagccgcttgattttttatggtacatgtggatggggcggtctagaaaagggaatatttcctcaatatgctagatgagtgtatacggcttatttggccggatgaagccatccatgctttcgtatgggtgacgtgtcatattctgattagttgtgcttggtttgatttttttctcctaaaccgtttatctaatttataatttgattacaccattatattagttacaattaaatatttaaaacaagatctcgaatgattatattttgattaaatatatatatatgacaaatgggtcccactaaatttggcttatcccatccatgctctatccctccaactaaacaagaaatttgatcatcctatacatacaaaccaaacaaaaaaaaattagatcgtcatatccaataaaatatggatgaccatatcttatccatgcatgatcatgaaccaaatgcacacttaaggccaagattcggtcatatttttggaacttgaccatcaagtgatttctgaaatggttagtttaaaaacaaataattacggtatgtacttatttgcctcaaagagtagctagaattataaggtttaaaagtttgactaaatcatgtccaaaacaatggggagtattaacagtggtacagctgtggggggtgccggagggggccaacacctcctatccaaacaccaccaccgccaccctcacctgtttttactctatattgaggttaactaagatatgtatttatctagtttatttgtgtagcttgaaattattatcagtttagttagcaagtctaaaaaaacattagcaagaaacatgatctacaaaattagtttgtgatttctcatctttttcaaagtaaaatagaatatacttatttgtgagattattcaatagtttacattaaaaggatttaacaataaaaactagttccaaactttcaatgatattattaaagagctaattaagattcaagtttttttaaaggattagtttacacgcattgattgttattgacagtaactacttgacctcctttgctatcgatattggtaattcagtcttatggcttatccccaccccccacaccccctaatcttaaatcctaggtattatacgtaccttgctgcgttggtcgagaaggacgtggtcctgggcgaggctgaggaagagctccttgttggaagtggtgaaatccacaggatcgtcggctcgagcgaggatggagtggtagtccggcggcaggaagcgctcccacacggcgttggagctcgccgctgcttggaagtcggcggagacggcggagcagcggcaggcgtccgtgggagtggtgaaggagattgcatgagccaggcatgcctctgggaggcgtgagatgctgctgctgctgcagtatcctgcttcttcctccttcttaccaacgctcacatcgtcgtccacttcctcccttcgtgattgcttcatggccagcggcttcaacaactgtcgttggagatatcacaatctagtatactgtatattggactataggtaggcatcaggcatgtctgtacacgatagaacttgtacaatctagtatgtgaacgcatgtcttatcagtaaggaaatttcgttgttatgagtaacaactgatcttttcccacctaatttattattaatcaaccgtacgttacatcatcaacatatacaattgtatatccactcctacccaaattccacggcgcgccatcaggccacggctgccacgcgcttgtgctcgacgcgttgacgaggaggaaaagagctgcaaccatctagccctctcgtggcaggtggatggactcgtgggtccggagccattcagccaacagtttcatcagacaataggtaagtagtagaatacagaatttaggccagtgatacaggtggttcttccccaaccagacaattcctccaacagatcgacacaagccccggccgccatcgtcaaggccactcgcctgtgctatatttcatatactagaaaaagactgcgttgcaacaggcaatggcggatacataaaatcgattcgttggtgtcataacgtttctattgatgtcatagtatgctaattatgtttagatcatattgttataacatagataagcagttatgctataggttttgccgaaagtcgttggtgtcgtctgacaccagtccgcccctggcaacaggtaagtgttttttaatatacaacaactattaggagctaagcaatatattgaaacattaagatcactatacataagtggagctgcagacccagctagcatagccgatgtctcctcttgctaccaagctagacccacacgtttcattagcgtcttcaacctccggacgacagtcatgtgctactatgatgctgtagcctatcctttgcatcaaatctggccgaatctttctcgatctcccaaatttagttgtggatttttaatccactcaatcttctgtttctatttccccgtaatcgaagcgaatccataaaactgggggataaaaatgacctggggaagcttgtcggccgcattattggtgaccgttaaacgaagattaaatctggtgaattaaagccagatttataaggaaaatcattggagaaataatgagggagttctttctgtttctcaataattgaagcgaatctgcaaaattggggataaaaatgacccggggaagcttgtcggctacatcattggtgaccgttaaacgcagattaaatttgatgaattaaagctgaattaatagggaaaatcatggggaaataatgaggggggagtggggaatcgatttttgcaatcaattggaggaggaaacgtatgaggcaaatcgacgtggcaacggtgctaggatttggccggcagctagaggcgcacgtagcttgcagtggatcggacttattaaagaaaatacaaaatcctcctaaaagaaaaaggtgaaataggtgggagagaaatggaggtccggaagactgaaagggagagaaaaaggaagcagggctgactcagagtcaatgacagacgaaaaaaagctatgaaaatctttcgtatattttaattaggtatagatttgtagagagagaaagatggcggtggcaatgatgcctcgagagcaactacaattttccagagcaatgccaaggagttgcttgctgaactaaaggccaagctcaccatggtgaaggccatatccgaggcggcagacagccggctcatcaccaacaccaaccttctccactggctgatgcgcctacatgcggcggctcaggaagccaaagatgtcctcgacgaattcgaggtcgacggctcaaacatcgcccgcaagcgcaaggccagtgacctcatactgtcatcccgatctctcaagaatctggtcattgctgatgaaagcctgaaaaggttggaacatgtcgtcaagaccctcacatagctctgcgcaacctcagccactttcattgagctcatccaggggcggatctccagtgtaacggccggtgttaggcgaaatcaacaactttcgataaaacatatagttaaactatttatccatttattataacaccatggtttaagtataattagcatactatgacaccagtagatacattataacatcaacgaatcaatcttctagatccgctgaaccagtagagacatgtttcaaggaagaactgaagaacataaagtgctaaggaagaaaaaagctcagaatatatttgcatgtgcaggagatgcatatgccttttttttttccgtgtatgacttctactcggacatctatatgtgcgggttcgatctaatcgatatggtcagactctatccttctatccttgtatgactctatatgcaggagcctatatctattgtttctcctgtttccataaatacaaagttattctgtatcaatctaagaccaataaaatatggatctactataatctaacggtcaatattttttctttttcttcgattaatgtggtaatttataggctccacagtgaacgtggtatcttctttcaaagctgttttaataatataattgatagatagatagatacaaaatcctcctaaaagaaaaaggtgaaacaggtgagagataaatggaggtccggaaggctggaagggagagaaaaaggaagcggggctgactgagagtcaatgacagacgaaaaaaagctatgaaaatctttcgtatcttttaattagggttgtgtttagattgacccaaagtttggaatttggttgaaattggagacgatgtgactggaaagttgtgtgtgtatgaaaggtttgatgtgatagaaagttggaagtttggaaaaaaactttggaactaaacacaatttgcctcgagagagaaagatggcagtggcaatgatgcctcgagagcaactacaatttgccggagcgtgccaaggagttgcttgccgaactagaggccaagctcaccatggtgaaggctatctgaggcggcagacagccggctcatgaaggggcgggcctacaatgattcatgagtattcaaatgaatacccaagaattttaaacaaaaaatacatatatgaagtatatattccatatgtatatatgaaaaagaaaaaaagacctaccattcaaaagaagcccaagctaaaaacgattcatatccctcccatcatctcttcctcccactatttcacgcccattggcccaatagcaaaaaaaaaaaaaaaaaaaaaaagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagccaggcacaacattcttgttctcccaatagtcggtatgagtggcgtggggaagacaacacttgcccaggtcatctacaatcatgccagagtgaagcaacactttgagcatagagcttgggtctatgtttctgaggatttcaccatcaaaagaactttgcaagaaatcctgcattcgttccaaggacacggtggcgctattttcaatggcgatgaaagcatggaagctaccatcaccaagctccgtatcaagatcagtggaggatgtaaattctttttggtgctagacaacatgtgggaagagatgtgccaggaatggagcgtgctgctcacagcattatccgatgaggcacgtcagcatgggagtgtcctccttgtcacaactcagagctaaagggttgcacaatttgccgccacgatttatcccataaatttaaaagcattgccgtgggagagcttctggcctctctttcagtaccacacatttggtggtgtggaggttccccaacaagatgacaaccgaaacatgctattgatcgcccaagggattgcaaagaagctagatggattaccattagcagcaaaagtaataggaaacctgctgagatgtaggttctcctgggataattggagaagggttgccgagagtgattggtggaacttggaagaagctctccagggtattctgccatacctcagggtcagttatcagcatctgtcaccaaaacaaagacagtgcttagcctattgttcaatatttcccaggaattacctgtttgacaaggacagggtggtccagatgtggcttgcgcacgattttatccagtggaatgagattgctgacgttatgaggccagatgatgttgggaggcagttatttgatgagctcgtggaaaggtccttcttccaacccacatttgttagtaacaagtatgtcatgcctgatttggtccgtggtttagcaattcagtttctctacaccagtgcttcttccatggtgaaagatcaacaggagtatcgtccttagcaccaggaaatattcgccacctggccctgcaggttaatagcctggaacaatgccaggagctgcacaagtacagaaatctgcgtactctcctaatatttggccgttgtgagagtgatgcattttttaaccttcttgatgggatgttggagaagtcaccaagtatccgtgtgctagacttattgatacggggaaagcccgaccttctcgacgtaggatccggatacacccgtgaaacctcacgaactggatgaacaacacgctgcccgtgcaacgcacctttcaccacgaattcgcaagcatcaaattctcatatatttcacgcatagacttagagagaaacgagttcaccttatgttctgatctgcaagtaaagaacaatgtacttttgataggtagatctgcatcacttatcatacgttaaagcaccagggaaggtatggcccaaagatgctaggcccctgagaaaactgcgattccttgatctttcatttacaaagatcacaaagttgaaggatctccccaccaacctccaagtcctgcatcttcgtggatatgatgctgatcgtgtgccacaaagtatcaccaagctgaccaacctacggcatctgtatgtagatggttcagcattgtccaagattcaaagtattggacagcaaactgaacttcaagagttggagagcttcattgcacgaaagggacaaggattcatgataagagagttaaagaacatgagggagttcacggggaggctgtgcatccgtggtatcgagaatatcagaagtaaggatgaagcgatggaagctagattgatggacaagaaacatgtgggtgccttggtgatcgaagggaaaagagtgcccaagtttgcacttgaaggactgcaaccacacacaaacatacaggaactcaccatcaaattcttccaggaacaagattttcctgattgggtgtgtccagataacttggttaatctcttacaggtaaatcttgaaagctaccacttcttgtctaccattccaccattgggccatctgcctttgctaaagctcctcaccctaagaaagcttccctcagtgaagcatgccaacggcacatcattcggtggtttcccatctcttgaggagttcgagcttcattcaatggagaaatgggaggagtggacagaaccagatgcagcagctcatgcttatgggttgtcgcttttccttggacacctcaggaagctccatcttgcatactgtccatcactgagacgtttcccgcatcttccatgctttatctgcattgaaagagctgaagatctccaagcctggaagctggatcctggcattaccagcatgttctcaagtcttgtcatccctaataaccttggcagtcgagtactgcaaccacaacgttgtaatgtccgcgcaacagttcaagtccctagaaaatattgagcttatcaaaagtgaagggctacgtttggctgatggattccaatactttagcaaactgagaagcgcatgggtggagggttgtcctcaactcctaagtgccatcaccacctctgtctcagtgggctttggtcaagattgttgtgcggcacatgatgagaagcagcagcaggaagctagccttttaacccacctcagagccaatgatagcttgatgtatggtgattacttcaggaccgtgggaaagctcccatcactgcgcaatctgacaatctgcaatgaatcgaatggcactaatttctcggtcaagcaagaactgtggtttcagcaacaaaactcgctagagcacctctgcattgaaggttttcatgcattgcaacgtctcccttcattcttggttaccatgctctccattaagatactagagcttcatggcttgcgtggcttgcagtccataccagacaatgctctgcccctgactctccaagagttcaatataaacaactgtacttcgtgtttgagtactcgggtatctaaagatggtgccgattggccatatgttgctcatgttccatacatccgagttaacggaaccacggtccaaaacttatagacttttgtactgtatatatgaactcctgaaaaatctccgatacaaaaatagaagagaatggcttttggtattcagtaatccagtcaatgaattcttttacctgagccatatgtttccttgagcaggttgagtatatcctcgtagaaatgatatgtatataagcatgcctatgtaactaaagaaggtatagacaaacaaacaaaagttggaacttgatttcgattttcatatatatgatccccttgccacatctgaaagggcatcaatgccatatatgtgtttctgttattgtgtgtgcgcctcccgtgtcagtgcattatttgatttttaattttcagtcaaagcagagatcggtaaacagttctcctcatcattaggcagattcttttggtaaaagccacctacaacttccaacactgaattcattgtgcgagcatggcatctgcgattcctaaattttcactcttccctcgttgtgctccacagcaagctagcacttgcatttcttcaatggcatcctgacaaaataagacctggcattttccttcttaggttgtagacagggggctcaagcagacatcatactgtgactccccctaagcaggactgtatgtctgcctcctgttgagatgtagaaaatgtagggtgcttaagaacaaattcttgcaggtttacttccaaagcagaaggtattccgaagtgtgacaacctttcaaatggtttcatattttccgttatcaagcacaaattttcatgaagaataccagcacatttctcaagctgctcaacattgcgcattggatgtaaatcatcctactcatagatctggtaaagggaagctctgccagctcttaaacttttctcctaaaaccattccaaaaccttaaagccagtaggtaagttcattggaaaattacattttgtttcagatgcagccagccacttaatgtgtatactccttcccttccattcttcgacatggtctgctgctatatttccatccctggtgaccaacggtttggtactaaagagcaactgtagttgtcgagcagcaattcccttgcgagccacaatgcatgcatactcagagtttcatctgttgacatcatgagaagcttcttcaactctgaacaaatagcaggttcactatccccggtgacagggtctttttctaccatcaaaccagccatcttttagaccttgaaacattcgttcctttcgaaagggtgcatgtaaactttggggtaaagtgccaacctcattgttcaacctgacttcatgccacttccttgagacaaaacggagagacgtgcagcctttcccctgctgaaattaaaaagaaagaaaagaaaccccaatgaggatcgaaaccatcatcgtgttcttcataattcttctcctgctacttgtcatacttcctctgatatttgttgattatcttagccgaattcacttgaaaaccctttgcacggaccctatcggctgattggccagctgtatgtaccatattaacaggaaaaggattactatcgaccttcattggcctcttcgaatcatcaaacttgatttttcctccctcaatagccgtttggatctgctgcctgaagaccttgcagtcattagttgtatgagacccagaattatgccacttacaatacctcttcttacccaactcttcagccgatggaattgtatgtccggcaggaagttgaatctgtttttctcgaagtagcaaatcaaatatcttatcagccttggttatgtcaaagtcatacctctcctcttttcctgagttcttcacccattggcacggtataacctgtttgctcctaacccactcggctgcagctatttcggaatcatcatcctcctcatccgacccatacatataaggatagacatgattaatctccctagagttcttcctagcttccgcaaacctttgttcatgcaaagctaccttctgtgtaaggtgcgacaagctttcgaaattttcatatgagaatttttccctgatcggagcaatcatcccttgaaaagccaaatcggataactgggcatcagtcaaactcaagctgtaacacttattcctcattttcctgaacctttgaatatactcacgcaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttcacgaaagtagtcaccctggttctcctgggtcgacccatctgtaacacctttgtcactcggctgggctgatccatctggaacttgtttcttttctccctctttaaaagagccgatcccaggatcatcaggaaccaccttcaccttgtacttctaaacaaatgtgcccttgcgagtctgcatgaatgaacttaaaaattgatctcgtgcttgttgcatcattgcatcgaagtctttcttctgttcgggagtgagcttctctggatcaatgggcacaacgtttccttcatggacgtcagtcaaaccgagcttctggatcgtttctttaacattactcgggctggccgacgacggcgacaatggtggtttctcagccatgagggaagctgccttctgacttctaatcagtcccaccaggcatgccaaaagcgtgttgacagaaaacacgaggcctgggagatctgcttaactccagtgcaggtccaaaactcgccttcggatgtatgagcgtgccagttgatttgatcatgcaatcaacaagaaacaaagacaaagaaaccgtgattaaatccataaatgatagccgatcggctaaatgccgatgacatatcatttatctttgagccgatgtcatatgtaaatcgatcggcatgtgttaagtaaacaaatcagaattaaatctactcgatcggctgtagatatcaataatatataatccttatatcgatatatacttgaatcaagtgattgggatagatcggtcaccttgccgagacagtataaatcacttagatcgaaatatatattaataatgagattatacatatattcatagcatagccgatcagatagatctagcatgtatcggctaatactccgataccacatcgtgttaagatattaaagcaaatagaatataccaaacataagcctaatatacttaaatgcaacaagatcttaacataaagggtagatctaacatgtcaatcgatcatataggataaaagcaattagatcagataagatcggctgaaactccgatactaccctaatcggcaaccagtaggcaggctagagattgaaattcaactgatacaacattaagtatgaaaagaagaacaatatctagacaatcaagctgctggatgtttcgtagagtggtggatatctcatataatctaagccaacgtcgttatttaacctaatcggttgccttctggtaacagatgttagccgattgtaggttagatgacgatattgtcaaggattatgcaagatataggataacttgacggattacatgaacaagattagagtatcataaagatggaagcactaatctcgagaacacaaaccgtcataacaagttttacctcatgttgaagatcgaaaccgatgcagctcaacccgaaagtaagaactcgtcgaaataaaactaaagcaaaaagggtggtgatgcgccgaaattgttttgaacgtgtgtgttctcaattacatagggctcggggactatttatacccaagaattataaaatatgtccatattggacacgactcttatccctaacaaactgtaagataccataagtctttgcggcagacttttgcccacatttatctctaagtaatttacataaaatatcctaattaatagatacaattgccttcccaggactctatccatgcgtggcaatcatcttgaagcacatcaattcgaacccgatgtcgtacacaagttgtattatcggaatcggctgtatcacttaacctaatctgactcagacttagccgatcccaatcatagtcgatccggactccagccgattcttactctgtttccgcaacaacccttatattcgattccgcttcgatcccatcttcatctccgatgctgatattaccaaatttggtcgttaacagccgcagacgccgccgccgcatctcttgggtgagagccatcgctgcctctctctctctctcgatctcgatctctctctctctccaaaccgccaccacctagctcgttgcccacgccactgccacgccacggtcaaccgccaccattgatgaccgacttcgacgcggccgccaccgccgacgacgctgtcgccactgccactccgccgtccccgcctcgagctcgccacgccgccgcccccacctcgagctcgccacgccgccgcgccacgccgccgcgacgccacgccgtcgggcccccacgccgccgccgcggcacgccgccgccacgcccgcatgccgtcgggccggcccacggcgccccgacgccgctgccgcactgccacgcccctgccgcccgcgcccaacattgccgaacgtgaacgaacgtgattgaaacgtgaccgaacgcgaacgaacgtgaacgaacgcgaacgaacgtgaccgatacgtggacgaccttgaacgaacgtgaacgaaacgttaacgaacacgaacgaacgtgcacgaaacgcgagtggacgtgaacgaaacgttaacgaacgcttaacgaacgtgaacgaaacgttgacgaacgcgaacgaacgtgaacgaaacgttaacgaacgcgaacgaacgtgcatgaaacgcgagtggatgtgaacgaaacgttaacgaacgcttacgaacgtgaatgcacttgtaataaaagtgtgagaacgaacgcgtttagactaatacattttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagagatttaatataagattgttagacttagcatatatgattattacaattttaatataagatttgtagcgatttaatataagtttgttagacttagcatatttgattgttagagatttaatataagattggtagacttagcatatatatatatatatatgattattacaattttaatataagattagtagcgatttaatatgagattagtagagatttaatatatgattattacaattttaatatgagattagtagagatttaatgtaagattagtagcgatttaatataagattgttagacttagcatatatgattattacaattttaatataagattattagagatttaatataagattgttagagttttaatattacggttagcaaatacatcctatagacctaataaatattttttgtatgcacagatggctgatcgcgatgaggaacagatactatacgatacaatcgcagagggaagcagccagtactggaacgaagaagaggggaacgaggatccaaaccagtacttgaacgaggaggggaacgtggagagggatgcggaggggagcgaggaggggaacgatgaggaggctagtggaagtcatccctcctacggacagaagagggcacgcggacaacgaggtgccgcgaagaagatagagggtcggcacatcataactgaggtgaacgaagacggccgacctagtgccccggcagaagcagccaagaattttgtacgccacagcggttgggttgtgagggacaacgtgcctgtcagcacggtgtactggcgcagaacaagggcacgcggggataatgacagctttgtcccggactcagagaaagagatgctgtagaccacaatgctcgagacgttcacgctacccgcgggtacggagaacatagtgaaacagtggactctgaagaaaatggcagacagttccagagcttcaagggagatctctacaagaaatacatcctgaaggggcagacaccgaacttcgacacattcccaaagctaagggatcactgggacgagttcattgcatataagacaggtcaacaagggcaggcgatgatggagagaaacaaagaaaatgctgccaagaagaagtaccatcaccacttggggtcaggcggctatagcgtcgcaatgccaaagtgggaggagatggaggcaagtttgattgagaggggtatcaaaccagccaccgctaaatggccggatcgatcgaagttctggtactatgctcacggtggaacgcttaactcagttgatggctcccttgtcttcagcgatcagatacgcgaggctgccagtcgactaacggacgcagtggtagcctcttctcagggcacatttcgacccgacagagagaaggatgagctgtcactcgccctacagactccagagcatccaggacaaacacgagggaaaggcgtgattcccaggaagattggatttaaggaggacatccacacgtacaggagttggatgaggagcaagagagataccgaggcgaatattgcagatcttgagtacagggtatcgagctacgagctcagcatgcaagaggaggtggcaaggaaggtggatgaacgtatggccgcacatcggtcctaggatccccagccgtacattaatcctgcaatggtcagtccatcaggcaatcgtagcagctgcgcctcaacggggcaggtcggatcacagagcatggacgccatgcaaacccaggacgaaaccacctgcaccgttgatgagatcacatagtggacaccatgtgagctgcatattcccttcaagaacttatcaatcaaggtatgctcgtagtttgatgatttttgacttgtacattccgcaagttgctgcttaggttgattactaatagataacctcttatcacgtgaaggtggcgtcgggaatggccatcccaacggacccttccgggacttaccactgcaggccgattccagcaggatactctagggtcgaagttgagctggtggaagccgcgtacgaggacctcaagttggactacccaggaggagacggtgagacacatctacgagacacaagccacgccattatactatggcgcaagtggtacatcatcctccctgggcgacaagcggcgtctcgtgtaccatctcctccggctccgccgtctcctccgtctcctcctgcaccatctccttcggttcctccgccacgtcctcctgcaccatctcctccggctcctccgccacctcctcctgcaccatctcctccggctcctccgcctcctccacctccacctctaccgtgtccgcctgcacctcccaagacaaggtctcgccaagctccacctcctgcccgcacaagggcaacgaagaaggtgaaagttgacgccaccaaaaataaggagccgccgtacgattgcagtcaagaggagcttgacacttatgtggcaggagaagtgaaaaggcaactcaagcctcggagtcctaaaaagaagatacctattgacctgagcgtgaagaagttcttccagggaatgtccaccgcaaacaaggatgccttaaagctatcggactatgaccgaacacttaggaaagcctattacaagaagtccaaaccagttcctcagcttggagaacagccaaaccaagaggtcaagtcgttggtgaccggcgaagactttggcataacggattttatttcggacaccggtctaacggtggatcagttggttggagccgcaccaatcccgaaggcggaagtggcatacaagtttgaactcggtaaaccgcttgtcaggcctgagcagctgcagtccctaccgacacaaatgtacaaattccatgaacggtacatggaaatgagcgccaatggtagagaggtgttcggagcgaggattagaaactccaacttcttgcaaggagaaaatgttctatggatccatttcaaggatgtcttcgatctgtaccatctggacgccctcgacgtctctcttctgagcgcatggattttgtaagtatctttgagttcgatttgtttcgttcaataattagctcctggcatatatgaaaacaataataatttcctttcatcgttgtagaatggagattcaaagggcccgacggcggggggtttacgatactgggttcatcgaccctcggaaaatcaacaccgaaatgatcgacaattacgagaaagacacagaggacaatctcgtccatctcctaacgcagcagcatttcaagacgttcatactactgccgtacaacacagagtgagtttttattgtcgtttggacaaatttcattcccatccatataacatatacattctgatatttatcttatctcacgcatattccagattccactgggtcctgttatttttcgacttggacgcatgcagagtcactgtgtacgactcaatgaataaagaggagaaggtttttgaccaggtcttccaactgatagacaggtaatataatgccatctattccaaagtggcgggactctgttgctattatgttgatctcgagtaataattaattaatcatagcttgcaactgcacatgtagggcttgggatcggttccgtcaattggtccgcgagacttgaaaagaaaaacttggacggaggtttcattttccagtgagtacatgcatgatccaaaattatattgaattgaatctctaattacagttaatataaagagtatattaaatctctcattttttctcatgtagtgtgcaaagcaggaccagggaactaacttatgcggctactacgtatgcgagtatgcccactgcctatcaaaccaaatatacaccacacgagaactcgatgtacgtatacataaaccattcaaaatttcattgcgtatcgatttgttaagttgtttattaatttcatatattgatatgtcattatttttcgaatgatagcgtattcacatgagggaaaatctcccacacaaggattttatcacggctgttcaagaacaactgatggggttcatcaacgaagaagtccttaatcccgatggtgaattctactacgacggatcgacaattcataacgtcggtccttcctcttgtgacataacgccggcgtcgaagtcgtagctatagctagcgagcaaatgaattgtactatacatgcatgtatatatatttatatatgtacgtacatttactttagtgttaatatatattttggtaacatatatgcacataaaatgttaagtgctttaaattataaatatgtgtgtaatatatgtatttatacatatacacatatgcacatatatatatacacacacacacacacacacatatatatatatatatatatatatatatatatatacatatatataagcacatatatatatatatatgtatatatatatatatatatgtatgtatatatgtaatcaaccatgcagcaaacatggccatgcaaatcaccgatctttagtcccggtccgtgttaccaaccaggactaaagatcgatctttagtcccggttatttcacccgggactaaagatcgctatctttagttccggattcgtagtcccgattggacaaccgagactaaagggggttacgaaccgggactacaaacggtttcccaggtaacatacacatacaaaaataaatatatagaaatggtaactggcacgtacggcgattccgagagcaatttggttgtcgatgttaggtggatctttgcctgggattggcgtaaattccctgactgttggactggcgatggcgaggtagctcttggagaattcagagggtcccaccccaactttccatataggaagccacgccgatgctccgtgatatggcccattcactccatatgccgctgcaatctgcgcacacatcatactaatccatcaccttatatatgtttaatttgacgattaaattaatataatcactagtactatactctcttcgtctaaaaaaaatcaacctagaagaagatttgacatttcctaatacaataaatctgagctacctttatccaaattcatgatcctataaggggtcggattgagtttttttttttcctgacggagggagtatagtagtattattacttctagattataattattattgccagcttcatcatgaatactgtttggaggaggtcggccattggagtagaagaaatggagggttcggtttgcatctgcagtagcagtagcagtagcaggtgtccttcggattgggatgcttccttcagggcacctaccgcttcgatgccatgcctgctccgcgaatttgaacgagttgtttcttcccaacaccatcatcttctcaactatcttgggacgatccacgcttggtttcaactgaacaatatatattcatcacatacatcagtactagtagctcttagactgcaattagttcttcgatcttaattctctccttaatttactactccctccgtattttaatgaatgacgtcgttgacttttcgaccaacgtttgaccattcgttttattcaaaatttttgtgcaaatatgaaaatattcatgtcatatttaaagaacatttggtgatgaatcaagtcacactaaaataaatgataattacataaattttttaaataagatgaatgatcaaacgttggaaaaaagtcaacggcgtcatacattaaaatatggaaaatatggaggtagtattactttctttctaacaattgcatacatacatatataaatggtcgcattccttaaaaaactattataatattctatatgttttatatttaaaacattttgattttgatctttccatctctcgtctaaatttgctaacatccatatatatttgggtatatatatgaaacatatacatgaatctattcagaacctaaatattttgtagttataattataacgtgaagagaaagtagtaatcgacaatgaaaatgttcagacgtatgtacagcaccaggattttatgatctttgagcaatggattcttgaggcttggttgcttgtatatgtccacgcagtcaataatatcaccgcactcgctctgtcaattagaaaccaaagtgagacttaattagcacatgaaacttttttggggggtaaggtcaatgatcactggaaaaattactacctggaccaaaatgacctcagttgttcagctatatataaattcatgaattcaaccagatcgagtatatatcaagatgaggaatattagatttgagaattcatcttgtgtgattaaaattaaacagatttatactatgatatatagttaatagatatctgccaagtagtaacctaaccaatcctaaataaagaagattaacataatgtagaaattcttacctctatggtcttgataatgtcattgggatcgatttgtacaccatgaacagtagttgtcgttgaagccaacaatatgctttgctgcaaagaatgcaagaagagacatcattctctaggagtcgatcttcaggacagtcgaggatcataccgttggcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaaataccataagtaggtctgctggtaaaattcaaatttcgaatgcaagtgtactaaccatattttggtggagaaagtccatttttctccctcaactatagggcggttttgggtcgtgtccatcaatcctaaaatcaggtataaagaccccctcaatcgttaaaaccagatcaatttaactccctaggcgatgctaatggtgaggtttcctcctctgtggtgttgagtttacgagtcactttggcctagtttttatatgacgtggcacttacctaccattccaataataaaataaaataaaatgttaaaaataggcaggacccaatgtaagtctcctggaaaaaaaatgggatcctcccctcttatctccctcctactcctctctctcaccctgcgagtatagagagagattgccaccgccactccactacaagtgtactcctccgttgcaaaaaaaaaactaaacataggaggggatgtgacattttctaatacatcgaatctggacaaagggctatccagattcattgtattagaagatgtcacatgcttgcctaggttgtgttttttgggacggagggagtacacaagcgtataggggagggccgccatggatcatctccgagtggtacatggccccgtgttttatgctactgctaggagcatgcctcctagggtgtaacctccgccacctggaagccaaccctagctcgccaaccgtcaccagaggcatgccaccgaatcatgctggcagttggaacggagagggccaaggagggttggctcacttcggaggaagagtcactcgagttcgacgtggtgatggcaagcgtggggctcgagctcgagcgagatgttgccaaggacttaaggctcggggagctgaggcaccttgccatgatgtcgatggtgcaactcgacacaaggagtagcgcggggacagagcaactgcttggaggtggccatcgagtcaagggagtatagtatggtgtccagttcccactggcacctctatcaccttctcctcaatcacatccaaagatgtcgtcgttgtcctggttaaccaccgtttgagctcaactaccaaaccgaaccccatcacttccctatctttgagaagatgccaccaccacacaggctgccttcacagtttggcgagggaaccgagagaaaaaagagtgggaagggaggagagatgtagtcacttacatgtggaccctatatttattttgttaatttctttgatcaacaaaaagccaccatagttgagggagtcattttgcatcagctttaggccatctttgtttaggcttaggcttattggcttagacttttaagtcagcttattggcttatatgatttataagccagtgaatttaatgtcctaagtttagtggtgaagtcatacatctatcttatataagcaaaaaaaagcttctccaacctagcttttggcttaatagtgtaagagtggcttatagctttaaaaaagccaaacgaaaaagctgtttgtttgtttaggcttaaactttttggcttataagttggcttataagcctaaacaaagaggaccatactctcgagctactagccctacctaccttgcaaatgtatgagctagttcatcgacctcgcgtcgtcataggatctcgccacgaagaagaaggaccctctaaccggatgtaatcatacatgacgccgaagaaggggctcaacgccctcgtctgcgtgatgaacaccacattctcctcctctccctccaccagcatgtaccccttgatcgcgaactccaagctccactgcacgccgtgtgccccgtgccgcgctatcgcgttcccgtcgccgaacgccgccgccgtcgtcaacgcctcgtccgcccggccgttcaccaccacctgcaccctcgccatctgcgccgccgccagctcgacgcggagcgtgtaggtggcgtccgccacgacgcgctccagcctgaaccggatctgcctcgtcgtcgccgcatacccgtcgccttgctttctgcacaacaaggaaagaaaacacaattggttatcttgatgattcttcagaggttaatcgatcgagaggaaattgattgattgattgattgttttgttcgttgttgtttaattaccttgtgacgtgtgcgaagaaccagtccttggagatgtcgctctcgccgatcgtgaagacgagatcgccgtcagggtatagctcagcgtacctctcccacaacccgtactgcctgtacttgtctttggtgatgaagatcttgttcaggtatttggggttgggatcagggatgaagaactctgctgcactcctgtcaggaacacccatctcccacagtgtcgggcctgatcttggaggctcgaacacaagatcaccgaggttgatgccacgtcctgcttaaattcagacaaacaatggtagttaaacagagttgttctgatccagattatcatgttaaatactccctccgtttctaaatgtttgacaccgttgactttttagcacatatttgataattcgttttattaaaaaattttataaaatatgtaaaactatatgtatacatgaaagtatattcaacaataaatcaaatgataggaaaataattaataattactttttttaataagacgaatggtcaaacatgtttaaaaagttaacgacgtcaaatatttagaacggagggagtaataccaaatgccatctgaattagtgctaacttaacctggtgttactgttacttgcgaggtgtacatgtagtccccaagaaacccaggaacccatgcgtagaggttgtacactcctgctctcacattactgatgctgaagctgccgcagggcgttgccctcgtccagaattggtagtttttgctctctgtcacccaagaaccgggttgtccaggagtggccaagccaacaaaagccatcccagctgccatgtccttactgctcatgtacctgaaataaaataataattaacatcaaaacaaacacattatcaacgtttcagagatgatgatccatgaacaatcttgacccatgaaatgcaagtcatcatgtacctgtgtggagttgaaactatgaaagtaatgaatcttacctgtctctgacaaatagcctcccggtgactgatcctctctgacttgccttgtggaagtcaggggatacagggaagctgtatggccatttcctagcttcagcttctgcctgcaacttggcatccacccaaagcgaatgcagatctcctctcctcggattggagttgaggtagatgaacaccgggcccatcaccttcttccagtactccccctcctcaatcttcagaacaatgtcattcccgacgtaatgcgtgccaagaaacatctgacacgaaccaaaatttcagttttctctctgtaccaagattccaagtgcagagttcgttattaggaatagtaattgttttttttttttgcggggaggaatagtaattagttgtagggtgaactgattgatcttactgtcagagaggtcgggccgacatgggaggtgagctctcgcttgagagggccgccgctcttgaactcgttgctgggggtgatcacccagaatcccatggggttagggtgattgctgctaatccatccatgaactctgttgtccttgttgtccagcgagtactcgtacttgtcatccacctagtacatcacaaattcagaaaatcaccagatgcatacatcaaacagtcgattaaaagatgacagcctgattaatttggcgtgcaagatgtttcagaattcggttagttaattacctctcctctgaactgtggttccttgggatcaacgagcaggacagcctccttgtatgccaatggagcaccgcgaggtgcatctctgtctgtcgcactcggcataaacctctgtatatcgtctgagatcgccatgtagttgaacctgacaaaacgttcatgaacacatgttttcaagattagactgcagatcaagcaaatattgaatgtcttcagagaacaatttttgagaaggaatactcacttgtccgtgttcagtttgaaggcgaggcgagcctctgaaatgttgagagcaggccagtccctgacatgctcaaagatggcatagcagtagaatcctgagctacctttcagcatcacaagcctgcacaaattttagagcagcaatcgtaaaatggcagtgatatttgtatactaccactatatggcaggataaattatagccaaatttattaatataggtccgaaaattctaaaggagtacctcttgtcgatgtttagcctgacactatttggacgtgatggattgtaggtgctcctgaaggaaagctccacttgatcttcacttgaggatactaccttgaattcagtactatccagcctgtgaaaattcagtcatttagttcatcctttttgagagaaaagcataattcgttcagctgtagcccgtaataaggtgcagtgcatactattttacattactgtgaaattatgttttccagaaagaaaatcatttgagctcttgtacatatcctctgtttattaggcagtaatttctgacggtgtttaacaccgtttgcttatcagaaaagaactgaagtcacagttacaggttgctcttggtactattgctattaggaggcatctttcggtgcagagtgatgaactgcaaaggcttgctcatattttactcacaacaagagcttgtttgttatctggcctgaaggcaagttcttcaatccatatgaatatgggtggttcaaaagaaataatattgattacaattaacaggctggtagctatatgttcaagtggtgttaaatcgaactagtactgttatattgtggttattgggtaggttgatcttgttaattatgttatgagctgtaacagatcaaggcaataaaacaagaacactattaactacagcaagctaggcaagtacctgctcactggctggtagtgactttcagattatgtacctacttcagttgttcagttagaacgagagtattagtttatccaactttctaactgacatttattttgcacattccaagtagaaaagtggtataaattagaaataaattgagattgaacagtagtcagatcatatatacaaatgtggaataagaacacacgcaaagatgatgattttggatgactctaattaaagtagcatatggatgcatccttttcagtttagaacaaaaaatgaattgaggaccttaaacacaggaaagatcaaagcgcatgcatatataccaagcaaagtatagttagcaggcgatatataaatgacttaatttacaataaagttaagaagtaatgacgtacatatcgatcatgcctcttggattattggatccggggaaattccataccacatcccagtacctgcagacagaccaagatcaaattaattatatatggttagatgtaactggtatgtaacataaagatggcttttcatctatcaagggaatatcatctttttttttacatgtgtcatctaagataatcacaaaaaaaaattaaaaatatgataacatagattaatataaaatatatataatttcacaaatatgtaaggctaaattcaacttttacaagttgcaatagaaacaacaaatttaactgaaaatagttatcgtaccataataattatatttgttatttttttataacatgtagaagttgaatttgaactttttgagaaaaaaattaaaaaaagacaggcaggtatgtactaagtatgttttgagaaattgaaagaactgagtaattagttaaagagcaagaaaactatatatagtagttacaccgatggagagatggatggagtgtaatataccctgcggagttgggttgtccgtcgaagcggagcaggttgcgttcgccgttgtatcggacgccggtgatgtggcccccaggttttgacagcgacacctgcacgatgccattgtccaccatcacctgcatgcatgcagatgcagtatatatcagtcagcttaattaaacaacgtacgcgtaattcggtcgaaacgcatggatgatctgatcgatagctaatactaactgcagatcgctaatataattaagcacatacgcgtatagttaattacctggcggtggtcgaggtgcaaggtaacgccgccgccgccggggcgaggtcccttctccggcacggccgcgtgctgcggcgttagtgacgacgccgacgacgctgcgacggcgacggcgacgagcaggagcagcaacggcagcttcgtgcaggccgccgccgccgccatcatggacgatcgatatatggaagtagagctagctagttggacaagtgacgactaaagcgcatgatcaatcgatcgatggatatatgcgtgtgcaaaacgcgctctatctatatatatatctatcgatcgatcggctaacttatatagtagttcttgcttccatttatcgatcgatattgaagcatgggcggctgggatttagtatcaagtgttggttacggcgccggaaagacgaactttaaaagaatgggaaataatgatggatgatgagtttggttgttctagccgtgcaagtgcggtgcgtcgtcgtcacaattcttgcctttagctcgatctcttcgcagttttgtttgttacaccaagccgttatcttgcttttgctctgcctctgatcatcgacgatgcagacactactacgcagttggatgcaggtctggcctccttaattatacgtagcagcagctaacaaatatttaatacagaaggaaattgttggtctgtgcaatttgccttcgattatattagtcgtcgttgtcatcaagtatacatgtaagtacgtgcttgactcgatcgaatcaaattaaaccacattgtgtttcagcttaaaattgctacgtacggagtagttgcagtgggattaggtacatatttaggtaaggttcgtaccgtactccactccactaatcgtcctgaaaatttctcccaaaaaaaaggactggtaatcgtcagcataagcatgcaatgcatgcagccggccgctagctacacgggctgggccttagtgggctaatgggcctagcccaaatcaaacaacggaaggactaccgctgcaagcaggctttgcctttaccggctttaaactagttaggcagtttgggctgccccaaataaaaaatactggctaactatcttacccttatacggaattgctaaccttgtcgactcgatagaaaacacatctccaaatcttacagatttttctccaaatattacagattttggaccactggataagctttatgattcgtgctccaggcattctcctccaacttcggcgacctcctctttttctccggcgtcggcaataccctaggctccggcagaggaccctacgggttagggtcccgagttggggtggtggtaggaggggtgggagagggagggggaagagggtggagttcgccagctttagagggatggtcgtgggaggcaacagtccggcggtgggcggcgaaggcggcggcggcgccgctaaagctgcggggtcggaagctggcggtgggggcaaagcggaaaggtagataggaggcggtcagtggtggcgccccaccttcggagacgaggaagacgacagcgccgccatcggcttgaggaaagaaaaggaaagggaggggaaggagagggggaaggggaggggagggggctggccgggtggcctcaccggtgccattgacgcccttcggccagtcggcgagacgggcggcggcacagtggggcgctggcggcggtggatcgagcagtggcgagatggaacacgcgagggtagcggcggcggcggaatgcgcgaagaggaggggaatgggaggaaaaagttagagttaaagctgtgcatgaatcctaaagcatattcaacggtccagaatttgaaagatgagaggtgggattttctgttaacagatgtatagacagtctcatatttataacatcacaatttctgtcacatcttctttatagagagagagagagagagttgtttttacactataaattatacgtatacatttacattgtaattgcattgtaaagtttaaaagttgccatattattataatatttatagtactcactagcataacataagagaattaagagataaaaacgattatttacctacttggaagaagaaaagatatactccaatgataggaaaatatataattatatatttatataagacagatgtagtaatcatatatatactcactccttccaaaaatctgagtcctatttacagtcactatatgctaaattaaattgttaatcagaaaacaagaagccattctagtacttattggttgaatgttcattggttttgccacatggtgagtgagttaattgctttttggttttgatgaaaaaagaaataggtctcagttttttggaaggagtgagtaataaaaatattgattgaataactgtaaaattaaagtacggatcagtagcactttttttgtacattgatgcaaatgcagagacgatcgactacaccgaacgatcgactacaccgaacgatcgatgcactgtgttttgtttgcatccatgggaccatggctgatacatggcgccatggcccagctgcatgctgctagcagactagcagtaggatgcccttatattggagtactagctagtagctagttctatcatggagatgggggcaatgcaatgttcacgtctccaatcttgtcgattaatgattaatcgttgcctcctgcaggttacttacgaccttgcattgcatgctcacgtttattactatgcacatgcataatccattatttccatcggtctccctacctgttcattcacgtttgtggctagctaggcagtatgatttatatatgctcaaatctgtatctactatctctgtttatcctgcaagctagtttcagtcaaaatcaaacgtattacctccgttctaaattagatgtcgttttgattttttttccttaaaatgtttgaccaatttgaccattcgatcatccatgttatgtaaaaaattagtgtaaataaaaaaataaatcatacttaaaatatttttaataatgaagcaagtaaaaaaataaataataatatcataatttttttaaataattacaaacagcgactcaaaagagtaagtacgacttttgcggcatgatctctctctttccggccggccggacagatagattaattagaatagatcagcatgcgtatgcatgtacttgctgcaggtcaattttccggtgtagtactgtagaatggatatccgcatctctgtactgcccagaagggaattaagcaagacagagatcacctaataataagatatcctaatatatatattctgtttgtgcatgcaactcgtgtgattttgaaaattgatatacatgcatgtatgctaatttgtttagtaggacgaagacgtactcgattatgttaaatgaatttttttagcagaaggcatttccattaaagaaatgtagctcgattatgacatgatcaacgactaatggtgattggttagctggctgaaccccagccgatcggctttatccagagcagctaaactagctaggagcgtcgacggccatgcagacacaaagcatcattgtactgtataaaaaaaaatcttcatccattttatattacaagacatttcgttcatatttatttgaatttaatcaaatttgtaaaaaataaaacactaatacgaaaactatttttcatggccgccattttgggttttcgctgacggaattcctagccgccacgaagcaaaggccagtgaaaatcaagatcttcgctagcggttatcgaccgccagcaataatttatttttgctggcggtcgtcttaagctcgccacaagacggtcgccagcgaaaatgttttttcactggcgggtttcactgtgccagccgctagtgaaaatgctggccaatttttttttaaaaaaagcgacggacggagctctatccgcctccgtcaatgctccaccattcaaaattttcacagaaatttaaccacgcattcaaaaatcaacagaaaattacatcaacaatttacattaaaaaatttccattcacccaagcattcaagcatcagaaaaaaaatttgaagtcgtcgcggcgctgcccccgtcggcgtcagcggcagatctggcctcccaggtcgtcgcggcggcggatccggcctcccaggtcgtcggcggcggcggatccggcctccccgacatcgcggcgaccggattcggccgtcccctagctagcggcagcccacggcggtggtggcgacggcagctagcggcagcggaggagggagagggagaaggagagcccaccgccggacccgtcgcccaccaccgcagccggcccccgtcccttccccgccgctatcgttgccctttgccgcagccagccgccgccccttccccgccgctgctgttgccccagatctggcaagagggcgcagccggccgccgctggggagaggtgggagggagaaggggagcttgctgccggactcgtcgcccgccaccgcagccggttgccatcccttccccgccgctgccgccacccccatatctggcaagagggcgcagccggccgctgctagggagaggtgggagggagaaggagagctcttcgccggactcatcgcctgccaccgtagccggccgacccttccccgccgctaccgtcgccctttgccgcagccagccgccgccccttccccgccactgccgtcgcccccatatctggcgagagggcgcagccggccgcaacctttctccgtttgccacaaccggccgccgctggggagaggtgggagggagaaggctaggagggagaaaggagggagtggaggaaggaggaaggagacgtgggtggtggaggaaggaggaaggagacatgggtgggtgggggagccgaggagaccgaggagacgtgggtgggtgggtgatttttaatagtgatgcgttgggcaggcggtggatttttagtagcgctgaaacatatttttttgtagcggtgctcttcacggtccgccacctaaaatcggattttccgtggcggacacttaagaggtccgcaacgaaaaatagagtttcttttatggcgaaccttttagcgtggccgccaatgaaaattggttttcgctagcggtccgtaactcccctcccctcgttatatttttgctgctggtttttgcgtatggccgccagcgaaaattatatggtaacgccatgaaaaatcgtttttctagtagtgataataatatttttaacacaaaacaaatatactatatacttcctctgttttatattataaaattttctagcattattcacattcatatatatatgttaatgaatctagatatatatattaagattatattgatgtaggtaatgctagaaaattttataatatgtaactgatggagtatttattaaagtgttttataaatatgtgatatgaaacggaaagggtgtatatattaattcgctcaagtcacattcgtaccttagcgtaccgcctaccgcttacgtttccgcgctgctggaagatagggagtgtatagtcttggacaataattgagaaactaaccgagaacagattagtagctaagctaggattagaattgatttgcaaatccctttattaataaactggggcctccgaccacaataatgcaaatgacagatggccggccacataatcggatcacacctagctttgcatgattggatcgtacctacgtacgtacatcggtcaaagatctgatcgatccaccgatcgatggataccctatcccccaccctcaatcgaaattcgtacgtacaaactagctcgcgtctcgcgacgtcgtgcataccctatccagatacgcatcgactgatgttgcaaatactaagcgcaaggtcaataagaagaaactataatcttcgatatatgtccatatcagctaaaataaactagcttatcatataaatatcatgttttctgtcttttaatgcacgtacgataccgttgatttttgacacaagttaacaattcgtcttatttaaattgtttacgtagttatcgtttattgactctggtgttgggcacaattacaaaggtgtgacgaagacggagaggtcctaaaagttgcatgccgcaagcttgagtcgacggttatgcagttttttgccaattatgagtggagattcacaaatagacttcaataatatattcaccttattatttattggttcatttttatctttccgtgatgtttgctttcttttttgaactacactcgatgtggagtgctagattgtaataatagattgtagctctcttaagcaaagaccgggatgttatatttcattatctaaaaaaaagttttgttgtgagttattttatcactgaaagtattttgagtataatttatatcatgcattttgcacaaaatttttgaataaaatgaatagtcaaacgtgtataaaaattaacactatcatctattaaaaaacaaaatagaggaagcactaactagcgtcatctagcatctcatctcacttgcacttaggcttgtggccatttctttaggctatgcctaacactccaaggtagagcatggtttcaccaattcacattggtgccgagctactatgagggagagagagagagtagaaaaagagtgtggcttgcaaaggggctatgtagcctataaggacatggtgatttgagagagaaaagtagtggtccccaaccactgccattgttgctccatacaccacatcatccgctcgaattaatattggcattcaatgtgcggtcatcggcccacaatgtctggatttgcactcatcaacgacgaagtagaacaagggttgcttcgatctgtgctagctctatccatcacagaggtcgatactgtcgcccgatctgctaaggttgagcaagtcaccgccatcgagcttctctcgtcccaccgagctcccctcccaatccgaggatgagaggatgctagtggtgatcagtgggaggagaggacgatgctagcatgggggaggacggtgtacatggcaatggttgggtgccgacgcatagaggagagagagagtgagtgatgcagatagaataggagtgggagatagattttatatacttttaaattttaggaagccacaaaaaattggactttcacaaaggtaagaaaatgaggactaaataaaaaactatcagaggtaaaataaaaaaaaatagaagttacctataaggctactttgtattgtggaaaaaacccagactttagcctaggtgacctttgggatcactcattgaagctttaggttgtatcgctaatcgcagcttgtatgtttttcttttcgtttggagctcgtgtattgctgatgactaaataggtagctgtgctccaaccaattttttcctatctccatctctactgacgttaacttcggctttttcaaaatagtcattcatcatagatgattacaacctctaataacataatgcacatgtagaaaagataaacaactttgtaagttcattcttttatgataaactatcgataccggtcttctataacttccttaaatatgaaacatagattctaacaatgcaacgtagttgattctcatgaggatccaatattttattttcaggagaaagtctctctaatccccactgagaggatgtttggttgatgctt

SEQ ID NO: 80315 - DNA, 14974 bp, Oryza sativa
gggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcgtgctcgccaagtcgccgccgtcctcgtccgccccttcgcagccgtcggaacccgccggagcttcgtcgccgtcgacaacccgaaggtagccgtcgcttccttctcgtcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgatgaagacgagccttcaatcgacctccgatgcttagaagaactagagtgacttgttaagtcgttgtcttagatcgttgtgttagtttgcttgcttaaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagttccccgttttcccttcttgtgccctgtccatgccagatggtgaatactcgcagcaacgggaatggtcccaacaaccccaataataacaacaatggagagaatcccactctggcccaagttcttgctcaacagacacagcttatgaacatgatgatgcagcaatttcagaatcagcaaaaccaaggaaataaccatgcacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattaccctgatttccagaaattagtggataaggctattcgtcaggaggacaagtacaattgcatggagcagaggaaacgtcggattgctcacttcaaggcacaacaggggagtaatcagaagccgcgtcttactttaggaccccagtctatgccacagggaggttcttcgtctgttgttcgtccgcaacgtcagttcttcaacaacaatgttggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgacgcgtgaaggttgtccctgcccagaataactctgctgtatcagcatccaaggctcgtgtaaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggtcagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcatgctcgccaagtcgccgccgtcctcgtccgccccttcgcagccgtcggaacccgccggagctttgtcgccgtcgacaacccgaaggtagccgtcgcttccttctcgtcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccgggtggttgttcagaatggttgggcctatacaacagggtatgttgtatagcgttggattaatattgtttaattattacttaactgtttcgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacattgactcccagtccgacgtagtaatcttggaaatcggcgctgatgaactgggagccgttatccgttatgatgcggtgagccaatccatatctgcaaaatatccccttgatgaatttgatggcgttgtcagccttgatttcccccgtggatgttgcctcgatctatttgttgaatttgtcgattgccacgaataggaatttgtagctgccctgtcctcgtaggaatggaccgagtatgtcgagcccccagcatgagaacggccagtgagagggatggtttgcagtgcttgcgctggtagctttgtgtgtttgctatgaaattgacaaccttcacaccgttgtaccatgtcgcaagcgtctttgagggcggttggccagaaaaatccttgtgaaaggcttttccgaccaatgtacgaccgacggc

SEQ ID NO: 80316 - DNA, 712 bp, Oryza sativa
cgtccaggaatcagccgaggtacacaaactgacaattgaatagacaaatccatcataataataacgttacatacttacaaaagaaaagaaaaaaaaaacagcagcggaattaacggtctagcgatggcttcagctccactcccataggcagtcaactggggtataagccaaacgtcttctccttctggatcctttatcttcaactgaggtttgattattattgcaagaatgagcatatgacatactcaacaagccacacagcaaatatgcaagtgcacaaggataccaaaggatggcataatataggctcatttgcaaaagcagcatttagcaaagatttaagataagtaaaacagtagagtaattaattagaaattttaatcaacactgaacagcacacccatgctgtacaggcccaaccatcctgaacaaccatacccggctgtacagatctaactccaaaccaggagctaaacaaattattaccaattataacatccataattattgtgaaaggtgtgagactaatcacgaaaaacattgctcaacccgcctataaccgcgggcacggctattcgaatagttttactctggccagaggtgtaccactgtacccacaagacacgatttcgcacatgttgccatgccccgaaataccaccacggcattgcaaagggggaaaatcgtgacaataccctttgcacaacacaac

SEQ ID NO: 80317 - DNA, 25757 bp, Oryza sativa
ccttttgttggtgcacctttgtcatcatttgaaaaaaaaaatcgaacttaatttaaacatcctgctgatccttcactttcaccaattatcttgattggccgaggaactggtcttgcacctttccagagcttgaccacacaatcatcccaactctgctatattgtttgtacagcattattgggagctgcactccaagttcatcaatattgtttacatttttgcctgtgcagctaaaaatcttatgttaacatgacatgttcttatacatttataccctttatgcatatttgaagatgtgctacggaaagatactctcctttgacaactgagcaaaatgttggcgtttgcgttctgggaggtgaacagtggcgaagtaatactgatacggggtgctggccacgaaatgtaagaactcgccagcgcctcgatagacaacggtgtggatcttgatggctcaggtcatgctgagtggcatattggcctcacctcacctcttgttcactctaatatgcgtagtcgttcctcgtataattatatttttaattttgtggttaatttgcactaatatgtaaataaattgattgttgatatgactttggatatatttcaacacattcttctagattcatgtaaaaaactgaacttattttaggatggagggtgtatgtcagaatgcacattaatataacataaaagaatcattttttaaattaggcaactaaatagcaccaaatttactgaatacatgagtgacaagacatcatttctattcatccgttttagttttggagactcgcaaccacatcgcttagttacattaattaactcaggtaatcacataaagctaaaatctattggtcagttatgtatagactcaacttgcaactaactaatgagttaattgtatggattagatggctaatcatccggggggttaatttgcagcgcatagggatggggggtgccaggcccaccccggcacccccggtggcttcgccactggaggtggatgatttatttacacttgcaaaaattttggtgggttaggctacaatattgagcttctggcgggttagggcactatatgtgcaaccttgacgctgcactgtgctggttaaggagcagctgagcaggctgtagattaaggagatgtcctctggttctaaatcctcaaacaaataaagattttactgccaaatttgacttgggtcttttattgtaattctataaatttgagctgaccgtgcatgaaatgagaggactgaggggatggaggctgaaggggatcgtggcttccgattgtctctcggctattcatcgcattcattcaattgtgaaagatcgttatgaagttggctgccagattgatgctatcaaggagatcgctgctatgttcctgtcttattcttttaaacatgttgaacgcttgtgtgattcagcggtgcattatctggctcgttaatatgagcacacccgttgtaatttctatcgatttgagatcccgaactgaattcatgggatgatctgtagtgatgctacttaatcagtaaagtggtgtgattgccgaaaaagacgtcctagactatgtttatgtagtcatacctacggcaaggaggatgtgctgccattatttttgacctgctgtgtgtagtgattatgtgttagtgggggctcatatcagtcatgtaggaaaaaaaaggagagtagagtggagagagataggagaagagatgttttttaatgttattttgtatatgactgatatgtgagtcaaacagtcacgtaggcaccatcgtgacttgtcatacatacttgtactccctccatcctaaaatacaagggatttttaatggatgggacattttatagtactatgaatctgacagatttcctatccagatttactatgaaatctctcatccgtccaaaatctcttttattttgggacagagctagtacaagtttgtgggttgtccgtgcactaactaaaatcctaccaccgtaacgttagtacgggcatattactagtcatgattaagtgatcaaggacggctcggtcatgactaatcaaaagagaaagaacaaggagtgaagactcaagatgtgtgaatagtaatgttctttaattaggagatttccttctttcagaattaatacgtctgttccaaaataaatataattattaacgcagccatactttatcaaatccatacactgatgttacctttttgaaacaggatagccaaggataccagccatatttttcttttgcacataataatcatcatgcgctttaactaaattcattatgtgtaaaagagaggtcttctcattctaaacctgcacaataattagaaataagaattaatatgtgcatcaccaattcaaatcgagattgaaaaaataattctattcactaatacacacatgcggctaaaatgaacaggaaggtataggttcttcagaaaaatggtcatcgtatagtctccgatgaccagccagtcgtacccaattaatcatctcatgtccaaacacagacacatcttgctttggttatttaatgttctgatcgtacactatttgaaccatctcaataataaatttatcgttgtcatccgccgaagacttatcatctagtagcatttggaggaagttgcatcgacgactcatttctttgtcttttaacacgatgagggcatgtaaagagaggtgggacggcaacagtgagggatagaggggagggggaaaggagagctgacaggggatggtggggcagattggtgtcggggaggcagatcagcattgatctgggagtgcgtgggagaaaaattaccgtccgggcaaggaggagtgcctggaggacagcgcgatcctcttcagtacgttaatagcggaaaacggaaaactagatattcatgttggtagtttaacagaagggttcacttttactttttggaattcaatttaggctctctcttgaagagatgaatttttccacttccttcaatttaggaaacaaaaacaaaattttggggtgggttattcacattatgttggtgatgctcttagaaagaatgcgaagtacccgctgcctcagctggcatatttttattatgtcccatgaattcaaataagagtgacctcgttgcttgaattgatacgtttatacctgattttcttatctaatatgatgatatttggtgagacgatgtcacgccctgaagtttcccctttccgttgttttaaaaaaattgtttaataaatcgtccgaagaaattgttttaattaacctggagctaaatccctaagtaataaatgcaattaataattggaaatggcattgtgcgatttttcttgggttccacatgtcacaatacactaacaagatttttagtggaattttcagagccttaaaagtaattttaaccaattaaaaatgagcaaatgcaatatttaatcccaggaaaagtctttttcctttttctccatttctttcccttctttttccttgttgggctgtcggcccaacctccctccagtgcgccctccttgctgggccggccccctccttcccttcccctccccgaagtcctccctccctccctctctctctcgggcgccgacaggtgggccccacctgtcggtcgtccctaacctcctgccgcccacgccggcgccccacctccccacgccgccaccgtttcccgccttatccgtgcccccacaccgctcgcaactcgcgcccacgtcgccgcccacctcctccacctctcccgcgcacgcgcgcccgtttagaggccgggattcggtttgaatcccgtctctcctctctctctcttcctccccactcccccacgtcgccggtgcaataggggccatccccggccacgtcctcccctccctcatccataaaagcactctcccgagccccctctctcgtttcccccattcgccgtcccctccagcaccctctaccgccgccgcatcaccacacctgagctccgccgccgcccatctccggccgcgcgccgccgccgctatagccgccgctgcgccacgccaccgccgccgtcgtgctcgccagtgccgctcgctcctcggccgccgcttggttgccgccaatcacccccgaagccccgtttccctcgctcgccggtgagctctccattttcatccatctccggccggccactttggtcatcgcggtcgtcctctccatccctaactcctctcctccccttctctaggtgtcgccgccgcttgtccgaacctcctctcgccgggtcatcgtcgccgccttcgccttccgctccagccgccgtgtcgccggtggggcctccctccccttcctttcctcccccttcccgcaagcgctgagccacgccgctgcttcggccatgcgccgccgcctttcagctgtcgccgccgcttcctgcgccgcgggtcaccgtcgtcggtggccgtgcctcgctgccgcctcgccttggtcggccggtcggccttgaggccaagccgagcctagccggcgcctccctttcccttccccttttttgagccgcagccagtggggcccgcatgtcggcaccccctccctctccccttgtgctgctgacaagcggggcccgcctgtcggcgccgccccccttcgctgacgtcagccctgggtaatattgcgcaataaaattgattaaggatttttctttagtagtaaaaacacagtttatcttctaaaattcataagtaattcatccgagctccgattaagtctattcaagtctcagtaaattcataaaaatccctagaatccattaaaaatggttttgttcactgtttcagtagtcttatagtgtgttttgcttgtgtgctttgtttgtcgcgtagatttcggcagtttcgtcgatccgcggtttctcgaagacgttgctgtggtctcatcagtgcgagagcaaggcaagtcatgcattataattgatcatattgtacccaatttataaatatcccgcatttctattaaatgttgcattcttttacagtgtcatgtgggatgggtcccactacttagccatttattgtttaccttatgccattgataacttgggtatcaaaatgattagacgttcgtttaggaaatgcttagtcatgcttagctcaactagtacagaaatggggatcacattattacatagactttgactattagcatagttttggattggtgccaccgcaatggtgttagttaattaaaatacactgaatggtgggctgtgggtgcatggttttgctagtcgcacccatggcaattaaggactggttcacgggaaaccctgggagacttaccgtgcttaccacaagcgggagtgggtaactgcttgatctgaagtatagctcgaccctttcctaggcaccggtggcgagggtgggcgtgatggagttgggtcggccgcggtgtccggttgtccagctgccggattcaccgcggtgcaagaggggaccgcccactgcccgttgggggtgggggtgaaaccttagtgtggtgtggatggttaggggagggttatgcggagggtcttgtcacgatttccccctttgcagtatcacggtgatacttcggggcatggcgacatgtgtggaatcgtgtcttgtgggtacagttgtacacctctggccagagtaaaactattcgaatagccatacccgcggttatgggcgatcaaccagattcactgtgattagtctcacccgtagtttagtttaatgaactggtgtagtacaggtggttggttgggcttgttgcaatgtggtgtagtgttggacagtgattggttaatattgcttaattaccacaattgttttaccgctttcaactactgctttattgcaaaggaacccctagcctccttcggttatatcctgcatcatacttcctcttctggtatgacttgctgagtacagtgtgtagtactcagtcttgctctcttttcccccacaccagagctgaagatcttcctagtgggagctgtcttgtcgaagttggtttcgtcgctgccgtcaaggattgcctgtggagtggagtcgccccgctacaaaactcaagcttccaagtttagctcgctttatctttttccgctgcatctgtaatcttttatatttttgtaagatgtggatctgtatgtcaacaattgtcgtttgtgtaccctagctggtcctggacaggggtttaattcacattcagcttagaaattctggttcgtgaatttctgggcgtgacaagttggtatcagagccgaccttgaccgtagttcaagccaactggaaaccctaagagctttctgaaccccttttcatctgcatatgctctttgcacttggatttgtttcgggaaaatttggggtttgttctttgatttttgggaaaaatcctggtcgttcattcggatcggatctttaaaattagataagtctagggttttagaaaaattttatttggagtattcgacagtcagtcggggatatatcggatgagatgcattaggtcatgtctatgttcgatggggcaattttatgcacatcattttccatgcatctattttatgcattaatttattgtttagttagttacattagtgtctttatctgggattaggaaaaatgttctatgcataaaaatcatcatgcttggttatttatttgagtcaattgttgttttgtttaaatgtggatttgagcatgcgttgattcctatctcttgtctatcttaggtgtcagacctgtttctcaatcgcaagcgccgctccgagcttcagagtcatcgcccttagctttatcgtcttcttagtctgtttgcttgctagtttccgtattttaggtttgttgcttgtgggttagtcggcggtcgatattatgtgtcagtggtatggctgcctgtcacgcccagaaattcccgaatagaattccaagcagaatgtgcattaaaatccccatctaggacaggccggggtacacaaacgacaaagttgacatacagatccacgtcttacaaacattataaaagtcttacacaaatgcagcggaaaacttacaggataactgaagatgagcattgacagggaatgaagcgggggcaccactccacaggcatcctcgatggcacggacgaagcctactcctcggagaaaccaccatctgacgcatactcacattctggggtttggggaaaatagagcaagactgagtactacccactgtactcagcaagtcataccggaataggggtatgatgcagggaattatcaagggatagctataatggttcatttgcataaagcgggcatttataaacagaagatgaaagcagtaaaacagttgtaataattaatcaatattaatcatccactgtccaacgctataccccgttgcaacaggcctaaccatccacctatactattcaattccattagaataatctagggtgagtctaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgagcagtcccctctcgtgcctaggtgaatccggaagccgcataggccgtcgcaaggcccatccaaactccatcatgcccacccttgcctggatgcgtcggctagaggaaagctacactacaagcccagccgttgcccacgctggcttgtggtaagtacgaggaattcttccagggtttcccgcgaaccggtccttaattactctgggcgcgaccatcaaaaccatgcacccatggcccaccatttaatattaattaattaacaaacaccggagcggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccacggtgatattataaaacaacgtagtatttgaagaaaacaatggagcatttgcaatataggatcaacatgttaaagtgacaagcatgacttgccttgctctgcagctggaggaacttcggcgactatttcaaggtacaccggagcgtcgggagagccgaaatctaagcgacatacaaagcaaacaatacaaacaggctataagactattgaaacagagaacaaaaccatttataatggattctacacatttttcttgatttactgagacttgaatgggcttaaacggagctcggatgaattagatatgaattaaaacacttaaaacagcaggcaaatccttattatgacagccatatcataggcacatgatatcgaccgtcgactaaccctcaagcaaacagacctaaacacacaaactagcagacaaaaactaagcagtcgataaactaagggaaagcgagcctaatgctcggaacggctcctgcggtcggtggagtcgaaggcgtcctcctgctcgtcaccaggtccctctgagcggctcctggagtctggcagatacgtctcgccgctgcacagctccgagccacttgaactgctgctgctgtggtcgcggttgccactgggagtagcaggcaaccaacccccgttgccactggctggacccctgacggctgatgctggagcgaaggagagagcggacgcgggagctgacactggaacaggagctgggactggagctggagctgcaggagctgcaggaactgtgggaactgcgggaactgcgggcggaggtgggttcctgggcacaagctgaatgcgcacgggtgccgtcgtcgacttgcggggcgtgttgcggatccggactcctccgggaatggggagacccttcaactgagcattctccttcttcaggcgtgcgatctcatccttcagagctatgatcctcacgagcttcccatcattcaaggccttagacgccttgcgcagatccgagtgcatcctgtccattaccctcatcacggcacacatatgaccaaaggtggtgtcgttctcgccggctgtcggacgaaaggtactgacgtcatcgccacttgctcgacgagggtgaaaccggtacgccgtgttgcagaagatgtagttgtggcgctcccatagtctggccatcatcaggtatgctgcctcttgacaggcgtgatctgttgtgcctccggatgcctcaaccaccatgttagcgaggtaggtacccacatagccatgaacctccaggcgaacacggtgagggaatgtcacgaccggaaataacccaatgggcgttccttacgtgcatgtattattccttgtcccaggaggcaaggtacaccaaaagttgatacaatacagagtttaacaagcggaagcgtaaatagttaatttattacatgggcggcgaaggcctagcacacatgaagacaaacgaaaaacagcggaagactagggcgacgaccacaggcgcttgatggcaggcacgagctagacaccaaagccttcatcatccaggaactcctcttctgggtttgggaaaaattgagcaagactgagtacaaccaccgtactgaataagacacaccgacaagtgcagaataaatgcaagggagtacaagggagtcataatatagggggttagggtttgcagtaaacagcattaaaagacacttagttgctcaagctatttggtaaacacgatcctagagatatacaagattattaatcaaggccgtgaacccacacgaacctgccttaacccaaggcctacgatgattcagaccgaactggcaacccgaccctgggtcccagctcgtcccaagccaacccaggccaaccattccacattttagttgttaagtaggttttaagaattaaaacactaacttgggtacattgctaggcttgcccataaccgagggcgcggctattcgaatagattatactctgatcaaagatgtacatctttacccacaagacatgtcttcttcacgtgtaaccacgtgccacataccaccacggcatacggacggaagacatgacatagtttccaacccatcctagccatagacaagagtaccgacccaaccccacctacggctggaacctccgagacaggtaggcaggactgagcccctagcagcaggacaccagccctgtgccatgacatctcgactaccgggccgaagctcgtgtagccttcatttgccctagagatgtccatcgactcccgacttcgtccatctccatccgtgtacttttgtttataaccagactgagccacaaactaagccttacccactagacatgtggaagtacggtagtgctttgcaacagaggcccgaagaccggtccttatgtggccaaggtgctactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaatcacctaatgttgcctaattaaacagcgaagcatctacctaaattcatactagtcgtaccatgaatagagtatccactagttggggttttgtttattctagggtgaacaaggtaataataacaataacaataataataaggtcatacaaaggtaaataggcatggctaaataaaacagtgataacgcgggaatttaaataaagcgataatgcaataatttaaatcaaaataattttataaactgggattcaatatgctcaaggatgatgtgacttgccttgctcgatttcccaaacgtcggcttcaacctccacgaagagcggatcttccaaagctgcagcgtctacacgaccaacggaaaggaaaaaggcttttactctagtaaactccatataacaagcaggaacaaagcacaaaaatgggttcttgacttcttaaggaaaaattagagacttgaacggtccaattccgagttcaaatggccaagttatggccatttgaagtttatatgctctttaagtgaatatttgcgaatttctttatttaaattttaatttaaaaaggatttattgcatcagccgaggggagagggcgcacggaccgggtccacgggagtggggcccacgcggcagcctcacggtccatggtggaccgggcgcaccggggctcacaccggccggcgccgtgggccccacgcgtcagccgcacccgagggcgcgggcggctgacggctgggccccacgcggcagccacacggcgcgcccggaggcggccacgacggcgcagtcggcgggaggcggcacccgcgcccctatggtcgccggcggcggccataggcacagcggagcggcggccgagagaggggaagagaaggaggaaaagaggcggcggtccacggcttaccctgggtcgacggcgacgacaaaaaaggcggccggagcggaggaaggcggcggcgcagctcgggtggatggggacgacggcgctccagcggtcggcgagctcggcgagggggtggacggggtcgacggcgctgcggcgaagccggaggaggcgacgccggggcgggagacagtcccagcgagcggaaaaggccggccggaggtcgtcggtgacggaggagagagagggcgacggcgcgagctcgattccggcggggagacagcgcgccaaagggtggaaacaggcgaaggaggcgcggggagggtttaaatagggttggaagggggagagggcggccgggagaggaaggaaaccggccgagaggtccggccgccatcaatggcgccggcgagatttgcggaagcaaatccggccgtttgaatgcgagagagagagggaaaaatggggggaaagggggaggggatcacggggaatatttccccccacttaattgcacgcgggggcggcgggatgcggcggattcggcggcggcggcggtgcttggcgcgggcggggcggcgggagcggcgggaggatggggatgacgggtgggccccacccgtcagcgagggtggcgggcgggcccacccgtcagcggcgcgcgcgcggggagaaggccgagtgggccgcggggagaggagagagagagggggagggagatgggctgaaccggcccaagagagggaaggggacttttagggtttttctttttataaaacctttttaactttgtttatttcttaacaattataatttgtgctctgaaaattccactaaaatttatttacacattttaggcttttaggaaatatacaaaaatcctctaagccttatttgacttttactctgcacattttaatttttggaggctttcacacggattttaattattctaggcataatttaaaggatatattttagggtcgttttgggacatgacagggaactcgccactgagcggcggaacagtcgaatactctggcgcattggggtagtccaccaccagtgtcatgcgagccaactctgccacaaagtcatccatgccttctccgcgatggttgagtgggtgatcggccatctagagaagacaaaggggtaggatcaatgcatgctcaaatccaatttaaatgaaacagtaaaagactcaattaaaataagcgaataagagcggaattttatgcatagatcatttttgcatgaaggcgaataaataagacgaacttacatagcgataaaataatgagaaaattagatacatactaataacaataagagcataaataccttgcaacccatattcctgagttaggacctaatgcattcctcccatcaaatcccgactgactgtcgaataaatcccaagtaattttactaaaaccctagactgacctgatttggcaaatcccacttaaacgggcgaccaaaattttcccttgcaccacaagaacagatcccaattttcccagaacaaatccaattgcaaagaacatatgcaatgaaaaggattcagagggctcttaggtttttctatttggcttgtcctacggtcaaggtcggctctgataccaactttggatgtggtgtagcattgatcagtggagatctaatttactttaattactcaacagttttactgttttgctcaataaaaatgttttacaaccgcctttatgcaaatagccacaaaccgtccttgtgttccccttgcacgtctgcatcgttggtgtggcttgctgagtatggtggttgtactcagtcttgctattatttcccccttttcagaagtgtagtgcttctgagctgaagacgaagttagaagaccgaggctcaagaccccagttgagttttgcctgtggagtggagctgaagccccgctaggatcgccttttccgctgctgctgcttttgtttcggtgtgaggactaagtgcctcttctgtaagcaatttacgctttatttacgtttggaactatttattacttgttgttttgtgtaccctagctggtcctggacagggatttaatacacaaaatagtctggaaatttgggctaaatttctgggcgtgacactgccttaattaggagttgtttgcttcctttttcaatgttttaatcaagattaagataattgcacttaaatttataagaaagattagtttctaagcccctgtttttcttccttttctcatatttctacctatgccccttcagatggtgaagacaaggaatggttcccatgaatccaacaacgccagtggcagcgaagaatttgggaaaaaaaacttgtgataaaagagatgagaaagaaaaacatagaaaattatatgaaaaagattagaaaacttagttaatttaaattaaattaagtaaaacaaattaaatatttttttacaactttaaaatgatggggaatgaaaacatgaataatttgtggtattatttgataatctaatttgattattttgaatttggaaaaaggaaattgtgataaaagagatgagaaagaaaatgaattaaaattattgtaaaagaatagtaaagtaagttaatttaaattaaatatttatttacaatatttatgtggaatgaaaacatgaataatttgtggtattattttataataattatatataactattgttaatattgtttaattggtttgaatttcgtggattaatttttcatgattttgtgcttttcatgtagatggatcggcaatggatgcgcgcggaccgacggtcaaaagagtttattgatggcttgcataattttctgaaagtggcagaagctaacaagaagaataatggttttatccgttgtccatgcactaagtgcaaaaaccagagagagtattccacagttagaactattcgtattcacttgttcgagatgggcttcatgccgagctataatgtttggacctcgcatggggagcaaggggttcaaatggaagaagatgaagtagaagacgagaacattccgcactaggctcagtacggtggatttgaaggaaatacaatgtgcgaggtggaaggggctgacgttgaagatgatcttggtcagatgttgcaggacatcaaggaggactgcgaaagtgaaaaggaggcttagaaattagagcgtatgttagcggatcacaagacgcctttgtacccaggctgtgaacaggggcacaaaaaattgggtacaactctggaattgttgcaatgtaaggccaaaaatggtgtcagtgacaaggcatttggcgagctattgaaactagtgaagaacattcttccagaggaaaacaagttgcccgaaacaacatacgaagcaaagaagatagtctaccctctaggacttgaagttcaaaagattcacgcatgtccgaacaattgtatcctctatcgcggtgaggagtatgagaacctagaagcatgcccagtctataatgcactatgatacaagattagaagagatgatccaggtgatgttgacggactgccttcgaggaagagaattcctgctaaggtgatgtggtatttccctataataccacggctcagacgtttgttcaggaacaaagagcatgcaagattgatgcgatggcacgcagaagaacgtcaacaagatgggatgctgagacaccccgccgatgggtcgcagtgcactacagaatccggagcattcaggacgaatgcgaggaaaaggcctcgtcccttggaaactaggattcaaggaggacagccacacgtacagtagtcggatcaggagcaagagagacacggaggcgaagatcgtagacctggaatacagggttttgttgcacgaggccaggatagaagaggtggtaaggaaggtggacgaacgactggccgcacatcggagccaggaggagcctgtaatggtcagtccctcaggaaatcgcagcagttgcgcctctacgggataggttggatcatagagcatggaagcagcgctaactcaggaagaaaccacctatcccgttgacggaatcaagcattggacatcgtgcgagctgcatattcccttcaggaacttgaccatcaaggtttgctcttgtacttgtatacattccatatgtcgttgcacacatagtttgattactaatttataacctctactgttgacaaggtggcgtcgggcatggccatcccaacggatccgacagggacataccattgcaggccgattccacctgggtactccaaggtcgaaatcgagcaagtggaagccacctaggaggatctcgagttggagatacctggagaggatggggagatgaaactaggagacacaagccatgccatcatactatggtgcaagcgctacatcgtgtttcccgattctcgatcccctcctcctgcaccatcgcctccggctcctccacctcctgcatctcctccggctcctctgactcctccatctcctccgcctcctccgtctccgctgcaccgtcttcgcgtgctcctccgccacctcctccgcctgcaccctccaagactcgccaagctgcaccacctcctccgcaggcaccttcgaagagttggcaagcaacaccacctcctctagcaaagtcaaggtcccgccaacctcctcttgcaaagacgtcaaggccgatgtagaaggccaaagttgaaccacggctgactccctatacgaagccatacttgtgcacagacgaggaggttgacgccgcggtgaaagaggacgtgaggaagcacttcaagcctcggagtcctgaaaagaagattcctatagacccgaagaccaagaagttcttccaaggcagttgtttgcccagatctttcggtaagttaatgataactatgatttgggagacatgttgacgatccgactataaccgtacaagaagttgcgttgcaccttaccgatcgatacacctttccgtgggttgttgatcttgccagtgcagatcaaccttattcctgcaagcaaatcgaagaaacaagcaataacaagataaaagcaatcagatattgcaaataggaattgaacacaaatgataagttggggttacgaagaacaggcagacggacggtctagccgacacgcgtgctgcaagcaagtagcaacggctaaactttaatctaacaaaacccaagaaaccatgaaggggtaccaagctatttatggagatgggaggaccctaggtcgtcctctacctggttgaggcgcaccccacatgggccccacttgggccaggttcccagacgaagttacaagcccataggtattacaagagacgcaacacattgttccttcaattgcacatgactgacaaagaatttggtgatgaggtggatcgtttggaaagaagactccgaaagctttccatcgagtactcatgggctgaaaacggaggtcgtatgtagattcggtggccgtttgaagccagttgtgcagcagggggtcaaatcggattccagcacttggagggcttgaacttgatatcttgttgttcatccatgatgtaagcaatggttgtatccatagtagccatgatcacatcatcctccccttcttcatagaaaaccgtcctcgatttttccatatggtgctcatctcatggtcgatttaaaacaacctgtttcatccaaacaaaacaagacaaactcgaagtaatatgataagaaataacatgtctctctagcttgcaagttttatccacatgtataggaggttctaaatctgaacatatataaactctatgcaccaaatatatttctctatcattatattcaccaaagatatgaaaaatagcattagttggtcatggcaaatcagatttagcaaataatttcgccttcaaactatcgagctcacaaaaatcatcacactgaatatagcccaaagtatttaaagaagatgtcaattcacgttcctctacttcattagcaatgtgaataacatgcttaaaatcatcacataaagaactagtatgagaaatagcatgttcgttcactagttgtggcattgatataagtgaagcattatcacacaacacttctttatcacaaggaacagcaaacaaatcagtttgtgacaaaggaatctcagcagttggttccactaatggttgctccactttagcatgaaaagtggataaattcaatttattaacaacacactcaccttgattaattttagcaccattaagtttacctttgatgccctcttcagatggtggaggtgcctcgactttgagtgtgaacaatgggattggcggttcatccatgcctttgtcctcttttctatcattatgcacttcctgcaaatggttagtaatagaaggcagaaacatagcgtattgctttttcatgtcctcctctatttgactttcagcattgcaagcaagttgtatcaaataagaaagagatgtatatctttgacaatcaagcatgtcctgaatttctttgtaaagcccacgtaaaaacatcaattctgtagcttctttgcattcatctaaaccacaatgtaataaacaagcatgcatatcatgatagtatgaagtagcagttctgttatcttgttttaagcattgcaatttgttgagcaaaatgtcagcacaatacatgtgaacataaacatctctcatatatcgtttcaggtctttccaaggttatggtattttattatgcctacaaagatgtttccaataaaaaaagcatttttaataagaacacgagaggcactgtcacaccttgaagttccctaccttgctttaaattcataaaataaatcatccgaagaaattgttgtattaacctagagctaattccttaattaataaatacaaagaataatcggaaatggtatgtggaatttttcatgggttctacatgtcaaaatatgctaacaggatttttagtggaattttcagagccttagaagtaattttaactaattaaaagctacaaagtgcaatatttaatccctagaaattcctttttttcctttttctttctttttccccctttttccccctcttgggccgccatcccatttcttcctgcgctgccggccaacttctcccttcccctcccgaagtccacccagcctccctctctctctgaggcgctgataggtggggcccacctgtcggcccttcccctacctctagccgccgaaggagcggcctcctcaactgctgcccgcctctcccgcgcgctcccagcctcgtcccccacctcgccgcaccactcgcccatctcccgcaactgctaccccattcccgcccacgcgcgcgcgcccgcaagggcgggattcaatttgaatctcccccgtctctctctctctctccaccccacgtcgccggcggcatttcccctctaaatccaggcagttcccggccatgtccgccctccccgcgcatataaaatgcaaccaagcgtcctcctctcccttttcccatttttgccgcgctctcctacactctctaccaccgccgcgccgtgcaccgctagcgccgccgcccaccgccgcgcaccgccgcctccggccgcgtgctaccacctctatagccgccgccgcgccgcgcaatcaccgccgtcgcgctcaccgagccaacatgcaccttggccactgctcgcttgccgtgcgccgccgccacatcgctctcaccacgcaccgccacccactacttcctccatccgccgctagccgcggtttgctccaccgtcgtgccactccattgccgccgttggccttgcgaggtcgagggctgcatcgtccacccgctcgtctcgccgtccgccacttgccgccgtcattcgtcgtcgcccctttccgcgccggccaaccccacgatgagaactccctctcctccctctttctctctctcccgtgttcactgccgtccactgcgcgcgcgccgtcgccttccgcgccgtccgtcgccgcctcctgtgtcgccagttgccatcgccggcgaccgtgcaccgccgccgcgtcgccatgcttggccggccttctttgaagccgagtgtcacgcccagaaattcacaagtaatttccgaacttatttgtgcataaaatcctcgtccaggaatcagccgaggtacacaaactgacaatttaatatacaaattcatcaaattaactaaaacgataaatacttacttaagaggcacttagtagcggaaaataaaatctagcgaagctctggctccactcccacaggcagctcaactgaagtataagccaaacgtcttctccttcgcaacttgccttcaactgaggtttgattgattattgcaaggtgagcatatgacatactcagcaagccacacagcaaatatgcaagtgcacaagaataccaaaggatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacccggctgcacagatctatctccaaaccaggaatgtaccattccaaactaggagctaaattaattaccatcaattaccacattatttttaatgagtagtgtgggactaatcacgaaagacattgttcgacccgcccataaccgcgggcacggctattcgaatagtttcactctggccagaggtgtaccactgtactcacaagacacaacccaccgtcatgtcaccgtgtccgcgcagacacgtcaccatgacgagtgattatgacaagacccctcgcataactcaatccaaagcagtgcactattcccggatcatagtcacccccttataaacaaggcatggactccccagcgacccccgtgggcttatctccaccacttctcagtctagtgctccgcagggagccttgttatacaaagtgtccagccgttgcccattctggcttgtggttggcacggtaaatgtttcacaaccgaaaatcgtgaaccggtccttaattgtcatgagcactaccatcaaaaccatgtgctcacaacccaccattatcaagttttagttggcacattaattaatcaaccaatcacgattgaccatcgtgagctatcattaaaccatcattaaataatagtgaagcattagttatcccaattgtgtgctaatgtttctaagcatggctaaacaattatgtctaacatctagctgaaccaatatataaagctcaactagtcaaattataataatccaaggtatcaaggaatacagtaatcaatgcaaactggccttaacaacggaataagttcacaccacccggtgacattcgaaaataaatgcacagttgaaataaatagagaatttaaatataggatcaacatgctcaaaggaattgtgtttaggatctgtgtgacttgccttgcaataactggtcttcaaataatcttctcgaacacttccggcgcactcgcgaaccttcgaaacgacggaaacgacaagctaacacgcaaaacaaggaaaaagactaataaaaaccaaataaacaatacatataaagtaaacaaacatgtagatcataattttagatgaattatgagacttgaacggcctcaatctgacttcatatgaatttattacgaattttacaagattaaatctaattaaagcctatttaaaaaggattaaataaatttagttcaatttatggataattttaatatgtagatctttattttatacaacttttgcaacttgaaccacattaaaccgagttacaatgaattagttatgaattcttaaagattaaaccggattaaagcatttatatggattttaattgaattatgacgcaataatgaattatttttgaaaaggaaaaaggggattattgcgtcagcgggtcgggttcaaggtggaccgggtgcacggcggcggttcacggaaatgaacggccggaatcgatctatccaaatcggacggccaagatctaaacggtctacgaccgatctacggcggacggcgtcgatgacgtcagcggtgacgtcatcaccggcgacggctcggacggtgcatgctcgccggagaacgatggcgcggcggcgcaaacagagggcaccaacatgatgcgggcatcgaggcgaaccttaccgaggcacgaacggcggtagacggcaaccggacggcgacggcgacgaggaagaagcggcagcgaccttcggcttgacgacgacggcggggctccggtgatctacagtaacgaaggaggggcggacgaggtcggcgatgacttgacaatcacgacaacggctttcccgagcaacgacgacgactggagcgacggcggtgctcgactaaactcgcgatggcgacggcggcgcacagcttgacgcggaggcggcgctacaagcgacggcgggctaaggcgaaggtggtggcggagagaggaggcaccgggggtccttttataggggctaagcggcggcgacgaaggcccatggcgatcggcgacgagaaggaaagattagggttcagggagagagacgaatccgattcgaggtcgaatccacggatttccaaacgattttagccgacgattcaaaaagagaaaaggtagagtgaatctcggggatcattttccctctatcaatttcaccggatcgagaaagggatgaacgaatttggaagggcggcggcggcccggctcggctagggttcggccgggcaacggcgcgaggaagacgacgagtctgacaggtgggccccacctgtcagtggcgagggcgcgcgcggcagcgggctgacttgggctggggagagagagaaaggttttgggccgactttcggcccaaagccaaaaagaagaattttaaaaactttttcaatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaaaaaatcttcttttttaggtttttaagattatttctaataattccttttaaacaacaatttataacttaaggatttttaagcaagcaaaacatttaacataattataattagatcattaattgattaattcattgattaactaattactgaaatattctttgtatcatttaagaattgagctctgaaaaatccgagaaaatttcagagagtatacttaatcacagagaatttaataaaaattaaattcatccatgctttatatttaggaaattttatttcccacatttaacttcacttgtaaattaatgaacatttaatataaattctattaataatttattaaataatttataaatcctaaaacgaaaattcaggctgtgatcggccaagcccgacggctgctccccgcgccgtccgattggcggggaggccgatttgggccgtcggtcctgtggaccggaggtggaccacccgcgtggtcccggtccacgttggaccgggccccttgagccgctgccggttggggcccgcttgccggcacctctcccctccccttgtgtcgctgatccatggggcctgcttgtcggcgctgcttcccctacttgatgatgtcagccctggaacatattgcgcaataaataattaaggcattttcttttatagtaaaaaacacagataatcttctaaaattcataactaattgatccgagttccgtttaagtccattcaactctcagtaaattcataaaaatgcatagaatccattaaaaatggttttgtttcctgtttcagtagacttatagcatgttttgcttgtgtgctttgcttgtcgcttagatttcggctgtttcgtcaatccgcggtttctcgaagacgttgctgaggtcccatcagtgcgagagcaaggcaagtcatgcattacaattgatcatattacacccaatttacaaatgtcccgcatttctattaaatgttgcattattttacaatgtcatgtggtatgggtcctattagtcagccatatattgtttaccttatgccattgataacttgggtattaaaatgtatagatgttggattaggaattgcttagccatgctgtcagggttatggataccacatacctaatagtagttgactaagctcgacggggcccaccatataccaagtcttgtacggaaacataccttgtatatagaaggagttccagataaggaatgacaaatagagttctatatggaaatgacatggactacgcagactgtattcatatttgtctccctagttctacttggacaagggatcatgtatgggtataaatacaagcctcctaggaggagaggagagagaccaatacaagccgcaaagccgatacaagccaacacacaccaccaaatatcgacattagagattagtctagacataccccatcaggtgtctacgaagatcggcaagagggatctagcgctatctctgatctcgacgagttcatactcgaggaggaagactaccatgtcatcgactacaagttggttatctagccgccaagtcgacgacagttagataggttatcccaattattgtactcggtggtatctatatcaatcctatataaacaggatgtagggctattacctgtcagataaggggctcgaacctgtataaaaatccctgtctccatctcttttacctcaatctcgcatataccctggtaccaacgatccccataccatccaaataccgtagtcatgatctcaaatgtcgacaatggcgcgacaggtaggggattttggtgcttcaagatttcgacgagatgggtttaagagatggattctctaacgacaagctactcgacgactccagctgtgggaagatctaatccgaccggagtatgtctcccgacgagatcggaatcatcgtcgtcaacaatttgactatcaagatcgaccaagtttcaagacgtcatcaccgtggaggatatcagtacaatgtggtctaccgtgaggccttgctccggatcgactacctttgaaccgacacccaccaccgaaaatccgacgaactactgtcctcgaacgtcctcgccctcgtcgtcctcggcaacttgagactagtcggcaaaaatcgccgcctcgtgtaggagtcagaaccggagctactagtccaatcctattcggtgtctgtcattgcatgcaggagccggtgaaaaagccgcattgcagtgcatgccatgtatggcatgtgcactttctctgtttccgaggacaacacaaggacaaatcaggagagtttaattactattatttgttggattcatcgctagaagcaaaaaagcaaaccagggaacgtatacaaggcaagtgtgaacactggtaattggtaggttgatttttgaattaatctagtaatttcgtagatacatccggtatgtatctataaaggtacgcaatattttatatacaatttactgtaacaattttcagatcatacaatattatcatatttataatttattatgtttacctagaacatgttttttaaacgatatctatatgtgagcattccctatattaggccaacaacggtttaatactggggctcgctttattttcttctgtataaatcatgcttgtttacggtttacataatacctcatatttaatctgctcattatatcctaataatactagaagattcatgtagttttttgagtacatactcgatattctctactatatatcttgtcatctagaaaatatttttcaggaacgattgagcactcgagtaggatgtggtcgagtacaccgcattatcgagaacgttctcaaagaatgctgagttgtcacacccaacctaccaacgaagactgacgacttatctcatgtatagcgccagctacagctggactatttgagaaaatgttgttaacggataattcctcgcgaacgttgttggcttgatcacccgacatgattgcgagtaaacatccagatgtgctatatgttgggtatgtgagtcatgctagcccatgagatgcacatgtaatcaccaactctagcgcctcttcaggtgatcgagatacgcctac

SEQ ID NO: 80318 - DNA, 35442 bp, Oryza sativa
gccacacaccggaggttctcgatctcttcgagccggtgtgtgtccaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgcactgacgcactgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccatgcctgctacaggttcggccatgccccgggccgcccgtttggcccggcccatttggccacctctaatggggccacgggggaggagagaggcaaaagcggcggcagagatctagatggaactatgggagtcgtgtctgtgtcatttctcgtgtggagccgagaggcaaaagtgtcctcgtcgcgctgcgccttgagccgagccggcaaacatccttctctctggcttctctgctgggaacgagtcgaactcgcgtgcgttcgatcagtcacttgtcaccagcgcccgcatttccgtcgcgatgactccacctccgcccctgctctggtcaacgactctcctcccctgacgtcactttgatccccttcacaagcctgagcaacccatgtgaaggacgacgcctcttggtgcatcgcctccaagccatcaactgcggccagtatactggaggtgatgaggagtctagaggacaggtttgtgttgatttcttccctcccttctttcttttgctcaggtgaaaaagaaaaatcccctttatttatactccattaggtttgttttgcttccgttactggcgcactgagacatgagcttttgattctttctagcacctacttttggttcgactggatgacgcaattagccaaacaatagcaatggcagggatgcaagccatgacagccacgcatggaggcaagcctatacatcccaatctcttttatatcatcttatatgtctgttagggtgtacgttagattcaccatgaaagaatgtactagttacaccatgaatcagaaaattaatgtttggcgtttgtttgttaatggctatgcaggtttaatggactaatgatatttgtattagaattattcaaaagagtaaatctcttggtggtaaattcaggctagttgcaatgtactgcttctaacctctaaggctctaataatattttttcccagttccaccttaactgttgcatatttacttacttaggttcttatcctgaatggatgttttggttttcagggagcaacatctgttcctcctacgattggatcttcaaaaagaattgttaggagagtaaatactcagacctttctcagctttaatttgtaatggtctaaatactcaatttgctgtttttttgttcctctgtttcatattgcaggctatttcattgctgccgcccactactcttccagctctgccgacaaccacacctacaagagctacagctgaagcaacacatagggcagaggaggcatcacaggtctggcttggatttagtttgatgttgcactttgtatagctatatgcaggttcactgattttttatatcgttcaaacatctaattcagcttttgtactaaatgtacctcacattctgaataattatgcaaaattgtaaagacgttaaatttgtctacttccgcttcagccattacaggttgaggcaaaatctgttttgttgatagctaatatggttgctcaattagtcccaacaagtagttttcatattcatatgaataactccacttcgcaatatttttaattaaaatgccaaaatctattctatcatactgatgttacgtttacatttcaattggcggttgtccccaacctcatcaatttgtcggttgtcacatccaaataggtaaattcttttctctgcaggacaccaaggccccaagcctcaggttctgtaaatgatcctgattggggtgaccagtagaagtgaggattgtgcaactgttattcaatttgtgtaactgtgttaggcgttcccgtcctgctttgagcaaagccatcctaatttatatcatgtttctcttgattggtcgcaggtttggaattatgatgagcatgtgcatgatgatttgcaggtgattccgagcatatcacgcgcacctagcaaagtgtcggtactgattacatatttgatttttttaaaaccaattggatacattcttctctgctagatcacctcatcggtgagatgtacgtgcagttccaatttgctctgctattacactttgtttcaaaatagctataggttttgcaggtctgtttgaatagatttggaataccacaacgcctacctctaaaaacacaataaaattactgttcactttggaatcttaaggtgcagaacaaaggtttttaactgcaatacaaattttgtgcaattccaaatgttttccttgacgtactaggtgagatttttaatcacggtggcctaattgatatatgtatttgagactggcaaggatgtggaaagcaagcattcatgcaactatctgggcttgtccaattaaatcaaaatgatttcttgctattccatttaattaatgttgaagtcacgtgaaagttctcttagattatgggtgtgttcggttgagccgtggcttttgaaaaagctgatgtgagctgtggactgtggaaaagcagctgtgggaaaagcagaaggccgtttggttagagcagctgtgaaactataggttatagaagaaatacctgtaatgcctctaaatgcatgtgggactgtttatatgcaaattactcgtgaaaacctaacccgttcaatattacgtattttaatggctaatctggaaagaaaaaaatatataagtttttcatacatcaaagtaatatggtcaacataaacagaacaaaagataaatggttcatacaatgatgccatatctcaaaataacaatcatcctcttgcactaactgttggtatttcttaacgacattactagaaatataattctcagcaatggcatagaaatacttctggtatattatggttacagagttcatccgcaagcccacggatatactattatagcatttcacccgagagtatttcaaggatatcatatttattttatctcgtgggaagatcatgtagagagaacttgacaaataatttatatataacttgtgattatcaaagtctaagcaggggttaataatccaagggtagagtgacacacaagcagagagcttttacttgaggtgtgtgttgaagtgaagagagtgaagtccttatataggctgccaatgacggttctggtagttggaatggtcggaattgccctccaaccatcattgggaagtgatccacgccgtccagccaaaacctggatccaactacgctaggggaggttcggctgaaccagggggcggcccaacctgacccaaattcggcaagtggcctcctttgttgcttcacttcttagacttgtgaattttggcccaattcatcgtgttaattctgagttcttggcccattcatacataagcctggttctcgacatcgtccgattgatttatcgtctgtgttgatgccaattctcctccactttatggttattctctgcaaaaggttagtaaacctaatactagtggaatattattattctaacataaatatgcattgtaagcatcactagttctcgtctattttggtaatattgacggtcaaaactgatcgataacgaccgtcaacactaactaaccaaagcatcagctatcctagtacgaatagtattcatggtatcatcattctctacatctgcactcacatcggctgttgtgtcacttgtatcttgtagtaagtagtccacatcagtatcacatctctcaaactccttatcacgtaaattgctatcacgaacaaaattatgcgaagcaagacaatccatgatgatatgcttctgagtagtaggtgagaaacttggtatgcccttcaaaatacgtcacttttgcatcaagactctaaaatacctttcaataacatttcgaagggaggaatacaagaaattgaactaggaggtcctgaacgatgccaaaattctggtatatggtatgtggttccttcgtaaggtgcaagatacctattcggtttggataacccgagtcgacgagataatattttcctataaaactaagttagtaatgcaaataataatactagtgtacaaatatcaaaattaatgaagtaaccatttaaacctgtaggagagatgggaaatgaaggaaaattttccaatgcatgactgaggatgcgcgagtcatgtgtagaacctggctaaccagcatccgcaaaggtaaacctcatgtcaaagtcacaaatagctagcacattctgagatgtatatccatggcggcatgtgtggctaatagttttatccactggcactaccactggaatatgtgaaccatctattgcttcaatcacatctttgaagtatggccaaagatgtccttatgcatgcttctacaaagaagtacttttcatcttgttgggatgtcctatttgttgcgaatcacattgttgggttatcctgtacaacaattaccccaaagtatttgggagagagaagtttctgtgccccaaagaatttgaattttgataatgtatataactgactcgttaattcaaggtcctcttctcctaatcgtttttccatgtgattcgcaagggtggggcggcgtaacccccatcttcccattcctatggagtgtatgtggatttgtcatgtcatgcttgcaagttcaacgtaattatttttttgtttaggtgattaatggaattcccttgtacgggagtttctttcttctgtatcaggcttgtttagaggagaaagggaagcgagcaaaatttgtgggtgaagaaactaacagatcgaagtccagtccctggttagtgtgattttatttttgcgattgtattcattagctccatcactgacaatctgcctgtcatactacccaactaaaagatattgatagatggtatgatgtttcatatagtggttagcaagtaaatcaatgttatattcaaaaatatttgccttgctacccaactaaagcaattttccttgcaggttcatgaatatatgtatttgatgtagatgtaatcaaatagattgatgttttgatgataggcaaaatttgctacagggcatcgaagaaacgtgtaattagctggtggacatcgcaagaatgagaatttgctgttgggcatcacaaaaaacgtgtaattagctggtggacactcgcggacttattttattatttccggtggatttggagagagaaacactggtgagagtacgattttgcccctgtcattgttccacttacaacaagggagtgagaaggcgagcaccgcgtggtggattggattggattcatccccgcaaaccttagacgctgatccccccacttcatctccgactcgatcgccgccggtcgccgtaccgtacaagcatgtttccgtcgtttctactctgggcactctccctcgccggtcgcaaggctgcgtgcccacctcacccccgtgacctcgtcatgctcgccggcgcgcacagcgcaagccaggccaccaccatcctgttgtcgtcccttctctaggcactctccagctgcggcgtcggtggcatgaacctggtgtcacctaccaccactgcctctggtggcgacgcatggtcggaatcaggatatctgcaaagcccgctccttggcagatcagcccgctggtgcgagcgcggacatcaagttggggtcggattcggtggcttcggcgaccgctcgcgaagactttgctctcctccgtgctcgtcatctcttgaacaaggtagaagtccaggcagagcaacatcacctcgccatgcacgacggctacgggggagtgagactggactgggtcttggttcgaaccagacacagtctactgtaagcgaaacgatggcaggagcaaaatcgtactctcactagtgtttctccctccaaatccatcggaaataataaaataaggccgcaagtgtccaccagctaattacaccttttcttatgcccgacagcaaattctcgttcttgcggtgtccataagctaattacacgttttttcgatgtcctgtagcaaattttgccttgatgatatgaccaggctgccgctaaaaatgtgttacaggtaccccaaatctcacaccatattatggcacttaataaattaagtagatctcatctactataaagattttttagtggccatgtttaatgaaatcacgtggtaaagacatattcatgttttttttagaaaactagagcttcacatagacacatacctaatttgctgtcactggtaagcgtgttgttgttagtggattttacagttttctaaagtttgaaattaattcagtttctttttaatgggtttctcattgatatagtgacataatcataagaatttccacattttttttctaatcaaagtttcatatatttgtgttgtacatgatttcagtcgtctgaaatctgcatattgtttttcgagaaactgggcacaagaggtatgcccctttacatctaaaagggcatatatatatgtgtttcaaactagtgtattacttgagttcattttttgagtggattatgttgggatatgcgtaggctacgataacataaatcaaaattttctatcgtgtaaaccaggaaccatgcaagtattagatcatagatcgttaccactcgacacgctgcacagcggaagaagacgctaagaagtcgaaggaactctcgcgaagtagcgcgcatcgatgtagagaaagtagtcgatcgcaccggctcgaccttctcctcctcgtgcgttctcctcgccgtactcctacgctgatcagcaccgcaaaccagcggcgcctctaccggtatccacacatacagggacggaacgccacgcgcagatatgatagcacccgcgcgtggctagggttttgctcggggagggaagtgacggctagggtttctcacgtgatacaatacctccgccggtcacacccctcacgaatatataggatccatcactcgggcctccaaggcccgtaggactcctattcggatccctatccgaattaatctcatattggatctccatgcaatccctttattccggcccattaagcgtgcgacccgaacatatatactcggttgtaacccgaaaactcctttcggtccacgcgtcaacagcgttagcataacgtattgacccccgggcatacataaagatcatatcagctgaacctctagtgtatacttgtatgaacccctttgcctcacgatatcgattaagctcaaggctagatatgtgccatcctctaatagctcaatcattcattcgaacctgttgatagattatataacttgtgattgactcctcaatcacctttggcatggccatgcacttctataatctacaacatcgaggggcccagagatatctctccataggaggggcaaatcccatcttgattattcatatcccactacatgtaattcatagcatacccgaaaactacttttatagctacccaattatggagtagcgtttagcagtccctaagtaagctactacacatgttgggaaccatgataatctcaggtctaaggattcaacaccaacactaaatgagatcactgatgacacaacacatatggctcttgcagtgtctcatgttgggtctatccaacaacctgttcaataacatgtgtctacattattaatttggtatctctatactatgatccatgagacatgatcatcaattaatacatgtgctgatcatctaaatatatttgttccacatatgatatttgatcagggatcctttagaaatagcaacacacaacataaagagtctcacgaaagaatcacatattcattaaccaataatgagtttatctatttcaagaaacaaagtcggataaatatgtaaacatagtgtgtgatacaattatctctatgattggctctagggcatatcactaactaacagattatccagtaataatgtactatactgctttttcttgtctttttcttttatcacatattgagccatggattctttttcaatcattcactatctcactgtgggtagaagacgaaacttcaatttgttttcatatcatttgttcctactaactattatttttttagtccagaaaattaggtggcaggtaccatggtatcattatctagcttgcatgagccaccaataatctcaaattcaagagaacctgcatagcgacggcacagtacgatttattcaaatcatgggatcaaaatttaatgcagtggagttgtatgttcaaaaataaaataaaataaaatcagcaagtgttgtttaattaaccaattgttttcttccttgaagcccctgtcttgatgaattaaaaatcccctaaacagtcagcaccgtactacatcacgatcacaacaatccaatcggatttgatttcgccatcctactcaattatttatcgtcacaaacaagcttccccacatttcttttctgggagccacttttttttcaatgattatgtggaaatcctagtacatcaccaggtaatcctttttttcaatggtaatcctagtacatcaccaaattggttggccgaaagttactagccatccgattccaaagaatgggaaactgcaccaaggttgcaaactttttattgaaaccaagatgtagaggtgcaaatcgatagggaactgtggcgttgccatgacgattgtgtatccttaggcctcctttgacgtacacactgcttgataacatgtaatcaccttcggttgccttcacagaaatgacataattggaggtttgttgctgagctgtaaattttggtgtgggtttcaccaggctcaataggaattcgccacggagttcaccgctgaatcagaggagtttgagcttaacccgaacgacaaatcttgcatgcacactgcttcaaggaaacaataggtagaagatacccaaatctagccacccataaagacccaagaacatgaatggtggcgaatgaactgctgtccggaagacgaggcagtcgactagcaagctgaagacgatgttgtcgcgccggaacatcaaatcagagctacggggagctgttccctccccacccatccagatgagcaagccggcgctgcttagaggagacaatttcaatgtccgattccgccgcaaatcatcgattcccacttctccatcgccaccaaccgctgccaccgccgtctactccagcatccatgagaccatgctagcaaaagcccaactcgggaagaacccaagctgcagtgaatacttcacaacaaagaaccgacctaactaaactagtacggggggtggccaggtccctcctttgaccctcgccggcggtctggaattaacatccaaaaggttgcaacaaatgtgaaaaaagaaatctgagatatgcaacaatatgacatgtaccaccacacaaaaaatcagctcaaaatatgatgtacccaatgagaaaaaaaaacaaatttgtactccagtaatattcaaacagattatgttactattcacctgagatttatctttttattctctcactgtgtacgtcgtattgtgaactgattttttttagtggtggtgtatgccaagtgttgcacatatcataatttgtttacattttttgtgacttttttggatgtatttttcgaggttggtagcacggtagcacattattgtgcagtagcacctgatattctctctgcttagacggatatggtggtggtgggatattctctccacttagacggatatagtggtggtggtggaggaatgatggtgagcggcggacattgacggtccactactggcgtgaagactatgagagccccacaaagaccccactaaaattttttaccatatatagataggagggaggactgtaactatatctagtttgctcagacctactgctatttctttctgaatccgccactattaatggataggaaggtagtagtggcacatgattgtagggttgaaggagggtgagtagggtctaggacagggtatggaagtcaatagtggcatatctcgttgcctgagcctcgaaggatgggaaagattatgggacatgggtatcttgccaccactcggcttgggggcggagtagaagaatagatgtttaagattgggatggagggatggggagaggaagagagacctaggcaggaaggtcgtgatgatatgacttagtgacgatatgatcggtcgatctggtgttatgcgttagtggggaagagagtggaaggaagaaaacatgaagaaggttaacatcatagcatcagaattctttgtgtaatctggtctatctaaaagtgacttaaatgtgtgaataattttacattcgctccctttgtcgtagaaaaaaaaatcatatcccaataaaaagacagggagaaggacataagactaaaatatccctcattactactactttggtccctaaaacaaataatcttttactggtaggtactaagcggcattaaatagattaaatttctttgatttgtacaacaaaaacagctataggagggtaggaattaatatatttttttagataaagtttttatctttggaagttataatttattttgggatggggagggagacaactacagtgtttcgtttggatcgttctgtctgttatgcccgtgatcttttcagttcagaacttcagagagcgataaaactgtgggggcaagtgctctggcgccggcaataatggaggcggcggctagaggcaacaagaagctgcaggagagggtgcccatccggcgcaccgcgtggaggctcgccgacctcgccatcctcttcctcctcctcgccctcctcctccaccgcgtcctccacgacagcggcgcgccatggcggcgcgccgcgctcgcctgcgaggcgtggttcaccttcatgtggctgctcaacgtgaacgccaagtggagccccgtccgtttcgacacgttcccggagaacctcgccgaaaggtaaggtgcccaagaattaatcaggaatgattcaagccaacatccagaaaaaagaagatgattctgacgagctggttggttttgcatctctttcttgttgttaggatcgacgagctcccggcggtggacatgttcgtgacgacggcggacccggtgctggagccgccgctggtgaccgtgaacacggtgctgtcgctgctcgccctcgactacccggccgccggcgagaagctggcgtgctacgtctccgacgacgggtgctcgccgctgacgtgctacgcgctgcgggaggccgcccggttcgccaggacgtgggtgcccttctgccggcggcacggcgtcgccgtcagggcgcccttccggtacttctcctccacgccggagttcggcccggcggatggcaagttcttggaggactggacattcatgaaggttagctatggcaaccgcaacacctctcagtttctttctctctcttttttttttccattttggaagtactaacgaatttaaaaatataaggaaacatgataaccacaacacgtctcagtttctttctctttttttaatccattttggaagtactaacaaatttaaaaatataaggaaaacatgataaccacagcacgtctcagtttctttccttttttttttccaatttggaagtactaacaaatttaaaaatataaggaaacatgatttgactcgtgctctaaattaaaatcgattagatgaaatccgggataccgatatttaagtcagtcttataaaagaagcgtcgaatgggtaggataccgtcaagtgattaatcctaatatggattattagtcagaattatacggaatttcaacgttcataaaacaaataaatatatttgcttggccgtccaccttgggtgatatttaagcacattagtacccttaagtactttaaaatatttaatttaaagtttctaaaacaacatgtacagatttattttacaaagtgtaaaaatgtatttatttattatatattataataaaaataattaaatatatatttttgagatcgttcgtaacttcaataattatgtaaccgggagggagtacgtaaaccggtcatattgccagagttaaatcgtcgattgatctagaattgaatgccattgccatatatgctcagtgtaacgagctttagttcggctgctgctggagtcaattagtagatcggacgattagtcgcgaatcagcctgattaattgggccagcccggccattttggcgtccacgtcgccacaactcgtcacgaatggcagagtcgtatcggtttgtcttccgtgtaccactgtaccagtacagttggccttataatcgattggaacggccgtcattttccacactttttcgtaagcagaaatgcagcgtttcgatatgtcttctttagctattctgtgagcttccttgtttagccaaaccagtgttaaccacccttgcctctgaggaggagtttagtatcttttagctgctgctccttaaatacacatatctcgttgctagtagggattaatttattaatgttccactgcaaaatttccaaaatttccgaaattccaggtctactggtccctgatagaatattatgttggcaaaagaaatagttttttaattacacatatcttatttaagtttaatcaaaatttgttcaaatttcaacttatttcggtctgaaattttgacaatttcctgaaatttgtttctatcggttccccggtagaaatatatgcaaaccggtatgtagaaccgtggttacaggatgcacgcttttatcttggagtccaaaacagcacaagcgaaaggaagggcctattcagattgatggcattttcaactataccgttatttggtaaaatgtataattatgtggctacgtttagtttgtaaccaaatattggcaatgtgtatagaattttggcaatactattaagccaatcctaccaaaattttggcaacgttgccaatttatcaaaattttagcattgccaaattttgataaggtttattttggcatcaatctgaatggacccgaagttatcattgagtagtcatggttcctgatcttaattcgttcatggccatcttgtttatgtgcaaacatttcagagcgagtatgagaagttggtccaccggatcgaggacgccgatgagccttcccttctgcggcacggcggtggtgagttcgcagagtttctggatgttgagagggggaaccaccctactatcataaaggtatcgatccccacctgactatataaaaactttcaaatatggattctggtccctccaactccaaagtgtgtcccttgcacagagtttctcaactcatttctcaccatgaccctgaacttctgtgcttaacttggtttggttctctgctggatgatttaggttctgtgggataacaacaggagcaggacaggagatggcttccctcgtctgatatacgtctcaagggagaagagccccaacctacaccatcactacaaggctggcgccatgaatgccctggtcagtgctacatagctctttttgttactagagaaattttacggttattgagagagtatatgtagataccgaaattttgcaacacaaattttaatacatcgaggtactaagttttacaccagaaaatatggtacctctcggtacactatttgttactaaacaacatggaaagttcagacaatgtttgttactcaccaacacggcaagttcagacactgtttgtgttactcatgattggggaagttcagatatttgattgttcttaccatgattttttgtcagacaagggtgtcagcactgatgaccaacgccccattcatgctaaacctagactgcgacatgtttgtaaacaacccccgggtcgtcctccatgccatgtgccttctgttaggttttgacgatgagatcagctgcgcgtttgttcagacgccgcagaaattctacggtgccttgaaggatgatcctttcgggaaccagctggaagttagtttgatggtacacaactagctcttgcttgtacgataatttatttaatttagttgatgatccaactaaactaggttgatgatcttgtgtgattttcagaaagttggacgtgggattgcagggcttcagggcatattttattgtggaacaggctgctttcaccgcagaaagtcatttacggcatgagacagggcgagaaggcaccacaggtgaaattgggcaaacactgatgtgattgtcatacattagggctccatttggtattgcggtagatcataataatcacgtttgctgcaaatgttttttgacgtttggcagttggccaaccgcttttctttttaattatctacgttagaaatgataataattataattatctaatcataatttggtatgtaaacacaaacaacaacaattattagtattagttttcatgtcagcctaaactagtaagagaattcaaatttaattcttcaggttattcatctaacaaggagctccatagtaaattcggaagttcaaataattttaaggaatcagccagggatgtcatttatgggaacttgtcaacagagccaatagtagatatatcaagttgcgttgatgttgccaaagaagtagctgcctgcaactacgagattggcacatgttggggtcaggaggtacagccattgccacatgtctataggatgttactatgcagtttaatttactattctatatgtttcataaatgtcattccatatattcacaggttggttgggtctatggatcactgacagaagacgtgttgaccggacaacggatccatgcagcgggttggagatccacgctgatggaaatcgaaccaccagcattcatgggttgtgcaccaaatggagggcccgcctgcctaacccagttgaagagatgggcatcaggttttttagaaatactcatcagtcggaataacccaatcctcacaaccacatttaagagtctccaattccgacaatgccttgcatacctgcacagctatgtgtggcctgtgagggcacctttcgaattgtgctatgcattgttggggccttattgcttactatcaaaccaatccttcttgccaaaggtactactgcatcactaaccaatgcatcggttataatcttctgtactctccttgccttcttaacacagtgttgcacctcatttgcatattcaaagataaaaaaatctttccaattgaatggctagagagtgaggtatatatgaactattaactctactattgcagacatcagaagacggtttctacatcgcattagctctattcattgcctataacacatacatgttcatggagttcatagagtgtgggcagtctgcacgtgcatgttggaacaaccacaggatgcaacggatcacctcagcttctgcttggctactggcatttcttaccgtcatcctcaagaccttaggcttctccgagactgtgttcgaggtcacccgcaaagacaagagcacatcagatggtgattccaacaccgatgagcctgagccagggaggttcaccttcgacgaatcgacggtgttcattcccgtgacagcacttgcaatgttaagtgtcattgcaatcgctgtaggagcatggagggtggttttggtgacaacggaaggcttgcccggtggccctggtatcagtgaattcatctcctgtgggtggctggtgctgtgcttcatgccattgctgagaggtctagtgggaagtggtcgatatggcattccttggagtatcaagatgaaggcctgcttgcttgttgctatattcttgctcttctgcaaaagaaattaattgcagctggtgtgcagcaacaattagtccatactattatttgagcatgcaaacactaggtttcatcttcatattattatgtccgcaaacgttgactaagctctagaaaagggaacaattcaatcactaattcgaagcaaaaactggttgtttactgtaagagagaatctactcgtccatggcaagttgtcccaccggtgcaaacttgatcttagtggcatatatatagtagatttcctcttattgtacggcctgtatgcatgcatgaatccttcaaagtagaagcattggagcggtcccgtgcaaatttattttcttggatggatctactattataaaaattgaagatgtttttgctgatactttgatacgtcatccgtgtttgaatcggttgtaattttatgttttatttttaatctctatctctacctaaaaagaacaagaaatttccataatcggtaaaaaggaaaaaaagtccgactaaaaaggtaaaaaaagggaaaaaaaagtccgactcaaaaaccgataaaaaaaacttctgtcgtgaaaaaaattgtccgactcaggtaaaaaaaggtctcgccagtaaaaaaagacaaagaaaagtccctttttttttcatcggtgacttttttcacgcgaaatagttttaccgtacgcacgcgctattggttttttcgtctggttttttaaatccgatctgttcaccacgcatctccctggtgcttttggttttttcatcaatttttttatcaccgggtttttatcccatgcgtttttggtttttcttgtacgattttttaatccgatttattcgtggcacgtctaccgagttgaaccttggcgtcacgctggcgccatattaatcgtgcgtttttacttcaatttgattgcaaaaagaaatcgattcccactcatccctcgtcattttctccatgattttctgggctttatttcgccggatttaatctaatggttgccgatgatgacagcgatcttccccaattgtttttatcctgagttttacgctctgattttgggtaaaacaaccaattttgggtgattaagaaagattcgaccggatttgatgggtcgaacgaaacatgccaaatgagggaggtagcggaccagcctagggctgaaaactgcttcactcgtggctgggtggaaacaagaaggccaaacggagggaggtagcgaactggcataggattgaaatgtaaggaaggcttttggcccaaaactcaagaaagattttgggaaggaatcgggcggcgccgggcaaaggagggagggaaggggagcttcacggggtggcggtggattgggaaggccggcgcggcggtgtggagaagaggaggccggcggcggtggggatagagaggatggccagcgaaggtggggatggagaggatggaccggcgtggtggggaagggcgacacgaggagaggctgccgcgggcgacgccggcgcagccgtgctcggctgagcgtcggccgactccgcgtggcggtaggaatggagaggaggggaaaggttcgacacggtggggagctcaatccggggacgccggcatgctgcgatggacaggagtcggtggagaggggatagagactcgctcgcctgccggctgccacttgccccgctccatcggtcggggagagagaggggatagagagaagaggggagaaagagaggaggaagaagaggagggtgagatggatgacatatggggcccacgtgggtcccaccatttttttattattttctgtgtgagactaacttgtggggcccatgtgggtcccaccacttttttattattttttgtgtgagattgatatgtgggtcccgcagattttattatttttccagctcgaattaccacgtaagtgccacgtcaatgccacgttagatgaagaccgagtcaaattagccacgttggcgccacgtcagtcaaaaccgccctcaaaaccgtcgagggacctaatctgcaccggttttgatagttgagggacccgttgtgtctggttttccggttgagggatgaaatcggatttgttgacaagttaagggacctcagatgaacttattcctctgggtagcgacgcaggggacttgggagaggcccacgagccagccacatcggaacaagcaggggacaccgtagcacctgagcccagcgaagaggtctccacctctgtcggctgggagagaaataagttcactttaggtcccttaatttatcgtcgagtttgaaattcatccctaaaccaaaatacgatataactcatcccccaatttataataacgtatcaactttgatcctggcggtatagcggccgcttttggctgatatggtgagtgggacctacctgggctccacatgtcagcggacggagttaggggcggtgcttgtcttcctcttctctagcgcggtggacggcggggcagggacggcgctcggccttcctcttctctagcagcgaacggcgggggtagggtggactgtggcggatgttgcacgatcttctctatatcaccagcccatcccgcgactccgccttcgaggcttcaacttgtccgacaacaacgtagttaaattcatcctcaccacgtggttccccttcggcgccagcagcaatgcgtcgcagccggtgacgcagtccgtggtgtggttcgcgaagcagtcgttgtccggcgagacaaccgttggcactatgcattccgtgctcagcgtcacggtagacggccagctcgcgctcaccgaagtagatggccgcatgctatggcgggcaccggtctcccggctgatgcgcggctccatcctcgtgctccgtgactctgatagcctccggccggttcgtcggtgacgccagctgaaggatcgaacaacaagaactaagccaaccaaatgggggtgaatggttgtagtatacatacatattatacatacatcctagttatattattacttaactaataccctctttccgatgccctcctggtgcttcgagaagccacccttgattgccgagttccttacaacaatccgtcatgaccatccaactgtggctaaatacggaggagtacccgccccaggaaattaacttagtactatatacacgcgcggaggaatacccgtactgagccatcaccatcagcggcccacctcgcttctgcagcatataacctcaaataatgatatgtagtaatctaaacaccatgcttaaattaccaaatgctactctaatatcatcgtcatgacatagagtcatcataaatacgatcattatacccacaccatcgcatcttccagataagctagcatcatgataaatgtaactcgggcatataataaagttggtattcatatactcggatagtaatacaataccaaaatagtataaagaaatattttaataaaagtacaagtcttacaaaagaaggaaaagctactagagctatacccgaattcttccgaagactccgaggattgaagattctattctatttctattccactatactctataaactatactaaacttgagagatgtatgaagcttcttgcttgaggtgtgtcttgaaatagagagagtgatggccttaaataagcaggtaatgacagttatggtggttggaaaggtcggtaataccctccaaccgccatagggagtgaatctcgaccattcccttaaaaccctgaatccaacggagctggtgctggttcggctgaaccctaggctggcccaaccagcccacaacttgccaggtggcctcctggacttcttctcttcgtagacttgtgaaatttggaacaattggtcgtgtcatttttgagttcttggcccgttcattgataagtctgattctcgacatcgtccgattgattgatcgcctgttttgatgtcgattctcctccattttgtgttcattctctgcaagaggatagtaatcctagttctagtggaatatttattattttaacataagtatgctttgcaagcatgactagttctcctttattttggtagtattgacggacaaaactgatcgctaacgaccttcaacattaggagaaggctagcaacggaccggacgccgctaagcgcgactgaccgccgctaagcgcgaccaaccgccggtaggccaacaaagaaacatagccgagatcgcacaaaacccaacccttacaatcaacacaaagcctcgctctatccagtcttcaggagttagggagagagggtgagagagagaacggaactcctctcccccctaggccctccgacgcagccaacttgtagagactaggatgccgccacaagagaatgaaatctagagtgggcttgcaccaattggttgggggtttcaactaggggatgcctaaacgacgtctccaaggagagaaacgacggaaaacgccgccgccgccgtccgtcaaggtctcaaagagaaccgagactgggctttcacccgacatctacacatgagggatgagacggcacgacaacgccctcgggaggggaatgacacttcgagcgtcatcgttgccagcccgaccgaggttgagctgggttttcaccgaccgctcaccacctgcgagtccacggctggcgccccgatgctccaccaccatccatcctctgccggcatgtgggtccactacactagcatcccccaccggccagccttcgtgcgccgaagactgcaccgcactcaccggcagttccttctccttgcaccgtgcccgcctgtgtcactactggcctcgtccactgccggccacgcctcttcgcgccaggtcggtctcccgccaccggccgcactaccgctggctacgcctccttgcgccgtgccgacctccgctgccaccggcggaacctctatgcaccaagctagcctctgagcactcctcccgccgctgccgcgccggccaaatgctgtcatctgccacgccaccctggctagccgcccgaggccgtccttgcctcctctcacaatcgtcgtagcccgtttccagacgtcgacaccgcatccacaccttcctcgcctctacatgctgccaccggcaaccgacgccgcattcacagccgttgccgccgtcagccaccgccgtcgccagccacaaccgccgccagcagcgcctccagccgctactaccaacggccggccggccgctgtcgccgtaggcctcacgccgccatcgacctgccgcgatgggcgctcctactgagagctcgcccgctatcgccgacccatcgccgcgagctccgctgcccccgctgcgagctcgcccaatctgaccgccgggtggccagatccgcctccggggggccggatccggcgcgccgtttacatccctgcctccgtcgacccagccatgcctctaccgtcgtcgtcgccatccccgccgccagccacccccccctcctcgggcagatccggccagagcggcgtggatctggcggtcaccgccaccactatccttgcggccacgcggcttggccggcggccgctcaggcggcggcgaggcgaaggaggaagatggggggagggtgtggtcggagctcgtctcctcccgtgctgcccctggtggagggcgacgcgagagcgagaagtgcaggcttcctctgccttgatccagagacccggtgttgctgtgcatggtttgagtttttcctttcccgcatgcaacaaaatcaccactatgggagcgcgtttggacttccagaccaaaggagagagcaacactatttgtgtagagtcactacaaattgccttatagggacattttcctaatactatgtaggcatttttaaaatgcctttacgatgttttagagacattttaaagaatgcctcataggtgactttttttagtgaattatctctataaacgaaaatgcattttatataatatctctatgccttgcggcatttttgtacatacatttttatatctataagaaaatagagacactttctagatgcacttcgttgtgcaggaactatagcaaatcaatgtgaaaaaaaaaagaaaaaatatcataccatgccaatcttggaattcatgacctcttgagttcataacttttatcttcaatatactaaccatctcaacctcaaatcattatttgtgaatatatgtcttgtattagttatatctagtttcttagcatacattaagatttggaaaagtgcctctacatagctaggttaaaatgcctttacaaatgaggcaatatttaaagtgccaaaaaaaatgtctctacagcataaatttaacaaaatgtgttataaatgcctttgaagtgcttatagattaaaagtattctaggagattttgaaagtgtctctaaactgtaaactgtagaactcctgattttagtggcaaattaaatattctctacaaaagtacgtctatgtaagatttttcttgtatgagtgctccagcgaggattaatggagattaccaatctccgatacctcggaaaaagctccactgtgttcttattattattgcttcttgcttttcatcaactataatttgtagaattgcaaggaaaggctataggttgtaaaacttgggctacactctttaaacctagacacttaagctagtatgcttacacttaagcttgtcccagctgcagcttttcccaaaagctgcttctgctagaagctgcccaaacagtccatagcttctgagaatttgtagttacagattctgaaaaatgaactaagaagtcagaagctggagaagctaggtttcagagcttttccaaattctcagaagctggctaccaaacagctgcttctcagaatctaaagctcccccaaacaggccctacgtataggattccaatttaccaccctctacaacatctttgaacatacaaggcaatcatccttgtgttgcttaaaagcatctcaattgacaatttgacaagtctatggtatgtaagtattacatatcagaaacaccaaattcatagaaattttacatgctatatgccacgccttacttccttaaaaggcatgatatgttataatgttttaatggagtactgttaattacaaaccagcaaacaaatttattgtaaatctataggtagcagtgacgttgaatgtgaacctcccgtgatagcattcagtagtcttggcaatggtggcattttgagttctagtagaccctctaggaattgcaccacctcgcccattgtcgggcggtcaaactcactgtcttgaatacaccaacaagcaactttgcaaactcgttcaacctcctcgagattcacatcaccatgtaattttgcatccaccaaattttcaatccctccattgataagctggcgggcaacttgcataggaaaataggccgaatgacccctacaatattcttgatttgagttcctccttcctgatattatttcaaacaaaaccatcccatagctgtaaacatctactttagatgtaacaacagtcccgctaatccattcaggggcaagatatccaatagttcctcttactgtagtaagagcatgactaaattctctccccaaaacctttgccattccaaaatctgctattttgggaacaaaagatgcatcaagaagtatattctctggcttgatatcacaatgtataatgcaatctcgacaactatcgtgcaagtaagcaaggcctttggcaactccaatagctatttggtacctaatattccactccaaaactttatcattatccttaaatagatgcacatcgagggagcggtttgtcatgtattcatacacaagtaacttcttaccatcttcacagcaaaaccctatcagtttaactaaattgatatgctggattatcccaattgaatttacttcagctctgaattgcttcactccttggcaggcaccgtcaagccttttcactgcaatgataattgagtcatttaggtatcccttaaacacagaaccaaaacttcctccccccaacttctctgaaaaatttttggttgcgcattgcaaatcggtatatcgaaatgccctgatcccaatgccttcctgagcattttccactccacgagaaaaccatttctgttttctcatccaaaacaccagtacaaatatcatcaaacacaaagcactcatgcttgcagcaatggtgacaccaatgacggttccgctctttttcttcctttccacactttgcacctcatttgcagcaacgcgaatgtaaagagtttccccatttccatcagcagatccatcagattgttgccttacattatacagcgcgtcatgccaaacagagcatcctcctttcccataggaatatgcagtacaggagcaattgctcaagcaaacttctgagcattgatctttactgccagctgtctgcacactcatggcattatggggcaatataatgttttgcacacagtagaacttatctgtgaaccctttcttgttcatggtactgccacaatttaaaggagtattcctcatacaacctcctgatcgatcttctagatcccaattcttgggtgatcttatagagaaacccttcaagcagtcacagaatggattgttactgtcattgcagactgagaaaggtccacagattgcgtaaacatcgcagtgaagtatgggcatcctgtagttgatcaaccaattctgcaagctgtccaaccatatacctgccaaacctcgaccattgacatctattccagcatgtgtaatcttctccttcgtcagggtatatgagaggtaaacctctctgtcattgttgacataagtgaaattgggtatggttgcgccaatcatctctggcgctaagccgaagaaatgcccattccaatccccagtggaccaatatactacagttgagttccataacaaatgaccagtaccattgatatcaaactccaccgagtataaaccagcagcctggtcaatcgaatttttcctagaaacaagacggttcttctggccagtcactttgttcctgaaaatctttgcgccagcgaaaaggctatctgtcgggtagtcaaagctctgccagaaaaccttggatgagtttgaggagctctgcagtacaagattcccgttgttcaacaacactacaatggtgtggttggttctggtgttcacatgggtggaccatatgatgttcttggtaacctgatccaagatgaccatgtttccatcacttgatattgccagctccggcgaagcggggtccacgaccgggttttcgccattggcggaccacagaggagttatcatagggagcttgctgtaccatatgcaaaggtaagagttgtggctggcataggaggagttcttactctccgtcttgaagaagccgagcacgaacttgctgttgttggagacaagcctatcgcttccggtgagtgcatggccaggtgacacggtgtctgtggcggcagagattctcggagggtacagggagaataggaggaagcaaagaaggagagacatgtagagaatacagtgaagagaagctaagtggaggagtggaatttgtaaggaaaacgattgatgctcacgaacgcaatgcaaacatcaggtccaatggtttagaagccagaccactgatcagttgtctgtagagctcgcagaatctcaggtcaacgtggtggtgcgggtaaaacgtcctaatcagtctgtattaacaactgatagtgtgctgacctcgatcttaataaatcttccctcattgatcagacatcaacaaatggagcgttttgactgcgtaatgatctgtggtttgtgcatattcaagagaaatctgtttggcatctcttccagcaacttccagttgaggtattcttttaagaggactcttttttttaaaacattgcaattaggttgacttctcaatgcaattggcgctgcttgttggagactctttcgattcttccccttttttgtcgaccaatcatggatttatttccaaagtgaaaactttagccaaaatgaaagctcagtttcacaactgatgagatcaatctgatattacttgtccagcaggaaatcaatgtcataatgatcacagatttgggcaaagcattaccaagcgatgtgagataattgatggcaacttaaaatgggttttgattttggcactatcagaatgatgcataatccagtccatggcaaacaaaataaaagtgcagatatgcaattagtcactgcggaatgaagtaatagtaattttactatccttgtaccacattgtttatataaaatcttcagaaattatctatcttgagataccatcattttacagaaaaattgagtaaattttataaaaccccaggtactataatttgtttcaaagaacccaaggttttgggccaaaatgtttcaagaaacctcacgtttaagcatattatcacaccccgatccggcaccgccgtacaacggcacctgacaggagcgtgtcgtaggaaaaacggcgcgaaccgcttcctacgaaaccgcgattacagtaccagtcccaggacatagtgctggtacccacggtgacaaatatgaaccatcgcaaatccttaaaataaataaaggacttatttaccttaacttacgttgcagctcagaacagcccgagaatgcaaccgacgacgcggacaaggaaaacaccaacaacagcagcagcagcggaaccaacggactaacacccaacaccacaggcgacggctgggaaccaggacaaaaccctattcttcacttcacttcatcttcagcttcaggacggaggaactatatatatatttatatagagcaagggtgagtagttttgtactcagcaagtcacggggatttaggtgtttaatgcaagcttggaagagaggcaaggttgttttgcaaatcctttgtttgaaatcttttgaaatcactaagtgatttatttctttctaagtttgggtcgaaaagagacttgcgtctcgatttgacttaagagatgcttttcaataactcaattggtaatgtaccgacctcccgggtcagatcattacttctcggctccaagagccatttcacttgattaatcggctcccagagcctttttcattttctcggactcccagagtccagctgcccagcagcaaagcaatccgcttcctctcgggaagcctagtctataatgcccgcagacatcccgaatcacacagattcgtttctgaccactcaggtcatccatctgccacataggctgatctggttacgattcccatcccacaacaacttttcacaaagcacaggcaaacaaatctacgcaacaggaaccacctcacatccgcccatgaccgtgggcacggctgtttgaacagttagttaacctctacagaggggtacactttacccacaagatacgaacttattctgaacacccgtcggtatcggaggttcgcaacaaagcctttcctaagccgacccagggttacctcatgccacgtagaaggatcaaatcctcatataaatataggccattttagttttcacaaatcaaactccaaccacctcgatcggtaatctggcaagcttcgcgttcttgccttaccaggaacccgggttggctccaaccgaccctgccccggcattccccaactattggcatgcgaggtttccctgaaccgactagttacttagctagggtgtcccattccaccttgtggttgcactttgttatgcttgatgaatttcccacaggaatcggtccttatatgcgaatacgggacagtgccacacaggcacaacccccgcatcgcgagttatcacaattcattttatttttaaacacaccgacaccacaggttgggttttcaaggcttctcaaacccatttcccaatttttggacaatcaacagtgtatgtgggatatttgatatacgcgctcaaagagcacggataccgaagtcccacaagggtggagcgacaaggaatcagggtagtacaacctataggaattagtgcgactactgggtaggtccgtcggtttggcacgcaaaccgaggccaagcaagttaagtgtgtgactctaataatgcaagttgcaaacaaaacaataatgattttccaattataggagcaattggtcaaaaggtgacttgccttgctcaaggtcttcacggagcttcacgaatcttcgagaaaacccgcgatcggcgaaaatccggtaaccgcaactatacgcaaacaaacaaaaacctaaacaaaagaccaagaaaaagaccctatttagactaaataatagtgccattaaatagatctcaatttttacggaattactggaaatagaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatggaacaaaggaaaaagatttattaaatcccttggaaaattaaagggatgagggatgtgatttggacttatctcgggtggcattggtgcggcccaaagggttgaaggaggctcggccgagccattgggccgggcgcggccacggggaggcggcccaacagagggggcgcgggggagagagagacggcccggtggaccgattccaccgcgcggggtcccgggtggggcccgcttgtcggtgatacggcccacggtgggatggacgcacgcgagggtggcgctagggttcggggggggggagaagcggtccacgcgcggcgcgcgggtggacgcggtgtgcggcgggcccacgcgcagcctgttggctctccgtggaccgtgcgcgagggtgggggacggagggaggtggctgaccgaggtcagctttgacctggtcgcgtcgaggtggcgccgacgtggcagctacgtggcagccacgcgggccgggcgagaggaggaagaagaacaggagctccaaccaacggtggccgacggcggggtttcaccggagcacgacgtggcgattcgatcgagagggagttcaccggtacaaaggggagcacgagaggggttgagccaatggctcggatccttcgaagaggggccgacgacgacgaatcgcggcggcgcacgccggcggcgagaaaagggggaaacggcggaggggtgacggggattcaattcaaggcggtgggagcgtgtccggggttcaagaaatccgtttccggcatcggatggggtggaggagcaccgaggagggctagcgatggcggcgggctccggaagcgggtggcaatggcggcgaggccatgccgagcggcggcggagctcggggcggcgtctacgcgcgttcgaggggctagtagagctaccacacaagctagagagggcgaggaagaacgaggaaggagaacggagggagtctctaccgagttaggacggcacggtgacgagtggccgacggcgcggagtgagttctccgttctcagaccggggaaggggaagaaggagggtgctcggagtcccgcgtcacgcgtcctcgcacgcaccggcctccccggtgcttggcgacgaacggcgacggcgagagcggagcgagcaacaacaatagcgcggcggtgttggaagtgaaacgagaggaggattcgatgggaggggctcgggttttataggtggccgggtgaggagcttcgaggggaaggaactgactcgggagaggcggtcaaggagaggagctggcggtcacgcccgtggtccaggcggcggtaggcggtcacgggcggtgtcgggcaaaatggaaaaagggggggggggcaaagggagctctgttcttgccgaaacggggaatgggagagggagagaagagcgcgtgaggcagagagtcgcgctgcctatatgtcttggacgcacgcgcgcacagggtgggggcgagcggcagggcggcatgggcggctgcgcggcgcaggcggccagggctgacgcggcggcgaccgagcggtctgccacgcgcgggcgagcgcgtgcgcgacgcgagggcgcggcggaattcagaggcggcggcgggaatcggcgccgggaggggagagagcagagagagagagcgaagacgggagagagaaagaacgagagagcgagagagctctctctcggctcggctcggcgcgtgcaacgcacgtgcgaggctgagggaggagaaacggctgagagagggaggtgggctaaggggggaaaacggcccacaattggagtttgtatttggattcaaattcgatattcgaactcgagggttcagggaggaatcaaggaagactcaaggtagggtttgatatttttcggaattgggagcgagtatttgccgaggattcaaaggatgcgattgaatttcggaatttgatttggagatttgagtcgaaggaggaatttcgaggtggaggattttgattttgatgagagggaacaaggggattgaattgagatcctggcacgacttagactctcacacaaagaacgaaaattttcgtaattaggattttgccgaattagttttaaacgtctcacgaaaagcggagcgttacacatatatattttaatatatttatgcataatatttgtaaaaaataatatgagatattccggagtatatataccttagcctcttttaaacgattatctttgcatcaattattggtagtatgattaatgtttatctatacaagtaattaccaattaatacatcactattagtaaggttgtctaatgtttttcaatcgtgcaatgtaagagtagggaaaaagatgaagtgcacgagaggggtatgtattttgagcctactaatgtaaatatatactaaaaatattatatataataataaaattatgagtatgtgataaacatgtggtttattgaaacactttacccccaaaatctgatattcattgaaacaaaacataatacataaggttttgcattagatgtatctcaaaacttggagttttctgaaattctaaaaaatttggtatctgtagataatctactaagaactgtaaaattaccctgaattaacaggagtcaattgtaatatgtatgtttactgttgacgtgctgagacgcaaatcacttggtctctgatttggacctcctttcaattattaattccagattggtgaagtgtcctgcccagttgatctatattggcagatcatggtgtgatgccaatcctagaattctttcaacgccaaagatcaatattagatcactgctctataagctctatgtgccaagtcttctgtttctatagcccactagcagcaaccacagaccggctccttgtaagggcatccacaatgttgctttttagccagtaagaagcatttaatgctctcttcctactgggtaggaagcattgtgagagtggcacagagttaaaacccggccatacctctactaccgatgaagaagagataaagaatattatttgtacagtgtttctgacagtactttaaaaaaaatgaaagttgccgttgcttttcaaccgttgcttgctacccgttgcttagtcactgcattgtgccattcttcagtctcatactacagaaataacacacaatatatatagattgttgaacaacacagatacattctaccagatagttgagatggatccctccaacagagttttcacaaacttgttgaatcaagggtccccaagccaatattctgggaacagtagccaaaactcccctcctactcaattcccctcaaccttcacccaatcacagtatccccaatccccacagtttccacaatcgcaagcactaaattttcataacttccacccttttggtcctccagcaaactatcaattatatggcaatcctcctccaagttttcatggttttcagcagcaaggcaattggttaaaatctgcagcattaagctttcaaggttttcgtcatcaagaaagttggatgcactcaccaaatcaggttggtggatctgcttcttctcatggatctgaatcaacttctccatgccctgcaacatcgcaagccaaaagtgttgttaacattgaagagtctagtggcaacaatgaagaagctgggaggaaagggacatgggtcaactggactgaagaagaaaatctacggctccttagttcttggttgaacaattcagtggatccaatagatagcaatgacaagaagtcagagtactattggagggctgtagctgcagagtataacaacaatacacgtcgtaatgatcgcaaaaggacagtcgtgaaatgtaagacacattggggtggtgtcgacgacggcaagagagtgcgacgggatggggacgagaatcgtgtcgccggcggcaagagagtgcgacggactcgagagagaaattgggggtcgagaacttgcaggaaggaatcacgcggcagtcacggaattttactatcggtgatttttttttgctggccccaccttattcccctccgacgcgcagaaacaatgtggagggtgcgatggcttaataccgcctgacccctgcgcccacagtattgccgaactcagcaacaaacattgcgcttgccctaagggagcatatgtgtgcgattccatgtcaagaagttgagccaatattttttttatttcgatggttcctgttcattgccacctatattatagatattgaagtaaaatgcattactggtataaacttataaaagagtgcaatctagttcatgaacttgtaaaacgcttattttgttgtatgaacttgtctcgtatgtgcgacccaagacatataatggcatgataaggcaaattataataagttgaccacaaaggagtacatgacatgttatatgaggtggaatgcttttggtttctactttatccttcttcatttctaccccttgcattattatttagtttgagaaatttgcatatgtgtgatacttaaaaggtggtttcgctacaatatatgccatcgttaaaatatgattctctcggataccattctcaagtcatgggcattcgctaaaatgccattttcgttgtatctttcatttgcaaaacatttttcatccaaatattttttttctcagacacttttgcccctgactatggttgaaccaaactacatcttctacctcaagcttctcaggaccaggcgagaggagagaagggcgaccactccggcgccgccgcccgccagacacgctgccgccttccccaaccgagctgtgccacctctccccaccatccgcgccgccttgcatgccatccatttgcccccaattccacgccgccgcttccccccccccccaccatctgagccagactaaggagctgcagttgctgaaactggagggggcgctgcagctagaggaggcacaacacgcagaggaggaggcgctagcgctcgccgagatggagaagaccaagttccgaggtgcgcacccgccaggagggcgacaagaaggtgcgcgcccgccgggaggctgacgggaaggtgcgcgcccgcaagtaggccgatgagaaggtgcgtgtccaggaggccatctccagccacgacttccactaccgacaacatcgagctcaccaccgagcgcttcttcgacgggcacaagatcggcagatggcgggggaaggcgacgcggtcagggaaggtggcggcgcagatggcgggtggaggcggcgcagatggtggggagaggcagcggcatgtgttcacgggcggtggcgcagagtgagagagacgacgacgacgctgtccccagccgccccctgccgagccgagcctccttccccaactgcgccggtgtcacctgctgccgagccacgtcgcctccccgtcgagcgcgcggcagatggtgggtgccatcggcgttgtcacccctggcgccgcttctctctcggttcgtgaaaaacgcggtcaccagaaaaagaaagaagatgtggtttggttcaaccacagctaggggcaaaaacatccaacaaaaaattatttggatgaaaattattttacaattgtaagaaatagcgaaaatggcattgtagctaatgcccatggcttaagattggatgtgtagcgaatctcattttaacgatagcatttttacgaagccagttccaaagaatggcacatatgcaaatttctaatttagttttgtatctctttctttatgcgattgttatgcctatgttttgctgaataaatatgtctacttgatatccttctgagatactccctctgttcttttttctacgatgttggttagttcaatttgacaaaccaacgtaataaattatgggaaggaggtaggcatgtttacacagcattcaaaaacaacaaaatcagcaagattaaccttgttgtaccattttgaccttggttaacatgcaccggataagtttgtgctctaaaatgagcattttacatgttcaaacactagatcgtagagtttgtgtatcaccaatgtaatttattctagatatttgctcaacttatttatttgttttatacaaattcccacaacaacgtgtgagcttttttctaatttctaataaaggaaaattgcaaaactcagtccaaatgtcactctgaatttgatattcctccatgtaagacgatttgttgcaaatgcctcttctaattcaccttgagatccccacaacccccccccccccccaaaaaaaaaaagccgttgctcatccattaccatggaggcaacaccacatgtactaatatctctgttattataaaaaaatgagggctgcag

SEQ ID NO: 80319 - DNA, 4229 bp, Oryza sativa
gcagaggcggcgacttgactccccccctccccgccctctcgctatagggtttcctcccttccccgtcatcagccgccaccccaccccctcccccgccgggcttcgccatgtacggtcaccgcgggtaagccaagcccctcctcttctctcttattcctgattaatctccgcaattccatcccgccgattcatccattgctttctttttttcctacaatacttgcttgcttacgcgatctcatcaatttctcgattcttttagggataatttctaagtaggtcactttgctttgctaccatgatatgatatgatatcatctgcctaggatttaggatacatgtacagcttcccccttacaagaccaaacctctctccccccaataaataaataaataaatcggaggcagtaatacatccaaattgatgtttcatcaactgcaccagcatcccaactgtggtttgtaagattcttttctactgatatgtgtcatccagtagtttgagtatttcttctattcatatgctgtcaacatttaattagtttttgtttatgtccactaatgcgttcgcatttcgactccattcacctttttaagccttaagtcatgtttagattactagtatttcttatctgtgcagttatctttatgtttgggttattttatatgaaatggggattgagagatggggggatcgtctcctttttttttcttttctctttttgggactctggattatctgaagggcaatgatgggaggcgggggggtttcggatgggtacgagggatcaaagaggccacgaatgatcgaatccaatccatacttcgcagtgaccgcaggcagtcccttggatgtctcaaagagggccaggatgatggaaccagcccctccctatttcggagccatgggcagcagcgctgctggtggcaccagtgccttctaccagccctacggcaccaacttacctggtgcaggggctaacagtgccatccagaactttccaggggtccgtctacgagggctcccctttgactgcgacgatcttgacatctgcaagttctttgttgggctggacatagtggactgcctcttggttcacaagaatggccgcttcaccggcgaggcttttgtcgtattcccatcacccatgcaagcagagtttgcactgcaccgcaaccggcagaacatgggcaggaggtatgttgaggtgttcagatgcaagaagcaagagtactacagtgcaatagctgctgaagtgaaccagggcggcttcttcgactcggagtaccgtcactccccacctcctccacggcccaagaaaccagctgaagacaagagcagcatggagtatactgaggtgctcaagctccgtggcctgccctactctgctaccactgaagacatcatcaagttctttgtggagtacgagctgacggacgaaaatgtgcacatcgtgtaccgtccagatggtaaggccactggagaagcctatgtggagttcccgacagcagaggttgtgaagacagccatgtgcaaggacaagatgaccattgggacaaggtacgtggagctgttcccatcaaccccagaggaggccagcagggcgaaatcgcgagtcaggcaatgaattatttgatccagtcatctactttgccctggccttgagcagctgtgttccagtttagctttcgccttgcatgcttaaactgtatccctcgcctttaggtttgtgtgtgtgtgttttagtatgcatcatgttgctaccgtgccacaacccgttggtgtggtgactttataagaacccgaattgcatttttaaaagaagtggtggattatgagatgcctgcactttaacagcagttgcgcctggttggatgcattttatatggcaatggcatgatcattgttttccttctgagtttgcgacagatgttctactgtatccccttctttttggtgaagcaggggatgaagctcgcactaactctgttccaaaagttggttgttaattaatatgaatatgcataaacataacgaggtgtacatcagtacatgcacgttgcggcccatggattgtgtgtgcatctgggatacggttttcccgattcctatgatctatccaatatgctaactctgaaactctaagcttcagcttaaagaaagctgggtgagaagatagtagtagctttttaattctgttcacatcactaattgggactacccccggacaacgattggttaagaccctgtttagatgggactaaaactttttaagtctctatcacatcggatttttggacactaattataaatattaaacgtagactattaataaaacccattcataatcttggactaattcgcgagacgaatctgttgagcctaattaatccatgattagcctatgtaatgctacaataaatattctctaattatggattaattaggtttaaaaaatttgtctcataaattagcttttatttatataattagttttataagtagtctatatttaatactctaaattagtgtctaaatacagagactaaagttaaatctctgtatccaaacaccacctaatagaagcaatgtttgtaacataccagcaccagcagctgtgcagtgtcaaatgcaggatgggctgagcagacaggaaaggttttgactgtcagttaatgttgggtgattttttagtcaacacttggtttgatgatctgtaccgttgactttgtaaacaaatgatctatattctactgtatgataaggttgaggtgctttgcggacaagcattaatcagccatcaatcaagccaatggagaagttccatgtagtttcaggattgggacacctcacagattttcagcgagtaaatgcatcatcacagcagctacaataacagactataagaatatattttaaggagataaaatagtgagcagagctgaactcagctgcgtctggagaaatttataatatgccactcaatagaggtactctaaccgaatgtcactatttaggatgttcttataaaaatgccactcaataaagataaagactcgttcttaataaaatgtcactttaggctattttgaggcttttaatcgcaaaagatgtgcggaatgacaaaaatacccatgtgtctttccctgcggcgataacgactccttctcggcgttggcgctgcggtggggcggcgggacggcggtggcggcgtcggcccctagcgcgactgagaggaaatcggccgtgcgtggacgggcgacgccgcgacggtagcacggccggccaggggcgcgcagacggggcggcgtcggcccctagctcctctcgactgcgcgcggtcaagtgacagcgacggcagcggcagctgggcgagcgcgcgccgacagggcggcggtggcggcgtcggcccctagcgtgccaagaagaagtcgtgagaaagagaagagacgcattctccagatctaaacgatcctaagggtatttcggtcatttcgcgagcttagtgtgagaaaaaaattaaaaatataaacaaataaaaaatgtctcaaaatagcccaaagtagcattttattaagaaacagtctctattgagtggcatttttataagaacatcctagagagcggtcttctgttaaagccacatctactaagtagcatattgttaagggcatgttcactttgaagccattttcaaccttaccaaattttggtaaagttaccaaaaaagtggctacatttagtttgctgtcaaattttagtaactatataagaaatcctaccaaaattttggtaagtcaactataccaaaattttggcattaccaaaatttggtaagttttttttttcgcataaagtgaaccggcactaaatttctccacctagatctgcacctgcaccagtacctgtacttgttctacttcttgttgtgcgaagtccagacccaattccaggctcaatcgtatcggcatcggtctcaggtaatgggcctaattccaggcccaacagtaagcaatgcagttcggtcatgggctcttcctcctcctatgcgtatagccgtataggaatagtcgtgtcgcgcctggattaggaccgcgctataaaatttaaaaatcaaggggttttttcgcaaaacgacgcgccctaacaacccaccccgcaagtcggcaaccctagccaccgccgccagtcccctcctcccccgcgctctccctcttcccataacgcc

SEQ ID NO: 80320 - DNA, 8757 bp, Oryza sativa
cccctgactggctaacgaaaactgcagtgtcttccctgtagatgggaccttgtctgtccagcaagtcacttgcaacctccatagtcacaggaatacctattgtccaaataatgcaaggaagaagtatctgggtcaagaaacaggtagctaatacatattgtcactgatgttgacatctaaaatttctacataaggagtcaggacaataagttggcataccagttaattcctccacaaaaggtcttgcagccaaggcagcattgtaacttgtaccacagccaatgaaaactaaccttctactgcgcctaatagttttgaggtactccttttcctttaatcctcctaaaagaacaccactatccttcactctacccctcatggttgttgttaatgaatgtggctgttcatggatttccttttgcatgaagtggtcataacttcctttctttatctgctcaacttccatctcaaggacagacaatgctcgttgcacagaagctggcttctctttctcatggtcaaacttaaggatagacacactgccatcctgcaatggccaaattgttaaagcttggacaaggcatcaaatgtaaggctaatgatgtcaaagaaacaaaagaactgttgcactagcgtgttcacatattatttcagtcaataaaaaaccagtgacacaataaaagtacaattgtcaaattggcagaaaaaatggtataaaggaaatagataactttaggtctagaaaagatagattgccccccattaaaaatgatctttctttctaaaaaagaaagtaaaggcaaaatagaacagataaggcaggtgaatcaacagagaaagctgaagagtaccttaatatgaacaatttcatcatcttcgatagccaaataattcttggtatgctccacaatagcaaataaatcactagagaagaataattctttgggcttcccgtttgttgtcagagctttgacatcatgaaatggtttcccactattttggccacttaattcctgaaaatagagacaacagttacaaatataaaaaaaatgtttccaagtcaaagggaagcagaatatttatagtatctataaatatgtgtaaaaaaatgattacacaaaagataacttctaaccaaaccaacatcaccataaaagaaaattatttaatctgcaagcaatctactgcacagtttctcacgtttgcatttttatagaacaaaacatgtggcagttaaccagagcaagtagttcgtagttactctattgagtgtggattttatcgcaggttccactctatgggaagaaaaaaatggtagttcttagcaccttttgacaagccaacatttgtgagaaaatgcacttcatgttttctagtttgacacttttacctaatacatgtttgaagcagatggagataagaacggtgaagagacaacagagttaaagttaacttttgatgttaggtctagtactacataataaagtcaacttgaacagcaaaagatgtagctcaagagcataacacataattcttacacaaaataaaaatcactgttttactatgcttgattagaacctagctgatagtttaagacaaaccaggatgcacttacattgacaccgagtatcagtgtgctgccccgtttgcatgcaatcaattcattggggtagtgtgggcttttaaagataagtgcgtaggctccttcaagctgcctcatgacttccataacaacttggctaaatgtcacatcacctgagaaaataataaaaagttgccttaactagaactagtacagtaagaccaacatatagaatctagttaccgatttcttttccttttgaattttgtaagaattctcctgccttgttaagagtaatgtattgcctaaataaaaatttctgagcgcgaaaagcataataaggtatatttattgcctcatctagttcttaggtggcaaatctagtttccaacatagatcatagtagtataattcttgctccaaagaaatgataatataattataacttgagaatgaaaggtttagctaaagatcagggagtacatcttgtctgttgtcaagaatataaataccttcttcatcatgcgccttatcaaaaacaaactttgccaacttagggatgacttctgtgtcagtatcagactcaaaggtgaacccgtgccggattagtgtctctttcagaacctgagcagatacatcagaaataccaagttatgatggaaatttatctgtttacatcattatcatctcttgctacattaatttgagatggtatcatgaggttacacatgatcatgaaaccaagtttgagatggttggctgattcataaatgtctaataaacttattgtgaattcagtatattgtcatttgccacttctataagataatattctctgcattacaacgacaataatctagcaaaatgagatagaactcactgatattctagttgctagttaatctacagcagttattttattccagtaaaagcatatgagctttcaactaaacggcagattatttaacaacaatagtgaggcgtctatggagattggagacagcccatgtgcagggcttggaagataacatgttggccaatagcataaatccaccatagttgcaataatgcatgtggattccccagctgtaaagatgatgagagaaatactatacaagaattctagtacaatatcagaacttcagaagagcaaggtaaacaagaacctcgtagtttgtgatgatgccattgtggacgaccaagaactcatcgccggcaccagaagattgggggtggctgttccttggggcaggcacaccatgcgtggcccacctggtgtgggcaattccagcatgcacattgaaggcggcgtccaggttcacatccttctcatcaacctctgaaaaatacacaaacatccaacatgacaaaagatagagtacaagagagcaccaaaattgtagccgagactaattgtatacggtataaatcgtcaggaaatccagagagaaaggaaatcagctctccaagtggtaaattgaataaatcaccgaaaatgccataaacccaagaagatttagagttgatccgaatgggtcaaattctaccttttctgaggagatccagaattttgggagctatgctatgccaatcccaaaaatgcaaagtgcgaacagaagaatttccctcgcaaggataactaaacccaaaatcgctaaacgacataatgatattccccaaaatgtgatatggatcccaatcaaaatccaaagcttttaccaagtgatacagccaagtcagaccacatagcacatggaaatcgtgcaaaaatccatcccaagaacccaaaattcaacccatttttcagcataatcaggagggaaaaggcactgaccggagtagacggatcgtacgaggttctcgatcttgccctcctggcggaacaccagcggggacgccccggcataggccggcaccgccgtagaagaagaagaagaagcgcaggagggaacgtcggcgtcgacggcgatgccggaggagtcgtagccgcggtactcgaggcggcggaggccattgaagaggacctcgaggatgtagcggcgctcccgcgacacattgtagttgaggtacgcgaagatcccgcacatcgtgcgccgcgccgcgctgggctgggcttctagaagcttccagaagtttccgggttcgggagagagagagagagggaggacgcggttacgacggcggcgaggagtcgccggccgaggcggaggaagaagaggagaaaaaggccgcgtttttttttttttgataggagaaggccgcgtatttgggtacgcggagtcaaagcccaaattttatactgatcgagtacagcaggacaggctgacgtgtagcctgtgacccagtagccgcacgatttggatcggacggctactgtagcgcacagctcttcgaaaggaaaaatggaaatctaggtgctccttactccctcaagttccatttctgtgcctaacaaactttgatcatatatcttatttaattttatttataattagtacttttattgttataagatgataacacataaatagtactttatgcgaaacttatgtttttaactttttttaaaaatattttaaataagacaaacaattaaagttagacacggaaaatcatggccatcctccttaaaatggaagggagtgagtgagtactcattacgggcggctgtcacttgtcatcacgtcaatgttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttaatacatgtgtagtacgtgttaaaaaaaatgctaatacatgtgtagatttgtcatgcttgtgccacgcgtcgcgtttctgattaatttggacgtcgatttttactcgtagttgcagtagatgacaactgagtgcgtgttttaagccatagtatggatcagatattttttggagagaaatatgcacacgtgttaggattttcagtcgtgttaatttgacactgagagattgtgtttattgctaattggagtgattaaagttgtagattagatggaatggatgcatggagtaacccaagtcagagtagcaaaggtctgggactggtcagcaaagggcagcgtggacgtagctcctctttcttttcttgcttgactcattctccctaaaaatctcctaccatctgcctaccagtttccaagaaacaaacaagtaccccccatgtttctgaaatttgatacttgtctattttgcttatgtcaagtatatagtaatgactaaactacgttctcatgcgataccacgtgattaatcaagtgtataactggtctactatttctttctctaatgggcactacccgagttctaaaaacacacacccaaatgaataatacgataattatcactggatgatgttgcttcagtttccagcctcccgaaaagaagcttccattactccaaagaactgttcactagagtacagataaacagagggaaccatacaaccagtccagagggacccaacgcagtgccaaacgtcaccatttcatgggcaatattgttacaagctctaggacagaacgtacatctctttactacatcaaaacggaaacaaagtccctagcttcacggataacaacagcatttgaaccgtcatctcataaatttgtcatccttaagagcttggaacagttagttgcttagattcggtttctgatataatctgacttgtacaaagcaaatcgccaattaagagctccaataccatagcttctgcttgtaacatatctttgtaaataaattcattgatctttcagctccttgacagcactgcatcttttatcatacacttacatggagttctgccctgcaggggatcacagagcagggcatagtacagtcaagaataatacagggaagcatatactccccttcgtcccaatttaaatgcaaccatgattttctgtgtccaactttgatcatctgtcttatttaaaaacaataaaaaaaacaaaaaaaaaacataagtcacgcataaagtaatattcatgttttataatctcataacaataaaaatactaattataaaaaaacaaatcaaataagacgaacgattaaaattaagcatggaaacttatggttgctcttaaaatggaacggatggagtatttccagcggggatcacggatggacatacatacagtacagcagatatattgggggcgccggccagtcctcagctttgtccacacctgtttctcaacatttttctatgctagttgctcctaacttggcctactgtcctccatctccaacaacacaagagtacaagacaagtactacaacggcaacaactatgcatgacatcaaaacgaaagctgggacctcgtcgatcaaagctaagcacaggcacataacaccctcaatgcaaccagcagcagcgaggaggccatgctgccatgaatcatgatcatggcgtcatcacaggagttcgaggctaatgacccacagcagctgcacgccaagcccaagaggctctaccaagtctggaagggaaacaacgtacctgctctttctttctttctttctttcttgctccagcgatctggctacagcttcttcaacttcatagcagcgaggtagactgattttccttcattttgcagatattcctgtgtggtggacgccttattattggcccggatgcagcctccctgctgctttccatgtttctcatccttggcccggccatcgtcttcagctatcagatggagtccacaatccaccgctctcaacaacggatgcatcgagctgcacagctgatagtcatcatcacaacagcagcggttagtgaatccccaaatcatttataagttgcttcttcacatataattttgattgccaatccgttctctagtgacatataccaaacaattaatccgcatggtagtcacagtgatttcagcttcaatatctgaaactgaaatcagtcaatcaggggttcaagattccacaagtctaatttccactatacaacatgtctagcactgtacagtcatgtgaatttcaccttcaaattgcaggaccttttcttcctcttcatgacatcagccagggacccagggatagtgccaaggaacacaagagcccacctgaagtcgatgaatttcttggctcaaccacaccatcgatggagtggagctcagggagaactccgcggatgaggttccgtaggtcaaaggatgttacagtcaatggcttcacggtgaaggtgaagttttgcgagacctgcctaaggtaccgcccaccacgatcctcacattgctccatctgcaacaactgcgtcgaaaagtttgatcaccactgtccatgggtcggccaatgcattggacttgtaagtaaacaatcaatgatgcagtaatcagtatagtcatcagcctaattcaatgtgcagttccagtactatttgtttccatagtgtttttagaaatatggtagagtataaccactatgcaatgaatttctcttaaaaaaaagctctatgaatgaatgaacttactttcaagtttccataagatgctggtaaatatgccaaaagagttcttcctctccaatggttaatgtccagccaaattccttccagtcatcttcagcatttgactatttataagttattcataaagctacagagcttaacaagacatttacgcttgaatttgtgagttataactttactttttagctaaaaggactcctcaatcatctaagttgaattacaccaggctcaatgtaagctattttttaattacaaaatcatcaagaatgagttgttaactagttccactgtttgactagacgtgcagataaggttaggcacctatgggaacagaacaatgaaattttcagagcaagacctaaactgtacctaacatacattttttaggactaaagcacatatttcgaaaagaatttctcgcaattaatgcagtgaacctaaggtcaaggaataacttatgtgaaagagcaggttaaccaagcactaatgatcatctgaactctatatttcagcaactcacaaatctcttatacagaaatgatgttaaagtattcttaagtgcgtgatcaatcattgcactctcggatggtttccacttgcttatcaaaatcatgccattttctattttttcttgcagaggaactaccgctacttctttctgtttgtagcgacatcgactttcctgtgcatatttgttttcatcttttcatgggtgaatgtctactatgaaaggggatacaatggcggatccatctggaaggctttgcgaaaggaagtatactcatttgtgctaatcatatatacttttatcgttgtatggtttgttggtggtctcacagtatttcatctttatctgatcagtactaatcaggtaaacctactttcttctttagctattctagagactttgctatagttactggttctcttatactgtaattcagtaaatgcattttaatgagtagacagtattaagagtttgagatagttctgataacttcaactagcagctccatacacggtgtttagttgtgtactgaatgtctaactagatccaactgcaaattctgcagacaacatatgaaaacttcagataccactacaacaaggacaacccctaccgaaagagcattgcagcaaactttgtagatgtgttcttcaccaagatccctccaccccagaacaatttccgttcatgggtaggtgagggcgcactggaagctggattttatactccatatattgcgctggatttgactgatccaagggaaaagatt

SEQ ID NO: 80321 - DNA, 14015 bp, Oryza sativa
tttttaatagatgatagtgttaatttttatacacgtttgactattcattttattcaaaaattttgtgcaaaatgcatgatataaattatactcaaaatactttcagtgataaaataactcacaacaaaacttttttttagataatgaaatataacatcccggtctttgcttaagagagctacaatctattattacaatctagcactccacatcgagtgtagttcaaaaaagaaagcaaacatcacggaaagataaaaatgaaccaataaataataaggtgaatatattattgaagtctatttgtgaatctccactcataattggcaaaaaactgcataaccgtcgactcaagcttgcggcatgcaacttttaggacctctccgtcttcgtcacacctttgtaattgtgcccaacaccagagtcaataaacgataactacgtaaacaatttaaataagacgaattgttaacttgtgtcaaaaatcaacggtatcgtacgtgcattaaaagacagaaaacatgatatttatatgataagctagtttattttagctgatatggacatatatcgaagattatagtttcttcttattgaccttgcgcttagtatttgcaacatcagtcgatgcgtatctggatagggtatgcacgacgtcgcgagacgcgagctagtttgtacgtacgaatttcgattgagggtgggggatagggtatccatcgatcggtggatcgatcagatctttgaccgatgtacgtacgtaggtacgatccaatcatgcaaagctaggtgtgatccgattatgtggccggccatctgtcatttgcattattgtggtcggaggccccagtttattaataaagggatttgcaaatcaattctaatcctagcttagctactaatctgttctcggttagtttctcaattattgtccaagactatacactccctatcttccagcagcgcggaaacgtaagcggtaggcggtacgctaaggtacgaatgtgacttgagcgaattaatatatacaccctttccgtttcatatcacatatttataaaacactttaataaatactccatcagttacatattataaaattttctagcattacctacatcaatataatcttaatatatatatctagattcattaacatatatatatgaatgtgaataatgctagaaaattttataatataaaacagaggaagtatatagtatatttgttttgtgttaaaaatattattatcactactagaaaaacgatttttcatggcgttaccatataattttcgctggcggccatacgcaaaaaccagcagcaaaaatataacgaggggaggggagttacggaccgctagcgaaaaccaattttcattggcggccacgctaaaaggttcgccataaaagaaactctatttttcgttgcggacctcttaagtgtccgccacggaaaatccgattttaggtggcggaccgtgaagagcaccgctacaaaaaaatatgtttcagcgctactaaaaatccaccgcctgcccaacgcatcactattaaaaatcacccacccacccacgtctcctcggtctcctcggctcccccacccacccatgtctccttcctccttcctccaccacccacgtctccttcctccttcctccactccctcctttctccctcctagccttctccctcccacctctccccagcggcggccggttgtggcaaacggagaaaggttgcggccggctgcgccctctcgccagatatgggggcgacggcagtggcggggaaggggcggcggctggctgcggcaaagggcgacggtagcggcggggaagggtcggccggctacggtggcaggcgatgagtccggcgaagagctctccttctccctcccacctctccctagcagcggccggctgcgccctcttgccagatatgggggtggcggcagcggcggggaagggatggcaaccggctgcggtggcgggcgacgagtccggcagcaagctccccttctccctcccacctctccccagcggcggccggctgcgccctcttgccagatctggggcaacagcagcggcggggaaggggcggcggctggctgcggcaaagggcaacgatagcggcggggaagggacgcggccggctgcggtggtgggcgacgggtccggcggtgggctctccttctccctctccctcctccgctgccgctagctgccgtcgccaccaccgccgtgggctgccgctagctaggggacggccgaatccggtcgccgcgatgtcggggaggccggatccgccgccgccgacgacctgggaggccggatccgccgccgcgacgacctgggaggccagatctgccgctgacgccgacgggggcagcgccgcgacgacttcaaattttttttctgatgcttgaatgcttgggtgaatggaaattttttaatgtaaattgttgatgtaattttctgttgatttttgaatgcgtggttaaatttctgtgaaaattttgaatggtggagcattgacggaggcggatagagctccgtccgtcgctttttttaaaaaaaaattggccagcattttcactagcggctggcacagtgaaacccgccagtgaaaaaacattttcgctggcgaccgtcttgtggcgagcttaagacgaccgccagcaaaaataaattattgctggcggtcgataaccgctagcgaagatcttgattttcactggcctttgcttcgtggcggctaggaattccgtcagcgaaaacccaaaatggcggccatgaaaaatagttttcgtattagtgttttattttttacaaatttgattaaattcaaataaatatgaacgaaatgtcttgtaatataaaatggatgaagatttttttttatacagtacaatgatgctttgtgtctgcatggccgtcgacgctcctagctagtttagctgctctggataaagccgatcggctggggttcagccagctaaccaatcaccattagtcgttgatcatgtcataatcgagctacatttctttaatggaaatgccttctgctaaaaaaattcatttaacataatcgagtacgtcttcgtcctactaaacaaattagcatacatgcatgtatatcaattttcaaaatcacacgagttgcatgcacaaacagaatatatatattaggatatcttattattaggtgatctctgtcttgcttaattcccttctgggcagtacagagatgcggatatccattctacagtactacaccggaaaattgacctgcagcaagtacatgcatacgcatgctgatctattctaattaatctatctgtccggccggccggaaagagagagatcatgccgcaaaagtcgtacttactcttttgagtcgctgtttgtaattatttaaaaaaattatgatattattatttatttttttacttgcttcattattaaaaatattttaagtatgatttatttttttatttacactaattttttacataacatggatgatcgaatggtcaaattggtcaaacattttaaggaaaaaaaatcaaaacgacatctaatttagaacggaggtaatacgtttgattttgactgaaactagcttgcaggataaacagagatagtagatacagatttgagcatatataaatcatactgcctagctagccacaaacgtgaatgaacaggtagggagaccgatggaaataatggattatgcatgtgcatagtaataaacgtgagcatgcaatgcaaggtcgtaagtaacctgcaggaggcaacgattaatcattaatcgacaagattggagacgtgaacattgcattgcccccatctccatgatagaactagctactagctagtactccaatataagggcatcctactgctagtctgctagcagcatgcagctgggccatggcgccatgtatcagccatggtcccatggatgcaaacaaaacacagtgcatcgatcgttcggtgtagtcgatcgttcggtgtagtcgatcgtctctgcatttgcatcaatgtacaaaaaaagtgctactgatccgtactttaattttacagttattcaatcaatatttttattactcactccttccaaaaaactgagacctatttcttttttcatcaaaaccaaaaagcaattaactcactcaccatgtggcaaaaccaatgaacattcaaccaataagtactagaatggcttcttgttttctgattaacaatttaatttagcatatagtgactgtaaataggactcagatttttggaaggagtgagtatatatatgattactacatctgtcttatataaatatataattatatattttcctatcattggagtatatcttttcttcttccaagtaggtaaataatcgtttttatctcttaattctcttatgttatgctagtgagtactataaatattataataatatggcaacttttaaactttacaatgcaattacaatgtaaatgtatacgtataatttatagtgtaaaaacaactctctctctctctctctataaagaagatgtgacagaaattgtgatgttataaatatgagactgtctatacatctgttaacagaaaatcccacctctcatctttcaaattctggaccgttgaatatgctttaggattcatgcacagctttaactctaactttttcctcccattcccctcctcttcgcgcattccgccgccgccgctaccctcgcgtgttccatctcgccactgctcgatccaccgccgccagcgccccactgtgccgccgcccgtctcgccgactggccgaagggcgtcaatggcaccggtgaggccacccggccagccccctcccctccccttccccctgtccttcccctccctttccttttctttcctcaagccgatggcggcgctgtcgtcttcctcgtctccgaaggtggggcgccaccactgaccgcctcctatctacctttccgctttgcccccaccgccagcttccgaccccgcagctttagcggcgccgccgccgccttcgccgcccaccgccggactgttgcctcccacgaccatccctctaaagctggcgaactccaccctcttccccctccctctcccacccctcctaccaccaccccaactcgggaccctaacccgtagggtcctctgccggagcctagggtattgccgacgccggagaaaaagaggaggtcgccgaagttggaggagaatgcctggagcacgaatcataaagcttatccagtggtccaaaatctgtaatatttggagaaaaatctgtaagatttggagatgtgttttctatcgagtcgacaaggttagcaattccgtataagggtaagatagttagccagtattttttatttggggcagcccaaactgcctaactagtttaaagccggtaaaggcaaagcctgcttgcagcggtagtccttccgttgtttgatttgggctaggcccattagcccactaaggcccagcccgtgtagctagcggccggctgcatgcattgcatgcttatgctgacgattaccagtccttttttttgggagaaattttcaggacgattagtggagtggagtacggtacgaaccttacctaaatatgtacctaatcccactgcaactactccgtacgtagcaattttaagctgaaacacaatgtggtttaatttgattcgatcgagtcaagcacgtacttacatgtatacttgatgacaacgacgactaatataatcgaaggcaaattgcacagaccaacaatttccttctgtattaaatatttgttagctgctgctacgtataattaaggaggccagacctgcatccaactgcgtagtagtgtctgcatcgtcgatgatcagaggcagagcaaaagcaagataacggcttggtgtaacaaacaaaactgcgaagagatcgagctaaaggcaagaattgtgacgacgacgcaccgcacttgcacggctagaacaaccaaactcatcatccatcattatttcccattcttttaaagttcgtctttccggcgccgtaaccaacacttgatactaaatcccagccgcccatgcttcaatatcgatcgataaatggaagcaagaactactatataagttagccgatcgatcgatagatatatatatagatagagcgcgttttgcacacgcatatatccatcgatcgattgatcatgcgctttagtcgtcacttgtccaactagctagctctacttccatatatcgatcgtccatgatggcggcggcggcggcctgcacgaagctgccgttgctgctcctgctcgtcgccgtcgccgtcgcagcgtcgtcggcgtcgtcactaacgccgcagcacgcggccgtgccggagaagggacctcgccccggcggcggcggcgttaccttgcacctcgaccaccgccaggtaattaactatacgcgtatgtgcttaattatattagcgatctgcagttagtattagctatcgatcagatcatccatgcgtttcgaccgaattacgcgtacgttgtttaattaagctgactgatatatactgcatctgcatgcatgcaggtgatggtggacaatggcatcgtgcaggtgtcgctgtcaaaacctgggggccacatcaccggcgtccgatacaacggcgaacgcaacctgctccgcttcgacggacaacccaactccgcagggtatattacactccatccatctctccatcggtgtaactactatatatagttttcttgctctttaactaattactcagttctttcaatttctcaaaacatacttagtacatacctgcctgtctttttttaatttttttctcaaaaagttcaaattcaacttctacatgttataaaaaaataacaaatataattattatggtacgataactattttcagttaaatttgttgtttctattgcaacttgtaaaagttgaatttagccttacatatttgtgaaattatatatattttatattaatctatgttatcatatttttaatttttttttgtgattatcttagatgacacatgtaaaaaaaaagatgatattcccttgatagatgaaaagccatctttatgttacataccagttacatctaaccatatataattaatttgatcttggtctgtctgcaggtactgggatgtggtatggaatttccccggatccaataatccaagaggcatgatcgatatgtacgtcattacttcttaactttattgtaaattaagtcatttatatatcgcctgctaactatactttgcttggtatatatgcatgcgctttgatctttcctgtgtttaaggtcctcaattcattttttgttctaaactgaaaaggatgcatccatatgctactttaattagagtcatccaaaatcatcatctttgcgtgtgttcttattccacatttgtatatatgatctgactactgttcaatctcaatttatttctaatttataccacttttctacttggaatgtgcaaaataaatgtcagttagaaagttggataaactaatactctcgttctaactgaacaactgaagtaggtacataatctgaaagtcactaccagccagtgagcaggtacttgcctagcttgctgtagttaatagtgttcttgttttattgccttgatctgttacagctcataacataattaacaagatcaacctacccaataaccacaatataacagtactagttcgatttaacaccacttgaacatatagctaccagcctgttaattgtaatcaatattatttcttttgaaccacccatattcatatggattgaagaacttgccttcaggccagataacaaacaagctcttgttgtgagtaaaatatgagcaagcctttgcagttcatcactctgcaccgaaagatgcctcctaatagcaatagtaccaagagcaacctgtaactgtgacttcagttcttttctgataagcaaacggtgttaaacaccgtcagaaattactgcctaataaacagaggatatgtacaagagctcaaatgattttctttctggaaaacataatttcacagtaatgtaaaatagtatgcactgcaccttattacgggctacagctgaacgaattatgcttttctctcaaaaaggatgaactaaatgactgaattttcacaggctggatagtactgaattcaaggtagtatcctcaagtgaagatcaagtggagctttccttcaggagcacctacaatccatcacgtccaaatagtgtcaggctaaacatcgacaagaggtactcctttagaattttcggacctatattaataaatttggctataatttatcctgccatatagtggtagtatacaaatatcactgccattttacgattgctgctctaaaatttgtgcaggcttgtgatgctgaaaggtagctcaggattctactgctatgccatctttgagcatgtcagggactggcctgctctcaacatttcagaggctcgcctcgccttcaaactgaacacggacaagtgagtattccttctcaaaaattgttctctgaagacattcaatatttgcttgatctgcagtctaatcttgaaaacatgtgttcatgaacgttttgtcaggttcaactacatggcgatctcagacgatatacagaggtttatgccgagtgcgacagacagagatgcacctcgcggtgctccattggcatacaaggaggctgtcctgctcgttgatcccaaggaaccacagttcagaggagaggtaattaactaaccgaattctgaaacatcttgcacgccaaattaatcaggctgtcatcttttaatcgactgtttgatgtatgcatctggtgattttctgaatttgtgatgtactaggtggatgacaagtacgagtactcgctggacaacaaggacaacagagttcatggatggattagcagcaatcaccctaaccccatgggattctgggtgatcacccccagcaacgagttcaagagcggcggccctctcaagcgagagctcacctcccatgtcggcccgacctctctgacagtaagatcaatcagttcaccctacaactaattactattcctccccgcaaaaaaaaaaaacaattactattcctaataacgaactctgcacttggaatcttggtacagagagaaaactgaaattttggttcgtgtcagatgtttcttggcacgcattacgtcgggaatgacattgttctgaagattgaggagggggagtactggaagaaggtgatgggcccggtgttcatctacctcaactccaatccgaggagaggagatctgcattcgctttgggtggatgccaagttgcaggcagaagctgaagctaggaaatggccatacagcttccctgtatcccctgacttccacaaggcaagtcagagaggatcagtcaccgggaggctatttgtcagagacaggtaagattcattactttcatagtttcaactccacacaggtacatgatgacttgcatttcatgggtcaagattgttcatggatcatcatctctgaaacgttgataatgtgtttgttttgatgttaattattattttatttcaggtacatgagcagtaaggacatggcagctgggatggcttttgttggcttggccactcctggacaacccggttcttgggtgacagagagcaaaaactaccaattctggacgagggcaacgccctgcggcagcttcagcatcagtaatgtgagagcaggagtgtacaacctctacgcatgggttcctgggtttcttggggactacatgtacacctcgcaagtaacagtaacaccaggttaagttagcactaattcagatggcatttggtattactccctccgttctaaatatttgacgtcgttaactttttaaacatgtttgaccattcgtcttattaaaaaaagtaattattaattattttcctatcatttgatttattgttgaatatactttcatgtatacatatagttttacatattttataaaattttttaataaaacgaattatcaaatatgtgctaaaaagtcaacggtgtcaaacatttagaaacggagggagtatttaacatgataatctggatcagaacaactctgtttaactaccattgtttgtctgaatttaagcaggacgtggcatcaacctcggtgatcttgtgttcgagcctccaagatcaggcccgacactgtgggagatgggtgttcctgacaggagtgcagcagagttcttcatccctgatcccaaccccaaatacctgaacaagatcttcatcaccaaagacaagtacaggcagtacgggttgtgggagaggtacgctgagctataccctgacggcgatctcgtcttcacgatcggcgagagcgacatctccaaggactggttcttcgcacacgtcacaaggtaattaaacaacaacgaacaaaacaatcaatcaatcaatcaatttcctctcgatcgattaacctctgaagaatcatcaagataaccaattgtgttttctttccttgttgtgcagaaagcaaggcgacgggtatgcggcgacgacgaggcagatccggttcaggctggagcgcgtcgtggcggacgccacctacacgctccgcgtcgagctggcggcggcgcagatggcgagggtgcaggtggtggtgaacggccgggcggacgaggcgttgacgacggcggcggcgttcggcgacgggaacgcgatagcgcggcacggggcacacggcgtgcagtggagcttggagttcgcgatcaaggggtacatgctggtggagggagaggaggagaatgtggtgttcatcacgcagacgagggcgttgagccccttcttcggcgtcatgtatgattacatccggttagagggtccttcttcttcgtggcgagatcctatgacgacgcgaggtcgatgaactagctcatacatttgcaaggtaggtagggctagtagctcgagagtatggtcctctttgtttaggcttataagccaacttataagccaaaaagtttaagcctaaacaaacaaacagctttttcgtttggcttttttaaagctataagccactcttacactattaagccaaaagctaggttggagaagcttttttttgcttatataagatagatgtatgacttcaccactaaacttaggacattaaattcactggcttataaatcatataagccaataagctgacttaaaagtctaagccaataagcctaagcctaaacaaagatggcctaaagctgatgcaaaatgactccctcaactatggtggctttttgttgatcaaagaaattaacaaaataaatatagggtccacatgtaagtgactacatctctcctcccttcccactctttttctctcggttccctcgccaaactgtgaaggcagcctgtgtggtggtggcatcttctcaaagatagggaagtgatggggttcggtttggtagttgagctcaaacggtggttaaccaggacaacgacgacatctttggatgtgattgaggagaaggtgatagaggtgccagtgggaactggacaccatactatactcccttgactcgatggccacctccaagcagttgctctgtccccgcgctactccttgtgtcgagttgcaccatcgacatcatggcaaggtgcctcagctccccgagccttaagtccttggcaacatctcgctcgagctcgagccccacgcttgccatcaccacgtcgaactcgagtgactcttcctccgaagtgagccaaccctccttggccctctccgttccaactgccagcatgattcggtggcatgcctctggtgacggttggcgagctagggttggcttccaggtggcggaggttacaccctaggaggcatgctcctagcagtagcataaaacacggggccatgtaccactcggagatgatccatggcggccctcccctatacgcttgtgtactccctccgtcccaaaaaacacaacctaggcaagcatgtgacatcttctaatacaatgaatctggatagccctttgtccagattcgatgtattagaaaatgtcacatcccctcctatgtttagttttttttttgcaacggaggagtacacttgtagtggagtggcggtggcaatctctctctatactcgcagggtgagagagaggagtaggagggagataagaggggaggatcccattttttttccaggagacttacattgggtcctgcctatttttaacattttattttattttattattggaatggtaggtaagtgccacgtcatataaaaactaggccaaagtgactcgtaaactcaacaccacagaggaggaaacctcaccattagcatcgcctagggagttaaattgatctggttttaacgattgagggggtctttatacctgattttaggattgatggacacgacccaaaaccgccctatagttgagggagaaaaatggactttctccaccaaaatatggttagtacacttgcattcgaaatttgaattttaccagcagacctacttatggtatttaattaatcaatcatgaattttacagaatacaaggaagcattattcctcctttccttatttccgtgtagtaatgtaaaaatgatagcaatggattaatacataattatcttatcgatgcaccacaaacacctctatataaagcctccatattatcttgtttgccaacggtatgatcctcgactgtcctgaagatcgactcctagagaatgatgtctcttcttgcattctttgcagcaaagcatattgttggcttcaacgacaactactgttcatggtgtacaaatcgatcccaatgacattatcaagaccatagaggtaagaatttctacattatgttaatcttctttatttaggattggttaggttaccacttcgcagatatctattaactatatatcatagtataaatctgtttaattttaatcacacaagatgaattctcaaatctaatattcctcatcttgatatatattcgatctggttgaattcatgaatttatatatagctgaacaactgaggtcattttggtccaggtagtaatttttccagtgatcattgaccttaccccccaaaaaagtttcatgtgctaattaagtctcactttggtttctaattgacagagcgagtgcggtgatattattgactgcgtggacatatacaagcaaccaagcctcaagaatccattgctcaaagatcataaaatcctggtgctgtacatacgtctgaacattttcattgtcgattactactttctcttcacgttataattataactacaaaatatttaggttctgaatagattcatgtatatgtttcatatatatacccaaatatatatggatgttagcaaatttagacgagagatggaaagatcaaaatcaaaatgttttaaatataaaacatatagaatattataatagttttttaaggaatgcgaccatttatatatgtatgtatgcaattgttagaaagaaagtaatactacctccatattttccatattttaatgtatgacgccgttgacttttttccaacgtttgatcattcatcttatttaaaaaatttatgtaattatcatttattttagtgtgacttgattcatcaccaaatgttctttaaatatgacatgaatattttcatatttgcacaaaaattttgaataaaacgaatggtcaaacgttggtcgaaaagtcaacgacgtcattcattaaaatacggagggagtagtaattaaggagagaattaagatcgaagaactaattgcagtctaagagctactagtactgatgtatgtgatgaatatatattgttcagttgaaaccaagcgtggatcgtcccaagatagttgagaagatgatggtgttgggaagaaacaactcgttcaaattcgcggagcaggcatggcatcgaagcggtaggt

SEQ ID NO: 80322 - DNA, 25486 bp, Oryza sativa
  unsure (1)..(25486): unsure at all n locations
agaataactattatacaccacttccaacccaaccactcctactctcagcctaacccaatcagcccacactatcccatcgccccatccctcacccccctccttgatcgatgtctttttttctcatccattttctcgtttctttttcaccttttcttttctcccaatcatcctgatcctgcatctgtgtttcaaaaaaaaaatcgtcctgcgcctctccctcttcttctaatcaactctcttttctcctcattttctctttttttttctcttcgaaatttccctcctcataaatatttttcttttgaaattatcattgtttaaggtatagatggctataaggcccgcccggcacggcccggcccaggcatggcccacggtcgtcgagccagcatggcacggtcagcacttcgggccgtgccgtgccagcctgaaggcaagggtagcccatcgtgccttcattaaaataagtttatttcccctcccttctttttggctgtgatatatatatatatatatatatatatatatatatatatatatatataataagtctattttacgtctctactctttgtgacgtgctttacatatgtttgagaataagtctgtttcgcatccctaaactttgggccgggccgtgtcgtcccagagtgccgaggaagcagcccaagcatggcacggctgttgggccgagccggcatgggcacgaccggagtcggaccgtgccgtgcttgggccgggccaaatttatcgggccttgggcgggccatatggccattgttgggatttcttaacgacattactagaaatataattccccgcaatggcgcagaaatacttctggtatattatggttacagagtgtatccgcaagcgcatggatataccattgtaccatttcacccgagagtattccaagggtatcgtatttattttatcccgtgggaagatcatgtagagagagattgactaatagtttatatattccttgtgataatcatattctaaacaggggttaagataatccaagggtagagtgacacacaagcatagagtgacacacaagcattaacaactcattctcataataaatgatctaagctaggtggaaagaaaagagaaagagaatctattcctatacctctaatatacataatatacatatattctagttaactgatatactagcaaataccctctatccgatgccctcctggtacttcgagaagctacccctgactgtcgaattccttacgacagcacgtcatgaccatacaaccggggctaaatacggaggaataccctccccagggaattaacttaggattatatataggcgcggaggaatacccgtactgagctgtcaccatcagcggcccacctctcatccgcaatatataaccccaaataatgatatcccgtaatctagacaccacgcctaaactaccagatactactctaatatcatcgtcatgacatagagtaattgcatatgcaaacattataccgcaccaaagcatctcccagataagctagccgtatattcagtataacatgaacataatgtaaagtaggtactcatatacttagaaagtatttcaataccataaatgtatatagaagagtattctaataaaagtacaaagcttacaaaagaggaaaggaaagctgctaaagccatacccgaactcttctgaaggcttccgaactcctgattcctgttctatttctatttcaccagctagatactactaaactaaacttgagagaaatgagagagctcttgcttgaggtgtgtgttgagtgaagagagtgagctccttatatagaggtagttatgatggttgtggaaggggaattatccaaagtgccctccaaccgtcattgggatgcaatcctggacatccacgccaaaacctggatccaactgcactaggattggttcggccaaacctggggctggcccaatccagcccaattttggctggtggcttcctctattgctccactctgcagacttgtgaattttggcccaattcatcgtgtcagttctgagttcttggcctattcatacacaagtctggttctcgacatcgtccgattgatttatcacctgagttgatgtcgattctcctccactttagtgtcattcccttcaagaggttagtatacctaatactagtggaagtttattattctaacagatatatgcattgcaatcatcactagttctcctctattttggtaatattgacggtcaaaactgatcgataacgaccgtcaacggccatctatagtttaaggtgtgtatggtgcaagtttgttacattgcaaatacttttcatctatagtaaaaaagactttcactaattgaataatcaaaattttaatctttggtcaatatgatatagcaaaatacccattcatcaatttatggaatagacatccgatcgatttgcgaggctatggaatggtgtatataaggtattcttcgtgtgatgacgcatgaggtgagcgctatcgggttcaatgttatatatgatttctgacttttttttgccattgttttgttagtcttatttcagtttgtcttttaaattggttgagtttttatcaattgtaaaaattgtcttcacctgttgctacacacatgcatttttgctagtgaatactaataggtgaagagccatgatcgttagtcatgtcggccatgccctatgacatgatcgtggcatcccaattcaggaagcccggcacgtcgttgggcggtagtggtcacgagtcttcttctaaaacattgggggcactacatgatgaattgttgtgcttacttcatggggttcggtggtggatgatttctttggtagattcaagatgataaagatgagcttggtgcaacacttaggtcactgttagtagactggtgagaaaagaagtcatagaatacatgcagacaaaggttaatgaatgcatggacaacggcaattggggaggactcacacaaagctaaatagtagggcgtattagcaataaatcattttataggggggaatcttaaactcaaggagatatttgggatggtttttgcatttttttattttagttaaccatggagctgttacacgccgagacgatggtatggcagcgagatggtgtaaaaggggtgcctagactagagaggagagtggtcgaataggaagttgcggagtgggtatcaggatcgctcacaatcgccttttgggactaacaagagttctttcccacactacaacatattcggccttccttgacggattgcctttgacaaatagggaatatgtcattgatgtttgacaaatattaaaagaagtcggcataaagttccgcctcaactgattctagtgatgactcaagtgtgatcataaaaattggtcacggaggcaaacgtggtcatcacaaataccgtgaaattcatcattagaatcagggatatcacatgcgaaaaagtattgtgtcataggagaattggtaggcaagatccacataggcccatagcaagctaatcccatttgtaagtatgagattgtacggtgaaattcatcatagactacccatgctatgggctagcacgcggtgatgaagtttttttttcatagaactaaccaataatagttgtaaggaggtctcacatataagtatgcaaaaaccttagaggagacagtttgtcatgtgtttattttgactgtgtgtgtttgtccgatgtttacttggtgaaatgtttgctaattcatacacaactgtggaagaattggcaggcaactgatttttgcaagtttgttacaagacttatagtgcggacatggtaaatcaagggttttactagagtcccttcatataaaatctttctatcgtataagcatgttgcatttagtgcacttctcaagttgttagcgagaagaacacaacaaactgtcgccactggctctgtttcacttgctcctagccgagtctaggattccaggattgactatccgtgttggatggattgagcggagaccggacgaattaatgaaggatgaaaaaaaatcaatgtgcctcgcatggcagatctgtcacatgttttgttccctcgcattgcgtcgagtcattgggattgatctaaaatgtatataatgaaatctcaattggaatctcatgccactaatcgaggtgcaaaaaaccttatagcgatggacgagagcgcttggtgacgatcggaaaattgcaaactttttaagtaggttagatttgatcaaaccaaaagaaatttgattagaaaaaaaaagtaaaagcgacgtataatacaaataatacaaaataaaggtattatgtagttttctgttacattcatttaaactagccataaatttgatcatgtttaagatggtttattagtttaccttagctcttaataaggttttgatataagttattttgtttataaagtatctatacttggctagaaacctccgaaaatttttatatggttagcccatttgtgattttgttttaatacatgcaatctttcgatccaatggccattatttatctgaactctttatctgacggctaatatatttttgatgatgtggcgcatcctggtaccagaaagcttgttgcttctgacggctaatatatttttgatgatgtggcacatcctcgtaccaaaaagctctgctttccctatataagataagattcgtagttttattttatttataaatgacaaaaatctattcctactcacagatcttgagtgattttttttaattatttcctaaataaaattcccggccaacggagtccggagccgtccaacaagattgttcctcacgccggcgtgccccccgccaccgcgcgccatcgccgtagaggctaccactgggacttcgaggtcgctcctctctccatctgggccgccgcccctctcgcgcaccgcgcggcctctctccctgcccctcgccctcgccacctcgccgatggcctccggctgtgcggcggcggcgggatgctggcttctcccagccgatatctaggccctgatccgagaggtgtgttcctcatctgtgatgcctaaagttttccttcgcttgttgcttggaacctcccgtagataatttgtgagaaccatacacgacctggtaatttttgtttaggtcggcattgaacgagctttagattttggggaagctttcttaattaggtgaggctggttgtttgctaatgttaattttgagagtggattgcgagatactttaaatttcgacgagtccacaaaaatgggtatttgtattggtcgaaattaaaaatattctgtttggatagaatcacaatttggaatcaaatatcaaaattgagttcaaattaatacggtgcgtcctactactacttatcgtactttggacgctaagatgtgttcttttgtgctctttggtgatagattttgacatggatctatgaatatggccagcagcactaaattaaaaggtgaggagaggctggataagcccaaagggtgcccccacgtctctccgtactacaatgccgccgatcctattatcatcaatggcaaagggattgatccctttgagctgagtgaaggtatggataaaagaagagtggcttcaattcttcaaagtttcacttgaggcaaccgagagaaaccacgctgcttcacaaggcaatggcgattccaatacggacagtagcagcctctggattctagattctggaaataaaagaggtattgctgaccataatgtgagtaaatgaacgaaatcttttatactgctggtgttatctacttggttcagagtttcagacaggaaattgcacctagtcctaggtaatgtgtgattgttttgttagctttatgaagacatcttatgtccaaattgctctgacagagggcattcgtcatgctatctggccagccagtaacattttcaattaaaatatcttgagtttgttttgcataagttgtctgctatgttaattaccaatcataatataacatatcagatcctgcacaatgaaagctggccaggaaatttgctttgtactttgtactcactgtcttatgtggcaatttttctcattaaaattggccagtgttcccgttgatggtgcctctgtagagttctactaatactcagcagtgcaggatttgagtgatccattatgtagttatatcatccatcgtagcaggagtaatcatatcatcctacagttatttcgaatcatcacttcactcatatcatgattaaagatgaaacccttcacttgcttaggggcgataggttgtgtcagtatatatgttggaaaacataaaaaagttagttatcccatataaggaggtccaatctactccaaatggttttgtttgggccttgtagaaagggtacagcactggattgaactttgcagaatatgcaaaaacagtaagtcatatgaagttgtgcacattcacttgcaattgctatgttagtgttcatcctagcccgtagaatgtgcttatttccttggatcagcagttaggctgcatatttttgttagtctatatccattactgcttcacatgcatgtcatctgtgcatatatcagtatgacttgcaggttgtcagtacatttctctatattggactcaacaatgtactctcaactgggaaggaaatcttcctgtgttgttaaaagcatctcaactgacaaaatgacaggtctacggtatgtataacatgtcctactgtgtacagacacagagatatggatcttattatgaacactgatgtttcttattttctatgcctagttttcttgaaatgagacagaaactataattttctcataaactactggaaattacaaattagcatacaaatttacggtaaatctaaagatgacagtggtgttgaatgtgagcctcctgtgatagcattcagtagtcttggcaatggtggcattttgagttctagtacaccctctaggaattgcaccacctcgcccattgttggtcgatcaaactcactgtcttgaatacaccaacatgcaattttgcaaactctttcagcctcctcgagattcacatcaccatgcaattttgcatccaccagatttccaatccctccattgataagctggcgggcgacttgcattggaaaataggcgaatggtcaccatccttgaaatattcttgacttgagttcctccttcctgataagatttcaaacaaaaccattccatagctgtaaacatcaactttagctgtaacaactgttccgctaatccattcaggggcaagatatccaatcgttcctctcattgtagtcagagcatgactaaattctctccccaaaatctttgccattccaaaatcagcaattttaggaacgaaagattcattgagaagtatgttctctggcttgatatcacaatgtataatgcaatctcgacagctatcatgcaagtaggcaaggcctctagcaactccaatagctatttggtatctaagattccaatccaaaactttatcattatccttaaatagttgcacatcaagggagccatttggcatgtattcatacacaagtaacttcttatcaccttcacaacaaagcccaatcaatttaactaaattgatgtgctggatcattccaattgaatccacttcggctctgaattgtttctccccttggcatgtgccgtcaagccttttcgctgcaatgggagttgactcatttaggtatcccttaaatacagaaccaaaactgcctcctcccaacttttctgaaaagtttttagttgcacgctgcagatcaatatatcgaaatgcagtaataccaatgctgccttgatcattttccgctccgcgagcaaacagtttcccttttctcctccaaaacatcagtagaaggatcatcaaacagaaagcagcagtgcttgcaccaatggcaacaccaatgatgactccactctttttcttcctttccgcactttgcacctcatgcacctcatttgcagcaaggcgaatgtaaaagttatcaccatttccgacagcagaagcatcagactgttgccttacgttatacagctcatcatgccaaacagagcatccacctttcccataggaatatgcagtacaggagcagttgctcaagcaaacatctgagcattcatctttacttgcagcttcctgcacatgcatggcattacggggcaatataatgttttgcacatagtagaacttatcgctgaaacctgtcttgttcatagtactaccacaatttaatggagtattcctcatacaccctcctgttcgatcttctatctcccaatccttgggtgatcttatagagaagcccttcatacagtcgcagaacggatcattgttgtcattgcagactgtaaaaggtccacagattgcgtaaacatcgcaatgaagtaagggcatcctgtaattgatcaaccaatcctgcaagctgtccaaccatacacctgccaaaccttgcccattgacatctattgcggcatgcgtaattgccttctcattgttcagagtatatgtgaggtaaacctctctgtcattgttgacaaatgtgaaattgggtatggtggcaccaaacatctctggtgctgagccaaaaaattgcccattccaatccccactggaccaatatgttacagttgagttccataccaaatgaccaacaccattgatatcaaattccaaagagtacaaaccagcagcctggtcaattgaattcttcctagaaacaaggcggcggttcaggccagtcaccttgttccagccgatcttcgcatcggcaaaaaggctatctgttgggtagtcaaagctctgccagaaaaccatggatgagtttgatgaactctgcagcacaagattaccatcgttcaacagcacaacaacggtgccgttggttgtggtgttaacacgggtagaccatatgatggacttggtagcctggtccatgatgaccatgtttccgtcgccggatattgttagctccggtgaagcggggtccaccactgggttttcgccattggcggaccacagtggagttatcatggggagcttgttgtaccatatgcaaaggtaagagttgcggctggtgtaggaggagttcttactgtccatcttgaagaagccgagagcgaacttgctgttgttggagataagcctgtcaccgccggccagtgtttggccgggtgacaccgtgtccgtagtggcatagctcgtcggagggtgcagggagagtaggaggaggaagccaagaaggacagacatgatggacaggacagtgaagaaagggaaggttagtggaggactggaatttgtaaggaatatgatcgattctgacgactgtgatgcaatgtttcgaagccagaccagttctgtgttttttatttagacaatatcagttctatgatcagttctgtgattttttagacaatatcagttctgtgttcagctctcagaatccaggtcaacgtcatggtgtgggtgcacgtcctaatcagtctgtattaagaactgacagtgggttaacctcgatcttaataatcttctcattggtcagacctaaacaatgcatcgttttgactgcgtaataatatgtgcaaactattcaagaaatatgtttgacatctcttccagcaacttccagttgagttaatcttttagagaaccccttttttttaaaactttgcagttcagtggaagttctttcacgacatcaatgcaatgggcgctgcttgttggagacttcttccattttttggaccaatatatcatgcttttatctccaaagggaaaacttaatccatgccaaagatttaagcactgatgagatcaatctgatattctttttccaacaggaaatcaatttcatgatgttcacagatttgggcaaaagcatgaccacgcgatgcgatacaatgatgccaacttcaaatcatcaaatgggttttgaatttggcactatgagaatgctgcatagtccagtacatggccgacaaaaaagtagtccagatatgcaagaagtgaagactgaaactgaattagggggagtcaaccagacgagtaaaagaaaatgttcagcacaggcttcatatcagaaagaatgacgcgcattgcatgtttgcatgtgcgcctgtgtgtgttgactgttgactgttgactgttgacgctgagccgcaaatctatctcgtggtcacgccgagatctgcaatttttggaagtgctagctggtataaagccaagagcatttttaagagtgggaggcaaaggcattttctaatttgaaaccactttggattgcaatcggagagcatactggagtagctctttctttcttttttaaataggctacaaaaatacccgtgcgttgcaacaagtgaaggctattttaatcttgttattgttatatggtttaggtaggatgaaatttattgtgttaaaatcgcttggatatatattttgttagaaaatcatgagttacaattaggagtccgatcgtcttaagttgacatacgagctttttttaatgagatttcttatacgatttcttttgtatttacaaaagtgaacgaacttaaaaacgggcttaaatacggatctgtgtttccaaaagcgaatgaatttaaaaactgactcatagacggatggcgtaccaaagtaccggcaaaaatatcttcaatttttataatagtagagattaagctgatttatttttaccgatctgtcctatataaaaatttagtccatataatacaattaatacttaagttatcaagtcatgataaaataaaatatgtttagtgatttttttaaattactagaaaaaatgcccgtgctttgcaacaggtgaaactattttttcactgaaattcactgtgagaattcatttagatatatatttttctaaaaaatcatgttaagttagcatgcgagttttttttaaaagaatttcttatacgactctttttgtattttcaaaagcgaatgaacttaaaacccgactcaaatacggatatgtattcccaaaagcgaacgaacttaaaaaccgacttatatttggatgtgtcagggttacggataagatataccctctacccttggatgtacgctatacgacaatattgtacatcggcgcgtgtacggacattctctgtatacgttaaggaaattcatctcgaagtccaccaatgcaaaggttcctacccgtataagactgggtcgtcaatatatcgtgcagagtccgatgtctctgagtcctacttggagaccacctgacctgcgatataaaagggaccccccgggaggacctaagggatcgaatctcatagccaacacagtgaccacaacctacgaagccagagtttgcaggagccaagtcaccgggtgatctagtcgaatcaactcgactacgatctcgtcagtatcatcgagttctgttatttcctttgtaatttgtggttctctccatataatcccatatcaattggattagggctattacctattaaggggcttgaaccagtataatctttatctcttgtttccttgatgtcatgctacgtagatcctcgtaccagcgtaccccaataccctctatatccggtctacgggtacccaccgtcgacagtggcgtgccaggtagggggacttggtgctcaagattctactactatgacatcaagcttcatcgacaacatcatcaacaccggccccattcaaggagtccctacttcaacaatgctgttgtggactcaagtcggcgaaatcgtcttcccggtttacaccacggtaccaatctcggctgatccatcaatgaccgatcccatgtcgaaggatcctcccgctgtagcggagaacggaacatcgacgtcatacgagcccgagaaggttcctagtgcggccaaaccttgtccttccgacaagaaccgcgagccgacaaggacaacttccgaggtaacaaagttctggtgtcctatccacaagtccaggaagtacaacttgcaagcttgctgggtttttctcaacgtacaagctgaaattcgtgcttgcaaggagcatggaatccagcgtacttctctaactcgtgatgtctattgtcctattcacaagacgaagaatcacgacttcttaagctgcaaggtctttctccgcgccatgaaaacgacgcttcctaaggtccagcagtcaggaacctcccttaaggatacagacaaggaacaaggagcgacgttgacctcggatcgattcattggagtaatcgacatcgatccccacgagccatcagtcctacacttgctcgaagactatggctcgtcatctgacagtacaccacgcgacgtgtttgccatcgatgggactagcacgtctgcacacgctaacgcagaggcggagaaccagacggtcacaccggcccaacaccttggcaccgtcaacgcaatactgagagaagctccctatgaccccgtgcttaacgatgatctcgcacgatggacagaacgactacgggaatcggtagctaatctcagtaacgcgttcgaggaggccgcaaccagagcacaaccagaacgaccgacaactgacggtgccgacggcgaaccaccggagcagcggacgtcgcctagacgagctacccctccacctcgcggcaccagcgatctttgcgaccatctgaatggccgccgagaagcacgacgcgcgcgagacaacgagaatcgttcccgacatcgtgtttcttcacgacatcgcgagaacgaagagcgaggaggccgctcgaacgaagaccaacaccaccataatcgtcacaaccgccgcgaccacgacaatcgcgaacagcggacaccagacgatgctggtcgaggccgtcaacatgacggtgatgataatggggatcggcgccaggacaacaatggtggacgacgacagaattctcgagaacctgaacgtcgccctcggaatcgcacaccggagccgagtgaatcatcgtcatcatcttcatcttcgtcatccgatagacatcgacggaggacacacgatcgccgacaacccaccgcccccagcgccgggtgtagagctttcaaccgttctctacgtgatgttcgatggcccaagagattctgacccggagcaatagagaagtacgatgggagcactgaccctgaagaattcctccaggtctactccacggtactatacgctgccggggcagacgacaacgcgttagcaaactatttgccaacggcgttgaaaggttctgcgtgtttggtgctgatgcacctcccaccctactcgatctcttcatgggcagatttgtggcagcagttcgtcgctaacttccaaggaacttacaagcgccacgcgatcgaagacgatttacacgcgttaacatagaatccgggtgaatctttgagggactatgttcggcgctttaatgagtgtagaaatacggtccccgatatcaccgatacttctgtgattcgcgctttcaaaactggtgtcagagatcgctatactacccaggagttggcaacaaggcgaatcacaactactcgaaggttgttcgaagttgtcgatcgatgcgcccatgcagacaacgcactgagacgcaagaacgacaagccaaaggcgagaggagagaagaagccagccaaggacgcacccaaatcaagcaagaagaaaagcggcaagagtaggaagaggaaagctcaaccggaagtcctcgcatctgaatacgagcgcccacccaaacacccaaacccacaaggcagtgatacgaagagaatatggtgccccatacacaagtcggacagacattctctggaggagtgcctcatcttcaaaaagtcgctggaaaagcaactggctttggagaagggcaagcgagtacgtgtagtcgagaaggccactgaggcaaccactcaggactcagactcggcgtacctagattccgatcttcatgtctcgcacatcttcggaggttccacagcgtactcttcaaagcgagaatacaaaaaagtggagcgtgaggtttgttcaacatggtatggggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattaaacaatattaatccaacactatacaacataccctgttgtataggcccaaccattctgaacaaccaccccggctgcacagtcctatctccaaaccaggaatgtaccattccaaaccaggagctaatcaaattattaccaattatagcatcatttactatggtgagaagggtgagactaatcacgaaagacattgttagacccgcccataaccgctggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaatcaatcacgattgaccatcgtgaactatcattaggccatcattaaataatagtgagtcataagttatcccaatagtgagctaatgtttctaagcaaggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgattttttaaagattaaatcggattaaaacacttaaatcggtttaaattgaattatgacgcaataatgaattatttttgaaaaggaaaaggggatttattgcgtcagcgggctagggtttgggtggaccggcgcacgggcggcggttcacacgaacggacggccgagattgatccaatccaaaacggacggccaagatcgatcggtccacgaccggctcacgggagaggatcccgatgacgtcaacgatgacgtcaccgacggcggcggcggctcggcagctgggtcggctcgggcggcgcacgcttgccggcgaacggcggcgcgagaacgcaaacggaaggcaccgggacgaagcgggcggcacggcgaactcaccgacgaccaaaagagcgacggagaagcaacggacggcgacggcgacgaggaggaagcggcggctaccttcgggttgtcgacggcgacgaagctccggcgggttccgacggctgcgaaggggcggacgaggacggcggcgacttggcgatgacgacggcggtcttcccgagcgacggcgacggctggaacgacggcggcgcacggctggagcggcggcggcgaaggcaaagctagggcacacggcgctagggctactccggcgacgagaggcgaaggcgagggctgcgacgggtagaggagacaccgggggtccttttaaaggggctcagaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccgaggatcatttcccctctattgattcggccggagaaggaaaggagcggccggatttggaaaggaaacggcggcggcgcgaaactagggtttcgggcggcggcggccgaaggtagacgacgactgacgggtgggccccacctgtctgcgacagcgcgctcgcgcgggcggctgcggactgggccggactgggccgagagagagaacggttttgggccgactttcggcccaaagccaaaagagactttttaaaacctttttcaatttaaattattccttaaatgcaattccatttattaaaaatactttcttagctcaaataaatcccagaaaaatctaggaattatagaattaagcaaagtatttaatgaaattttatctggcccctttttatattggaatttattaattaaacttagattttcttttcaagacttttaaaattatttctaaaaattccatttaaacaacaatttatatattttgaattttcagggtgtgacaggggttgcacccaagatgaagtggtctgaacagaagatcgagttctcagatgaggaccgccccaaggctactgttatcccaggacgatatccgatcgtggttgaacccactattcggaataacaaggtagtgcgagtcctcgtcgatggcggcagctccatcaaccttctcttcgccagcaccttggacgcaatggggattccacaaagcgtgttgacacctaccgatcaacccttccatggaatcactcagttttcgtccaagccattgggcaagatcacgcttcctgtgactttccgccaagcgagcaacttacgaacacagcagataacatttgatgttgctgagtttgacacagcatacaacgccatcatcggaagaactgcactcgcgaagttcatggccgcatctcactacgcgtatcaggtactcaagatgcccgggccgaagggaacaatcactattcaagggaacgcaaagctggcggtccaatgcgacaagcggagcctcgacatggtcgagcacacgcccagcccacccgccacagccgagccacccaagaaagtgatcagaacgactaagacgtcgaaatcagacggcacaatcaaaatcgttccactctccagtgccaaccccgacaagacagtcaagatcggagcatcactgaacgagaaataggaactcgcgctcatcaccttcctccacgacaatgcagacatattcgcttggcagccgtccgacatgccgggggtccccagggaggtgattgagcacaaactcatggtgcgacccgatgccaagccagtaaagtaaaaactgcggagatttgcaccagatcgaaaacaagccatacgagaagagctcgataaacttctcaaagctggtttcatcagagaggtactccatccagagtggctagctaacccagtcatggtgcggaaggccaacgggaaatagaggatgtgcatcaacttcaccgacctcaacaaggcgtgccccaaggatcacttccctctccctcgaataaaccaactagtggactcaacagctggttgcgagctgttaagcttccttgacgcttactccggctaccactaaatcagcatggcaaaagaggacgagaagaagacaacattcatcacgccgttcggtgtattctgctatgttaaaatgccgtttggactgataaccgcaggaaataccttccagcgtacgatccaaggggcacttagcgatcagctgggtaacaatgttgaggcctacgtcgatgacattgttgtcaagaccaagacaggtgactcattcattgatgatctacgggaaaccttcgataacctcagacgatatcgcctcatgctcaatcctaagaagtgcacgttcggggtaccgttaggcaaactgctcgggttcctcgtctctggcagaggaatagaagcaaaccccgagaagatcaatgcaatcgagaacatgaagtcgcccacaagactcaaggaggtacagaagctaaccagatgcatggcggcactaagtaggttcgtcgctaggatgggagaacgaggacaacatttcttcgctctgctaaaaaagcaagacaaatttgtatggacacaggcagccgaagaggcgttcatcgcactcaagcgctacctgtcaaatccccctgtacatgttgctccccaacctaatgaagagttatttctctatattgccgccacgccctactctgtgagtactgtcattgttgttgaaagagaaaaggtgcagagaccagtctattacgtcagcgaagctctccacgacgcgaagacaaggtacccacagatccaaaaactgctctacacggtaatcatgacgtcaagaaagctacgccactacttccaagccaacagggtcatagttatctccgccatccctcttggcgaagtcgtgagaaacaaagacgttgtcgtccgcattgcgaaatgggtagtcgagctaagccagtttgacgtccactttgtaccacgaacagccatcaagtcccaggttctcgccgatttcgtagccgattggactatgcctgaaaacaggttagacagtcagaccgacaacgaaacatggacaatggcgttcgatggtgtgctcaacagccaaggagcaagtgcggggttcatcttgacatcaccttcgggagatcagttcaagcatgcaattcaccttaactttagggcgaccaacaacacagccgagtacgaagggctactcgttgggataagagctgcagccgcacttggggtcaagcgactaatcgtaaaaggggattccgaactagtcgcaaaccaggtgcacaaagattacaaatgctctagcctgagttgtctaagtatctcgcagaagtcaggaagctggaaaaaagatttgatgggatcgaggtccgacacgtatatcacaagaacaacatcgagtcggacgatctagcacggcgtgcgtccagacgagagccactcgaacccagcacctttctggacatcctgacaaagccatcagtgaaagaggcaaacgacgaagatagcccagtcacccccgacatcagctcgggggctacagaggcagagcgcgatgttgccgacatcgagaccacggacgactggcggaccccactcattaaattcataagcagcgacgagttacccgaggatgatgcagaagccgagaaaataacccgtcaagcaaaaatctactgtatgatcggcaacgatctatacaagaaggcgccaaatggggtacttctcaaatgcgtctcgtccgacgacggcaaacacctcctcctcgacatacacaaaggggtctgtgggtcacatgccgtcggtcgtacattggtcggaaaagcctttcgacaaggatttttctggccaaccgccctcaaagacgcttgcgacatggtacaacggtgtgaaggttgtcaatttcatagcaaacacacaaagctaccagcgcaagcactgcaaaccatccctctcacttggccgttctcatgctgggggctcgacatactcggtccattcctacgaggacagggcagctacaaattcctattcgtggcaatcgacaaattcaacaaatagatcgaggcaacatccacgggggaaatcaaggctgacaacgccatcaaattcatcaaggggatattttgcagatatggattggctcaccgcatcataacggataacggctcccagttcatcagcgccgatttccaagattactacgtcggactgggagtcaatgtcacgcccggaatttctatccaaaattccaaacgcttacatgtgtgtgaaccctcgtccaggaatcagccgaggcacacaataacaaattgataatagagtgcaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacgaaacagttaagtaataattaaacaatattaatccaacgctatacaacataccctgttgtataggcccaaccattctgaacaaccacccggctgcacagttctatctccaaaccaggaatgtaccattccaaaccaggagctaatcaaattattatcagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccatgttttagttggcacattaattaattaactaatcacgattgaccatcgtgaactatcaataagccatcatgaaataatagtgagtcattagttatcccataagtgtactaatgtttctaagcaaggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaattcggattaaaacacttatattgattttaattgaattatgacgcaataatgaattatttttgaaaaggaaaaagggatttattgcgtcagcgggctagggtttgcggtggaccgggcgcacgggcgacggttcacgcgaacggacggccgagatcgatcggtccacgaccggctcacaacggacggggacgatgacgtcagcgatgacgtcaccaccggcggcggcggctcggcggctcggacggcgcacgctcgccggcgaacggcggcgctttggcacgaacggagagcaccaacgggtagcggacggcacggcgaactcaccggcgaccaaagcgacggcggaagaggaacggacggcgacggcgacgaagaagaaacggcggcggtcttcgggttgacggcgacggcgatgctccggcgttcttcggcgactacgaagaggcggacgaggacggtgacgacttggcgatcccgacggtggccttcccgagcgacggcgacgaccggaacggcggcggcgcacggctggagcgacggcggcgacggcggcgctaggttgcacggcgctagagctcttccggcgacgagaggcgaaggcgagggtggcggcgggtagaggagacaccgaggagccttttaaaggggctaggaggcggcggcgaaggcccacggcggccggcgacgagaaggaaagatcggggtttgaaggaaaaagaccgatccgattcgaactcgaatcaaacacattccaaaccgatttagccgatgtttccaaaagagaaaaggtagaggagatcccgaggatcatttcccctctatcaatacggccggagaaggaaagggacggccggatttggaaaggaacggcggcggcgcgaaactagggtttcgggcggcggtggcgtgacgaagatgacgaccctgacaggtgggccccacctgtcagcgggcggacgtgtgcgcgcgcggcggcggactgggccggactgggccgaggagagagagagcggttttgggccgactttcggcccaaagccaaaagagatttttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaattatttctaaaaaattccatttaaacaacaatttatatattttgaattttcagggtgtgacaagtcagcggccggctatatctcgtggctgaacggggcatgcgctcagctcgaaggcatcggcaagcatatcgacgaggccctgaagcaggagtgccgtcgatcgagctggtttgccgaagggcacgtgctggcatgtatacgagatcatcgtccgcagttgcacctcgagttcttccacgagggattttctcgttctcggaggactcccgcggaggtagacaacctggcgaagtcgatggcgccgctggcggagaaagtcttccagtcgatggattggcgttggccttcctggtagtctttgtatatctgtgacaagcatcttagattaagtgtaatatattttggaattttttgcagcctgtaaggaatacttgtgaaatagaaaggaagtctatctaactaagctttcttactctggatgtggtgtgtacgagtgtcttctcacttcgcgacttcgatcattcacttgagttatacactcttcctagcccccagccttgtcgtcggagaattcttctcggaagataaggctcttagacctttgacttgccttagttgaataaacactgatcctagcccccagccgtgaagttggaaaatccatttccgattacacggcttggttaatacgcacggcgagaactcttacacgaccagatcttatatggtctttcgtctctgaagaatccgacaaggccttatcagctctgggcatccccagccgaagttcccttagattcctcggaggccttgtcaagacggcgtaaagggacatgtgaataggtttcaacactaggtatcatctgggtaagggatcatcgggaagggacactttgattgaaatttgcatcttaaaacaggctttattgaagttgtaaggtgtcttacaagtatggatactattgacttatacataaaatttacgcaattggtcaatcttccacgaatttgctaactcgcaaccgtcgccgtctgcaatcttgaatacgcctggccgcaagacttgtgtgatcgtatacggtccttcccatttgggtgagagtttgtttcgccctgcttggctttgaactcgccggaggacgtagtcgccgatcgaaagtatgcgtgctcggatgcgcttctcgtgatagcggtggagggcctgttggtagctagctgccctaacggcacccgttctcaatgttcctcgagttggttcacgtcatcgtttcgctattcctcctgatcctcgtcagagtacttctgtactcgtgtactctgatgtcgtaactcggtagggagcatggcttctgaaccgtacatgaggaagaagggtgtctccttgttggacattgtcggtgtggtgcgcacggcccatagtaccgaggggagttcttcgacccacttcttgtcatgtgacatgagcctgtcgtagatatgggtcttgatcccttgtagtactatgccgtttgccctctcgacctgtccgttactctgagggtgagaaaccgaggcgaagcagatattgactgtcacaccctgaaaatttaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttgcaaagcgtcgaagacgagttcgattcggatcggttatccctctctccaagcngaaggtttcataaaaaaaaaaagtcgccgtggcaaacaccgaa

SEQ ID NO: 80323 - DNA, 4191 bp, Oryza sativa
ctatttagggaactcttctcatcacttcttccacacacctcaagcaagaagtttcatacatcctcatgcttagtatagtctctagggtatagtggaatagaaatagaatagagttttcagtcgtcggagtcttcggaagaattcgggtatggctctagtagcttttccttcttttgtaagacttgtactttatttagaatattcttctttatactactttggtatagaactactttccgagtatgaataccaactttattatatatccatgttatattcattatgatgatagcttatctgggagatgcaatggtgtgggcatactaatcatatttacgatgactctatatcatgatgatgatattagagtagtatttggtgatttatgcgtggtgtttagattactggatatctttatttagggttatatgctacggaagcgaggtaggccgttgatggtgacagctcagtacgggtattcctccgcgtgtgtatatagtcctaagttaatttcctggggagggtactcctccatatttagccccggttggatggtcaagacggattgtcgtaaggaactcggtgtcacaccctgaagttctttcccaagccaaaattgaatttataaattacctagaggaaatatcggtgtaaaagcaagagagaaacctaataaattaatgcaaataataatcgggattggcatgtggaatttttcttgagttctacatgtcgaaatatgctaacaagatttttagtggaattttcagagccctagaaataattttaaccaactaaaaatgagcacaagcattatttaatccctagaaatcaattctttctttttcttttctttttccctcctttttcttttcgaatgggccgctggcccattctctccccctccccctccccgttgggccgggccgcaggccacggcctagccagccgcccgagccccctcctctctccccgggtcgccgacaggtggggccctcctgtcgggcccgtctccctcctcgagctggcgccgccgcgcccagcaaccgtcgccgcgccccgctcctgcgtctcccgggccacgtcgcccacgtcaccctcgtgcccgcgtccccgcgcccacttccccctctctcccgcccgcgcccgcgctcgagacggccgggattcaatttttgaatcccgcctctctctcctccccacctctccccactccgccggcgaaatcgcgatctccccggccacgatcgaccctcgtgggtctaaataaagcacccccgttccctcctctctctttttcgttttgcaatcacctgctccagtgcactccaccgccctagcgccgtcgtcctcctctccggcgcccgccgccgccgctccggtcgccgctagctgccgctagccaccgtgccgagccgtgccgtcgacgttgttgcgttcaccgtcgtgcgggccgtcccgtccacccctcctccgtagcaatccgccgccggagccccgtccgcgccgcgcgccggtgagcttcgccatggccggcgccttcggttgccgccctagccatccatggtttccccctccctctctaactcatcccttttgatcccttaggtggttccgcagcccgtctcgccgtcgccatcgccctccgtcgctcgccgtcgtcggtcgccgtcggtgagacccctcctccccttcctccctctctcccgcgccgcttagccgccgcgccggcgcctagccgttaaccgccgctgtcgccgtctggtcgctgtgacgccaccgccctccgccgccggccggtcgccgccggtcgccgccttgcatcgccgtcgcgtcgtgctgcgccgcagcgcgccacgaccgccgggtcagcttgagccgtgcccgtgcgcgcccggccacgagccgcctccgccgtccgatctaccgggcggtatatcggggccgtccaaccccgccgcccgcgtggctgccacgtggccgccacgtgtgcgccgcgtcagcgccacgtgtgcacaacgtggtgcgccgctcctccccggtccgtggacccggtccaccatggaccgccctccccgagtcactgccttgtggggcccgcatgtcggcgccgcccctccctctcccggtatttatttattacgcaataaatcaattaaggatgtttccgtttaagcccattcaagtctcagtaaatcaagaaaaatgtatagaatccattaaaaatggttttgttctctgtttcagtagtcttatggcctgtttgtattgttttctttgtatgtcgcttagattccggctctcccaccgctccggtgtactttgaaataatcgccgaggttcctccagcagcagagcaaggtaagtcatgcttgtcacttgaacatgttgatcctatattgcaaatgctctatcgttttcctttaaatactgcatcgttttataatgttactatgggatgtttacctactgttacagccacgctaatttttgtaccatgctcctttgttagcttggggtataacatgactagagattggactagggattgcttagccatgcttagttcaactagcacacaatgggggaaatacattaatacatagatatcagattctagtaatgatggttaataccaccgctccggtgttggttaattaaaattaactaaattgtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtgatggagtttggatgggccttgcgacggcctatgtggcttccggattcacctaggcacgagaggggactgcccgctgccttgcgaggggtgggggtgaaacctgtggtgtggtgtgcttggttagagggggttatgcgaagggtcctgtcacggtctctatccggtatgtcgtggtggcatgtcggtgcacagaaacgtgtcgtggggctgtgtcttgtgggtacatgtcacgcccggaatttctatccaaaattccaaacgcttacatgtgtgtaaaccctcgtccaggaatcagccgaggcacacaataacaaagataatagagtaccattattactctaattaataagcgaataaaatgtcattacagaggtagatagttcctctcaatcaataaagatctaagtagcggaaaataagataaacggcacagacgactccactccacaggcagcttgaccagggttacacctaatcctccacaccaacagcttcactgtagaactcttcctctgatgaacgattgcaaggtgagtatatgacatactcagcaagtcacgcagcaaatatgcaagtgcacaggataacaaaggatggcatagtagggtttcatttgcataaacagcatttaataaacatttgagaatttaataaaacagttaagtaataattaaacaatattaatccaacgctatacaatataccctgttgtataagcccaaccattctgaacaaccacacccggctgtacagatctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgatcagaggcgtaccactgtacccacaagacacagccccacatcatgtcaccatgtgcctcaataccaccacggtacctcggaaaggagctgtgacaataccccttgcgtaacacaatccaccgcagcgcaccattcctggatcataatcacccccttataaacaaggcatggactccccagcatcccctgtgggcttatctccgccacttctcagtctggtgcccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaggtttagttggcaagtaattaattaaccaatcacgattgaccatcgtgaact

SEQ ID NO: 80324 - DNA, 14969 bp, Oryza sativa
tcccaacagtgcttcagaacatagactatggttcctttgaagataatccagatgacaagaacaggaatgaagatgatagactagtgccttttgcttcaacttgggcacaacaagcaaatgaaggtgctcgaacatctgaaatagctactgtagaatataaggacgaaataagtgaagatggtggtaaggaaattattagttcaaacacaagttcagaacaaacatcaatagaagctaatgcagcagcatctgaggatgaaagcaatgaggacaatgctggaaaaagtaacagttcagatagaagttctacccaaaatttgggggatgtgaactatagctctgtattactcatctaaattgataatctgttcatatacatggccattatgagttgacattattcttagcattacacatgataaataaaaacagaaaatgaatgactgtatgcctcagcaaaatttttagaatgtattagtttacgtctagaagcccatgttgcactgttcacgctttcctgcactatatgtttctaatttctgtagcatgtgggccgtaatgtggacataaaaagaaaagagttctgttgattgattactaccttaatgatgcaacagttcagattgctctactgcctttatggtactacaaaggtgaagctaacgatgcagatgtggagcaagtcacagaaggggcttgacattcacaaaataatccataaagcaggaccaagataatgtaaattgttaagtaatgattccattgctcattatttggtaaaaaaaaatacagctgcttacagcttacaagctaaactttccagactaactgaaatctggaatttgaaagcaaattactggtcgctaaaaggcagtaccaaagattgcacatttctgcaaaaatgaaattcctcacgcctgatagacatctggaagctgaaggcctacactggcagcagatttgttcaatatcttcttcatctcctctgatcggtccacagctatattatacgagaatagcaggtcctgggcaatcaaacatgatttacagagttaacatggtatacagtgcatgaacaaccaatctaaactaggtgtgatgtactgggaagtgggaattagcaatgaagcaactgcgagtttgtatactaaaacacaccgaaggaagttcaattcatcacgttaatcagagtttgatttggggaaaaaaatagcaaggaacccaatagaaaggggagtttcagtcaaaaaaaaatagaaaggggaaagaagccttctagccatttcatcgaacacatttatctgctaaaacaatgcgcaaaacaggagaagattatacgcatctagaaatggctccaaccttgtggtggtggacgctggcgaggaggtaggcgtaatccccggcgagccgcagccgcgctctggcgtcggcgtccgtgccagtggggcggcggaactcggaggcgacgaactcgcggaagtgcttcttggagtccccccgccgacgtgcttctgcaccgccttgagcacccgccggtagacggccgccgacgtggccaccatcgatctgtccacggatccgccgcgagaggaggcaatcggacgcggagactgcgggtcgccggcctcgccttcttggccgtgtcgatcgaactggaactgtagaggaggaggaggaggaggaataggtaggcgtccccttgccggagattctcctctgcagttgccggagttcgccggagcttctccgccttcttcaggaaggagtaaaggacagagtaaagggactgaagtaaaaaaaattgcaaagaatgaaaagggctattctgcaaatatccatcttcatcctgagcctcaatctgaccgtccatcttcgatctaacgcccaaaacatttgcaaatcagaccatggtttggtttggattggactgctacgagtttgcatataaccaaaaatgcttctcgctcgaacatttcagcataaaataacttttttctttatttgaagatggcttatcaatactttattatatctattataaagctttaagtttttccagggcggatccaggaatgaaaaatagaaggggctcaacatacgggaaaaaccgacataaacatatcatgtctcatacaatattacagtatcaacaggtacccctatatcatggtctgcaatttcgattctaaaaaatttaggaattctgcaacaccatcccccaaggaaactatcacacccaaataaaatcatttttcttgtgaagtttaacaaaatctattcaattttggtaaaaaaaaaattcaaatatcgaaaaactttcttgcctaaaaatttcgaaatttgcagtactaatcttgaattcctagctaatctaagctccctgattcaaatattggccatctttgtttaggcttaaacttattggcttagacttttaagtcagcttattggcttatatgatttataagccagtgaatttaatgtcctaagtttagtggtagagtcatacatctatcttatataagccaaaaaaagcttctccaacttagcttttggcttaatagtgtaagagtggcttataactttaagaaagccaaacgaaaaaactgcttgtttgtttaggcttagactttttggcttataagttgacttataagcctaaacaaagaggaccttaatagtggaagggatcgccaatatatcgggttttacggttatgtgatacaaatcaaatcagatttgcccaataattgagcgagtaaaaacgaactttttcctactttttgcagcacgcctgatgatgcgtttgtgatatcgtgggcctcaaccaggtgccagcactcccgtcctgaggccatcgacgcttcccatataattttggcccggaactccaattccatcacatacaatatcggcccagtatgtttgtgggcttccggcccaaatcgccttgggctgtagcctacgggtactcaggtctctgggggagtcaagggtttaacccgtcctgcgacgcggagcaccggccgccgctcgccgacgcaagacaacgacgatgccgagcttccctccgcccggcaccgtcaccatctgcgagatcaaccgcgacctaggtgtgctatccactccctgctccccctctctctgctgtctccaatccgcttcgcttgctagctgggctgctcattccaagtctgtgcgttgcagttgcggcggatgcgctgtccgacgatggagccaaggatgcctacggggatgtcctcgtcagtacactcccatcttccccccttcctcctccgcctcgcatagtttcgtctttcttctttttcacaacactaattttattaggcctctaattgaaactttaatttgggatttcttctccagggaatggtcttcagcccgattcctttccagccggatgcgattgttgccacccacgagcctcctgctgtcactgaagctgctgagattgtccccagaacaagtttagcttccaccgtagctgagtccttcaaacaaatgctattcccttcttgcgatgtgagttggttctttatcatatcttagtgactcaattgcgaataattaatatatctccatattctgtttatgtcataatatcagttggcatagtatactgttagattgaatttatttatttatttttaatataagggaggaatatgcctctggtcagcgtcatatcatgacaatgttgcatttgtgaaatctggtacctttcctagaggttctagtggccaagggatgcttgtggacattctctattgttcttctgctgaaggtagtagcctagtaggaaaggatcctatggcttacaaaatattgtatactcgcttcaacaaattatagatatcatcgtcgaaaaaagtacagatatatttttcatccatatgatttcactaaaggaggtaaaattactgaaggcgtgcagggtattgaaatgaacactcaaagtcatataatggatgaaacataatttatgtcatactgagtgcatgcactgtatcgaaatgaacactcaaagtcatataagtgaccaaacattaacttatggcatagaagggattaagtgaaaacttagtgaaacataaagaacattctcttttaaatatcggtgtccctggaaacagataagtggtattttcaccagataaaatgtagaccccagaattttgcattccaaaattagttaccagtaatcggtcagaaattttaacatgagaaaagaaaaaagatctgacatataaaatacattaatacatcacaaatagatcataatgattgtagggatataatccatagggacatgcttcacaaaaaaagtatataacatacaatagttccaccacaaatgtggcaattgatttaattctagaactggatgtgagtatttctttttccttcagaaatgtaacaacaaataaacttgaaagagaagatgaagttggcatacttccaaagttgaatttaaattgttccaatcaatttattggtactggttcattggcttaggagcggcaactgatcacttaccgctggctgtatcatgactcctctttgtgcatattcaacactgcattatttaattttgtcttctaattaacatacttgctccatttttcagttcttccttaaggaccaatgctgtgtctaatttccataccctcgaggataagtcctttcttcgagttgagctggacgatctcttgcaggttgataacaaccattccatctccttggtggttgtagaagtgccccagttgtacctccatccagccgtcaccccgttctctcggatagctcactgtctcctctgctcgtcctacttcgcttctacccatgtcaagaggtgtctcttgcgtgcgtgggtgcagagagacggtgcgcttggcagacactacttgatcgtccatggtgatatatgcctcttgtgtccggcagtcaagcccgtatgatttatctgccaatttgaagatgagatagactatgtatcgtgtgttgggtgagagctctctgcagttgatgcggccacgcaaatggaaccagcagacaaatacaagcgcagctactctttcaaacctgaaacaaggagaaactttggtttttgtttaattatcgagaaaaaaaatcaaagcaaatcaaagaatagtatgtatattgaatttaaacactatctgattgagaatgtttattatagtttatttcttaatgattttgtatttctaaaagaagtgtcatgtatatgtgattatgtttgcaaaataagtgcttcagatttatcctccacgtttgggatgcaaacctggaatcgggtaagtagatccatctccagtaccgggcatcatccccccatgctatctctaatgatctggatgatagcaagtagcatttagctccgcttgttctttccaaccaaaaactctggatgcaaatgtgcaaattagtcgcgcgcattcatttacttagcatcaagataacaagaagttagcactaatattgaacaaaataatggattttccctggcaacattgcgtggagctagattgtaatattagactttgatttaatatacaactcgtagctcctcaatacaattgtattttgtatatagtagatttaagaatatagaattgaatttgatttacaactcttagtttctactttcgtaggtacaattatttgtatacaatacaacaaaagtgggattggaactaatatacaactgttgacatttatttatgtgaatacaattattttttctttaaaaacaactatattgatgtaacgacccgcctctcccaggccaggaccgcttacatatgacagctttcataggtcatatactatgaaacgttttatgacctattttaagtgactacatatggcagctttcatgtcctcccagagagacacaagtcttttatgcacactatatatgacagctttcatagtcttttatgcacactacatatggcagctttcataggtcaagtcttttatgcacactatatatggcagctttcatagtcttttatacacactacattatgcacactacatatggcagctttcataggtcacatgtcctcacttgtgcgcacccgggaggtcttttatgcacactacatatggcagttttcataggtcatatactgtcctcatagagacacacaagtcttttatgcacactacatatggcagctttcatgtcctcacatgtcctcacttgtgcgcacccgggaggtcacccatcccctcacttgtgcgcacccgggaggaccctggagttctttggagatcagcttctggaaaagaagttgcaacttgttaatatgagtactctattaagcaacttgttgatatgagtattctattaatcctattaagccctaggctagaatgttctggcagctttcataggtcatagactactctgtgtggtatgttctagcagctttcataggtcatagactgctctgtgtggaaaagaagttgcaacttattgatatgagtattctattaattctattaagccctatgctgggatgttctggcagctttcataggtcatagactgctctgttctggcagctttcataggtcatagactctctgttctggcaactttcataggtcatagactgctctgtgtgaaaaagaagttgcaacttattgatatgagtattctattaatcctattaagccctaggcaaaattgctccaggccaagcacgtttaaccctggagttctttggagatcggcttccagaaaagaagttacaacttattgatatgagtattctattaatcctattaagccctaggctgggatgtcacaattgataattctgcaccatcataatttgaatagatcaaaatctaatggtttaaataattttcttttttcaattaatatggtacggtttctatgccttccgagtgaaactaatgattttctttttcgagctatcttaataatataaccaatgaatgtttttttctcgcaaacttttgtgcggagctagataaaagtaggattagaatttgataaacaattcatatcttatgtttctataaatatatgatttatatatgatactaaaaatagtattagatttcatatacacctttatcttatgtttccgtgcatatagttgtaatttgtataaactattttaaaagtaaaaatagatttaatatataaatcttagcttttgtttcaggtactcatattttgtatacaaatttatcaatcaatctatgcttataaggctataacttatattttgtatacaattgtgttttgtttttctctccgactaatgcgaggtgtgatggttcttttttaaccatcttaactgtatactactccattaggttacaaacgttagacatttagggtgtgtttggttgggtggataagactggatgggagatagccgcttgattttttatggtacatgtggatggggcggtctagaaaagggaatatttcctcaatatgctagatgagtgtatacggcttatttggccggatgaagccatccatgctttcgtatgggtgacgtgtcatattctgattagttgtgcttggtttgatttttttctcctaaaccgtttatctaatttataatttgattacaccattatattagttacaattaaatatttaaaacaagatctcgaatgattatattttgattaaatatatatatatgacaaatgggtcccactaaatttggcttatcccatccatgctctatccctccaactaaacaagaaatttgatcatcctatacatacaaaccaaacaaaaaaaaattagatcgtcatatccaataaaatatggatgaccatatcttatccatgcatgatcatgaaccaaatgcacacttaaggccaagattcggtcatatttttggaacttgaccatcaagtgatttctgaaatggttagtttaaaaacaaataattacggtatgtacttatttgcctcaaagagtagctagaattataaggtttaaaagtttgactaaatcatgtccaaaacaatggggagtattaacagtggtacagctgtggggggtgccggagggggccaacacctcctatccaaacaccaccaccgccaccctcacctgtttttactctatattgaggttaactaagatatgtatttatctagtttatttgtgtagcttgaaattattatcagtttagttagcaagtctaaaaaaacattagcaagaaacatgatctacaaaattagtttgtgatttctcatctttttcaaagtaaaatagaatatacttatttgtgagattattcaatagtttacattaaaaggatttaacaataaaaactagttccaaactttcaatgatattattaaagagctaattaagattcaagtttttttaaaggattagtttacacgcattgattgttattgacagtaactacttgacctcctttgctatcgatattggtaattcagtcttatggcttatccccaccccccacaccccctaatcttaaatcctaggtattatacgtaccttgctgcgttggtcgagaaggacgtggtcctgggcgaggctgaggaagagctccttgttggaagtggtgaaatccacaggatcgtcggctcgagcgaggatggagtggtagtccggcggcaggaagcgctcccacacggcgttggagctcgccgctgcttggaagtcggcggagacggcggagcagcggcaggcgtccgtgggagtggtgaaggagattgcatgagccaggcatgcctctgggaggcgtgagatgctgctgctgctgcagtatcctgcttcttcctccttcttaccaacgctcacatcgtcgtccacttcctcccttcgtgattgcttcatggccagcggcttcaacaactgtcgttggagatatcacaatctagtatactgtatattggactataggtaggcatcaggcatgtctgtacacgatagaacttgtacaatctagtatgtgaacgcatgtcttatcagtaaggaaatttcgttgttatgagtaacaactgatcttttcccacctaatttattattaatcaaccgtacgttacatcatcaacatatacaattgtatatccactcctacccaaattccacggcgcgccatcaggccacggctgccacgcgcttgtgctcgacgcgttgacgaggaggaaaagagctgcaaccatctagccctctcgtggcaggtggatggactcgtgggtccggagccattcagccaacagtttaatcaggcgataggtaagtagtagaatacagcatttaggccagcgttcaggtggttcttccccaaccagacaattcctccaacagatcgacacaagccccggccgccatcgtcaaggccactcgcctgtgctatatttcatatactagaaaaagactgcgttgcaacaggcaatggcggatacataaaatcgattcgttggtgtcataacgtttctattgatgtcatagtatgctaattatgtttagatcatattgttataacatagataagcagttatgctataggttttgccgaaagtcgttggtgtcgtctgacaccagtccgcccctggcaacaggtaagtgttttttaatatacaacaactattaggagctaagcaatatattgaaacattaagatcactatacataagtggagctgcagacccagctagcatagccgatgtctcctcttgctaccaagctagacccacacgtttcattagcgtcttcaacctccggacgacagtcatgtgctactatgatgctgtagcctatcctttgcatcaaatctggccgaatctttctcgatctcccaaatttagttgtggatttttaatccactcaatcttctgtttctatttccccgtaatcgaagcgaatccataaaactgggggataaaaatgacctggggaagcttgtcggccgcattattggtgaccgttaaacgaagattaaatctggtgaattaaagccagatttataaggaaaatcattggagaaataatgagggagttctttctgtttctcaataattgaagcgaatctgcaaaattggggataaaaatgacccggggaagcttgtcggctacatcattggtgaccgttaaacgcagattaaatttgatgaattaaagctgaattaatagggaaaatcatggggaaataatgaggggggagtggggaatcgatttttgcaatcaattggaggaggaaacgtatgaggcaaatcgacgtggcaacggtgctaggatttggccggcagctagaggcgcacgtagcttgcagtggatcggacttattaaagaaaatacaaaatcctcctaaaagaaaaaggtgaaataggtgggagagaaatggaggtccggaagactgaaagggagagaaaaaggaagcagggctgactcagagtcaatgacagacgaaaaaaagctatgaaaatctttcgtatattttaattaggtatagatttgtagagagagaaagatggcggtggcaatgatgcctcgagagcaactacaattttccagagcaatgccaaggagttgcttgctgaactaaaggccaagctcaccatggtgaaggccatatccgaggcggcagacagccggctcatcaccaacaccaaccttctccactggctgatgcgcctacatgcggcggctcaggaagccaaagatgtcctcgacgaattcgaggtcgacggctcaaacatcgcccgcaagcgcaaggccagtgacctcatactgtcatcccgatctctcaagaatctggtcattgctgatgaaagcctgaaaaggttggaacatgtcgtcaagaccctcacatagctctgcgcaacctcagccactttcattgagctcatccaggggcggatctccagtgtaacggccggtgttaggcgaaatcaacaactttcgataaaacatatagttaaactatttatccatttattataacaccatggtttaagtataattagcatactatgacaccagtagatacattataacatcaacgaatcaatcttctagatccgctgaaccagtagagacatgtttcaaggaagaactgaagaacataaagtgctaaggaagaaaaaagctcagaatatatttgcatgtgcaggagatgcatatgccttttttttttccgtgtatgacttctactcggacatctatatgtgcgggttcgatctaatcgatatggtcagactctatccttctatccttgtatgactctatatgcaggagcctatatctattgtttctcctgtttccataaatacaaagttattctgtatcaatctaagaccaataaaatatggatctactataatctaacggtcaatattttttctttttcttcgattaatgtggtaatttataggctccacagtgaacgtggtatcttctttcaaagctgttttaataatataattgatagatagatagatacaaaatcctcctaaaagaaaaaggtgaaacaggtgagagataaatggaggtccggaaggctggaagggagagaaaaaggaagcggggctgactgagagtcaatgacagacgaaaaaaagctatgaaaatctttcgtatcttttaattagggttgtgtttagattgacccaaagtttggaatttggttgaaattggagacgatgtgactggaaagttgtgtgtgtatgaaaggtttgatgtgatagaaagttggaagtttggaaaaaaactttggaactaaacacaatttgcctcgagagagaaagatggcagtggcaatgatgcctcgagagcaactacaatttgccggagcgtgccaaggagttgcttgccgaactagaggccaagctcaccatggtgaaggctatctgaggcggcagacagccggctcatgaaggggcgggcctacaatgattcatgagtattcaaatgaatacccaagaattttaaacaaaaaatacatatatgaagtatatattccatatgtatatatgaaaaagaaaaaaagacctaccattcaaaagaagcccaagctaaaaacgattcatatccctcccatcatctcttcctcccactatttcacgcccattggcccaatagcaaaaaaaaaaaaaaaaaaaaaaagagcccaaacactttctaaccctgtctcctcaccacccatcccaactctccccgtctcctgactcccgatccagccaccaggacagccgagaccgacgcggcgacgcgccggcgccggcgccggtcgccctgtgcgctgcgccccatcgccagctacccgcctggcgcatcccccacgtcgccaccgccgcgtctccaccctccaggctccagccacggagccgctgcgcacggtgcatccggcatcccccgcgtctcgccctctccaagctccagccgccactcgccggcccgccgggacgccgccgcgtgccgcctggcaggctccaccgcaggtggcaggccgctggccgcattgccacaggcgctgtggctgtgcacagtgcgctgagcagctgaccgccccctgcctccctccactcaagtactccactcactaaggtaactcactaactcttcccttcaatcctcgcctagatggctagatggttaggaagtaggaacaatttggattaggaaaacaaccatacaggagattaggatttaattcatagttgaatctagcctgttggatattgttcatggttgaacattttttatttaaaatttgaatccacgaatgatttatggttgaatagagtatactgttgttttgtaggtttgaaacatgaaaaaaaggattggttacattcattaaaagggatttcttcttgcaagttcaggataaagataccatcaatcattttcaaaatatcaagaaatggaaagttcttctctaaattgtaagatttcttatcattttgccattttgtatactctataaatttgatatgttttcgcaattaatagtttagtattatactctaatatgcttaacacattcaatttatgatcaattttatccatccatctatgactttataaaatcatgtttataccgttatatattatacaattattagactctgggttgaacaattttttctatctcttctaatttcgaatacccaagttgaaaatcctgggcccgccgctcatcaccaacaccaaccttctccactggctgatgcgcctgcatgaggcggctcaggaagcgcaaggttgacggctcaaacatcacccgcaagcgcaaggccagcgacctcatactgtcatgatgtcatcccttagatctctcaagaatttggtcattcctgatgaaagcctgacaaggttggaacatgtcgtcaagacccttacacagctctgcgcaacctcagccactttcattgagctcatcaagatggatgattccaaaacaaaccagctgcacaaggcagcagaggccagctctcatctcccggtagatgtccctgtgtttggccgggatgaggtcaaggagttcatcctgaatgtgattattggatcaccgtagcatgatcatccagaatccagcattggaactggtaaagtaagagcagccaggcacaacattcttgttctcccaatagtcggtatgagtggcgtggggaagacaacacttgcccaggtcatctacaatcatgccagagtgaagcaacactttgagcatagagcttgggtctatgtttctgaggatttcaccatcaaaagaactttgcaagaaatcctgcattcgttccaaggacacggtggcgctattttcaatggcgatgaaagcatggaagctaccatcaccaagctccgtatcaagatcagtggaggatgtaaattctttttggtgctagacaacatgtgggaagagatgtgccaggaatggagcgtgctgctcacagcattatccgatgaggcacgtcagcatgggagtgtcctccttgtcacaactcagagctaaagggttgcacaatttgccgccacgatttatcccataaatttaaaagcattgccgtgggagagcttctggcctctctttcagtaccacacatttggtggtgtggaggttccccaacaagatgacaaccgaaacatgctattgatcgcccaagggattgcaaagaagctagatggattaccattagcagcaaaagtaataggaaacctgctgagatgtaggttctcctgggataattggagaagggttgccgagagtgattggtggaacttggaagaagctctccagggtattctgccatacctcagggtcagttatcagcatctgtcaccaaaacaaagacagtgcttagcctattgttcaatatttcccaggaattacctgtttgacaaggacagggtggtccagatgtggcttgcgcacgattttatccagtggaatgagattgctgacgttatgaggccagatgatgttgggaggcagttatttgatgagctcgtggaaaggtccttcttccaacccacatttgttagtaacaagtatgtcatgcctgatttggtccgtggtttagcaattcagtttctctacaccagtgcttcttccatggtgaaagatcaacaggagtatcgtccttagcaccaggaaatattcgccacctggccctgcaggttaatagcctggaacaatgccaggagctgcacaagtacagaaatctgcgtactctcctaatatttggccgttgtgagagtgatgcattttttaaccttcttgatgggatgttggagaagtcaccaagtatccgtgtgctagacttattgatacggggaaagcccgaccttctcgacgtaggatccggatacacccgtgaaacctcacgaactggatgaacaacacgctgcccgtgcaacgcacctttcaccacgaatt

SEQ ID NO: 80325 - DNA, 1712 bp, Oryza sativa
actataggcgaattcgagctcggtacccctagtatatagaaggagttttggataaggaaggaaaaatagagttctacatggaaacgacaaggactattcggattatatccatattgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgtaccactgtacccacaagacacaaccccacatcatgtcaccatgtgcctcaataccaccacggtacctcggaaaggagctgtgacaataccccttgcataacacaatccaccgcaggcccaccttctggatcataatcacccccttataaacaaggcatggactccccagcatcccctgtgggcttatctccgccacttctcagtctggtgccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcgttaagccatcattaattaattaatagtgaatcataagttatcccaaaagtgtgctaatgtttctaagcatggctaagcaattatatctaatacatctagttgaaccaatatataaagcccaactagtcaagttataataacccaaagtatcaaggaataaagtaatcaagaacaaaagggctataacaaacaataggttaattccacccaatgacattcgaaaataaatgcaatagttgaatagaaacagtagctttaaataggatcaacatgctcaaagggttatttgggatctgtgtgacttgccttgctggccttggaactcttcaaattcttctcctgcgaaaacggactctccggaaacgtcggaatctaaacagaaaagagcaaaaacaccaaaacagcacataaacaagcatgaatagtacatgtggatatttttaacatgtagatctcaattttagaaaaatttagagacttgaaccaactaaatcggagctaagatgaattagttatgaatttttaaagatttaatcggattaaaacacttatattgattttaattgaattatgacgcaataatgaattatttttgaaaaggaaaaggaggattattgcgtcagcgggctagggtttcggtggaccgggcgcacggcgggcggttcacgcgaacggacggccgagatcgacttgatccaaaacggacggccgagatcgatcggtccacgaccagctcacgggagagggcgacgatgacgtcagcggtgacgtcaccaccggcaacggcgactcggcggctcgggcgcgcatgctcgtcggcgaacggcgacgcttcggcacgaacggagggcaccaacgggtagagcgcgacgcggcgaactcaccggtgaccaaaggagcggcagaagaccaacagacggcgacggcgacgaggttaaaacggcggcggtcttccgcttgacgacggcgacggtgcttcggcggtctacagcg

SEQ ID NO: 80326 - DNA, 13899 bp, Oryza sativa
cgagtatcgaaaccagacgttgagttgttttggagaaaagtgctatttaatgcgaacaattattttttggtagttggcccaattttgcattgttctttaaagagtagaataatggtgcaaagttgatccttttaaaaaataccaaatgtgttgggcactatgcaatttattatatctttcctaatattgattataaagaaatacgtgtgcgatacaacggattaagacatatttgtggatagcaaccattagacacataattgtgagtccatatataaattttcagacataatcaaggccgggacccccctcctgatccagccgataactgtcgtctgtatggccggtctcaatttaccctagcccacaagtaaagcagttgcattgtctctatttaacctatcccacatgtaaaacggtagtcctacctcatataaccgatcgacgttttcaatatctggtaacagtctcgtacatgtagtatgctaagcctaatcatcccatcaaatatatattcaacatccgtagtatgctaaaccagtctattccttaaaatctgatttaatatttctcgatcaatcttaggaacaaccggtgaagtaaagagggaaatgcgcccaacagggtggtacccccccccccaccaccaattttgccaattaaattacgcaacctgactgtgtaaccattgacaattaatattctactggctagttgaacgataaataacatctggtgatattaaaatagcccaactgcgagaacaaaatatttcagttgatcttgactttgttcgtacttcgtagggtgaataatgaatgcgtaaacgtgtttgacatgcagccattctccatctaagcatttttgggcgacatgcagaccagagtgcagaagaatactccctccgtccctattgtgatattttgcttacactatttgactgttcatcttattcaaagaattttagaattattatttattttatttgtgacttattttattatccaaagtactttaagtataactttttattttttatatttgcacaattttttaataagacgagtggtcaaacagtgcaagcaaaatatcaaaatcccttagagcaaggttaatagtacaaccaactgctagctccaaatcatttatagccaatttatacaatagttgcttactatattattaatatctggcctcacatgtcatacacacattatgtcttggagtccgtgctacaggtggctacagatttatagtccgctgatcttctctctcctcttttatctctttaaaatatgtttgtagttgacttatagtctgctattgtacatgctcttatatcagggacggagggagtatagaataggaatccattgatgaactagacttcgcatatggtacaaagtactccctccgtcctagaatatagcaacctataaccggatgggacatatcctactactacgaatctggacagaagggtcttaggttgctatattctgggacggagcctctgtccgcaaccataagtttccgcgtctaattttgatcgtccgtcttatttaaaattgttttataattagtatttttattgtcatgagatgataaaacatgaatagtactttatacgtgacttatgtttttaattttttttcaaaatatttttaaataagatggatgattaaagttgttcatggaaaattatggctgcacttaaaataggatggagggagtagtcacatacccttgtaacgggacacgaggaacatcgtttaatttttttttcatgtatttttgtttttaatttctaatacgtaggatgggtgggaagcagttttgatggtgttggaatggaagaaagacaactgtgcttttatagagtagatacaagaagtgcaaaaaatttgtggccactaaccagttaccaaccaagttctctctgtacactcaccggcatacacacggatgcattctctatacacgcttgaatactgttggaacagacactcataattctagcatgctacgctacgctagatcggatcatctcagatagcttatctgtgacgagccaaaatacttcatcatagatgccctcatctgtgatggattagactagatgtcgttacagatgaggctacaggcgcaggcccatcacagataaggagttatccatggcgggtccatatatgcacccgaaacgtctgacgggctcacctgtcagcccgtcacaaacctaacacttatgacatatttataaatttagtacatcagaaaaaaggacgaaataacctaaaatgactctttattttacctgtcactggtaactagtgtaaccttatctattcgccccatccaactgaaccttatctcttcaacccgccccccctctctcgatccccccatcctctttctctctctcaatctctctctcgattcaccgctcgcgctcgcgctcgcgcccgcaaccacaaccctttcaccgccaccgctagttcgtgctggccgatgactccgtccgcatgccgaaggctgctttctccgccgtgagtgccgactgccaactcctcaacctcaggcaccagctatcgactctgcctccgccatgggccagccaccgcctctgcctctaatggcaggggagttcttctatttgggattatgtgattttgttttgtgcccagatgaatctgatagtgatgatttttgtgattctatcttatgcctagatgaatatgaatgtgatgctttttgtgtttcatgaatgcttaatgaaggttagtgattagctaggcggacggctaggcggacggcatttttatttttttgccctatttttcacgtttgtgataggtcccagttatgacctgtcatagacaaagatcaccaatgacaagttaaaataattccccgtcacagataaaggttacctgtgatggattttagttgcggtccgtcaaaggtaactttacctatcacatataactcaaagtcatcggtgaccatttatctgtgacgatggcttaacctgtcataggtaagggtacgagcccatcacatatgacctgatccagcatagtgctagaatatccataaatctgcacaagttttcaactggtggacaaccaagatctagaggtgaatcttgaaaagggatttctggatgattgaattctcatgtgatcctttggaacaaagaaatttgatcctttggaacaaagaaatggagctcgcaaattcatttgaaattcctatgtactcccaccggattgttaatacttatcgttttggacaagggtacggtctccaaaaagtagctttgataactattttctattataaaatatatagaaaaatctttcaagactaatctgcacatatggtttgcatatttttaaaataaatattttagaaattatttatagtcaaatattttaaagtttgactttacatttattcaaaacgactaatattgtcagcccgagagagtagtgggtagttttctacgaattttggaggaagacatcatggtcgttagtcttctgcttaccaaatacaatttaggggaataattgaatcagcatcggtaaggccaatttgggagagttgagccccgacaaagtgcaagattttcggttggttgctgctacaaaacatggtatggactagagattgcctgcagcttagggaatggcaaaacgactactactctgccaactttgtttcatgaatttggaaacaatgaacaacctgatgttctaatgcccaatctcgaagcaaatctagacaggagttctaataaggctgcggcatggtcatattaattatcctcaattggagcatgagccaatccttattggacttgtggacacaacgaacaacaagcccggatgcaaccacaagaaaaggcccgaaataaatgttcatgctcatagcctggaaaattaggaaagaatgaagcgcaaagatcttcaataagaatgaagcaacatttcagcgagtaatcaaccgcatacactgttggtgcgcaaaacatattgcgagattattaccttaagatctctgggtgagctgaggtttgactggcgtttgaaaagaagtgttgtttgagtgttaaagttaggtttgactggcgaaagtttctatgttttttcctactgtgtgttactccctccttctctaaatgtttaacgccgttggcttttttaaacatgtttaaccattcgtcttattcaaaaacttttgtgaaatgtgtaaaattatatgtataaataaaagtatatttaacaataaatcaaatgatagagaaagaattaataattacttaaattttttgaataatttgaacggtcaaacattttttaaaaagtcaacggcgtcaaatattttaggatggagggagtactaaacaacatgttttatttccatatttcagcagatattcaacgctacgtgattctattcacgcgtttcgtttttttccctattttttagggatcatacgcgtcatcatatcagaaatcctcatctaactaatggttagggatgacttgaacgacatgttcgcaaggccatagtcaaggtcaaggtagtactaattatttttgtctcggttatatatcttgtgggatgattaagcctatctgtccatacgtccttatttcatttttacggcagctcatccgtagcttacgagtctaatcacttcaagagtccgcttcagatgagcatatataacatacaattaaaaaatatcattaaccattatttttgtatataccaatgtgttaacaattacatatatttgttactgatatatagaccttttaatccctcgttattctttttcctttaaaaataatagatagttggtaggagatgtttaacatatggatatgggcctgctagccccacctgtaattttttttctcacaagaaaatagaagtatgtggtgcacgcagcaataaaaccaacatcatcactactattttttttaaagaagtatagataacgttcttgactgacttttgataagctgtttgatagttcatatctctgctattataaaaattaaagatatttttaccgacactttggtacgtcatcctgttgacggttggtactcgtagaccggatatagagggtattggggtacgctggtacgaggatctacgtagtacgacatcaaggaaacaagagacaaagattatacttcaggccctttaataggtaatagccctaatccagttgatatgggattatatagagagaaccacaaattacaaaggaaataacagaactcgatgatactggcgagatcgtagttgagttgatttgactagatcacccagcgacttggctcctgcaaactccggcttcgtaggctgtggtcgctgtgttggctatgagattcgatcccttaggtcctcccggggggtcccttttatatcgcaggtcaggtggtctccaagtaggactcggaggtatcggaccctgcacgatatagtgacgacccagtcctatatgggtaggaacctttccattggtggactttgagatgaatttccttaacgtatacagagaacgtccgtacacgcgccgatgtaccgtattgccgtatagcgtacatccaagggtagagggtataccttattcgtaaccctgacagtagcccccgacttctgcttaaataaactcctataaccgatcacgacttctgatgtcggagttgttgtcgttctcgactggtcgatctcggtgtggggatcgtagagacaaggagtgatcgacaacaccaggcgaagttcaacggttatgagtgaatttaaattgaagtccgagaaaccgcctcgcgcaacggacccagaaatttccgacggccatctctctcctttccttggaattcgcaccgtcggtagtgcgcctatttaagggagttttgggaatccatttttgagtccggctggtgcgaaaactttctagcctctaaacgctcttcgtcttctccgcttccacgcaaaccctaattcgctcgcctcggcttcttctccggcgatctccaacggcgatggacctcgacaagtccacctccagcagtgcgtccttgaagaaattgcaggaggagggcgctctcctcggtcgcaggactatggagagggaaccgggaggtactgaacctgaacccgtcctgggccgcatggttgcggttgaggactacattctctgtggttttcttcctccgccttctgagtttttccttctcgtcttgaacttctacggtctttctctgcttcatctgaaccccaactccatagccttccttagcattttttctcatctctgtgaggcctacattggggtagagccgtttcttgacctcttccgtttttactacgagttgcgctggatggaacctaaaaaggtatccgggtgtgttggtttttgacttcgggatggcttgaagtcgcgatacatccctttccagtgcccctcttctcgtagcaaatggcgggcgaggtggttctatcttcagatagaagattcggatccagtcttcattgttcctgaggagcaaccagacatgattccgtcttggaccaccaaacccgccttgaccccatccctacagtctttcatcgatatcatcgatgacctccgagtacgagggttgtcggggtatgaagtcgctgccgacttcattggtagacggatccagccgctccaggcttgagcctatccagcctttgactactctgggccggaggacgcgacccgggtttctcctcggggtatttttcttgtattctgggtttctctcctttgatgcgcattcctcctgacttatcgaaatttggttctcgatctacaggtttgaacagcgcaatcgtggagcgccgtgttgcctaggtgatgatcagtgatcccacgatggtgagcaacgcccccacccctctttgcgagaaagaagcggctgaacgcgaagccacaatcaacgtgagtgtaatcgatgaccctttacattttaacttttagatcgcatcgtgacttcatgttgtgcaggctctccccttgactgacatcatcgggccgctcgcggaccaccaggtggcggattcgttgaaggagggcgttgcccaggaagcgtccgacgcggccattgccgtcgctgctgctacgagcagcggcggcaaagttccaaggaaagggaggaagttttcctctgtgctcggcaaccgccggaaggcgcccaccccctcggtaagccttttgggttatcgattacatagtcgaaaaatgtcgccctcatatcgtacttggtttacttaggcctcggacgcgtctcccccgcctccatgacggtagaggctggtgacactcggcgagaagtaagtggacgagatttgaggcccttgacttgatcgggttctggcgttttgttatgatgactaacatggccgtctttcgtagggcggcgcgggcgaaggtggcgcaaaaggggtctggagggaactccagcgcgtctcctgcagtggcctcgtccgatgtcgtggtcgtgcccaggagccgcgaggtgatgcccagcggccctgccagcgatcttgcgcccggtcgaggcctgcctactgctgtcctcacctgggaggtgctccaagtcgagacgaggcgcctcctcgaggctggtgctcgcggcataagtcgcgagatcgcggaggcgagggcggcggcggcgtcgtcgacgaacgagcgcgacgacaaacttgcgcgtgacttggcggaggtctgcgaggacctccagaaaatgagggaactggtggccggcaacgagcggcaacgacaggggctcgagaaccgcatgtcggaactcgagaacaacctgtcggagatccgaggttcgttgcgggtcacctacaccggcctacaccagctcgccagggaatgtggtgccaaaactaccatcccggcgaaccctgacgagttctcattgacgtcttcgctcgcagaactggcgacggcgatggaggcgatcccctccaagcacgcggccaggatcggggaagagacgtccaatgggatcaacaccggggcgtgccacgtcctcgcatgcgtgaggttggcgcaccctgaactcgatctccaaaagatcttggatcagggggcggctagcgacgcgcgcaaggatgtgatggaagaagttggcgatctgggggagtccgttctcccacttttcgaaaagtagggacgccacttgcctgtaccccttaaccaatcgcgctttgtaaaactttcattggttccaactgcctttctatatgcagttatcgcctcagtttcccttagcgtcttgatttcgagtactttgtgttgcttgtagagacgttgatgtcgaggatatccagcagcgtgggcagcctgagttgcctgtaatcgctccggtactcgcacttgagccgtacgcgccgcaggacggtgtgaaccaggatatggcgacgattcctttaggttggttctttttgtctccatctcctttgctcttctatctggattggcttaaattgccgtgctctcggaaaaggagagcagcttaacttggttgtttgcttgccgagcagacctcgagagttcgctcgttgatcacgaccgtcgcatccaatactagaggacgaagttcgaggtcgccaaacttgagagggctatgttggaagtgaagaaggaccgggccgtggaggcactccgaggtcgcgaggtgtggttcaactcgtacctcaggagttgttgcacagcatggtcgtcgtctgccgggaactgcgagtacctcgcgggaatcccgaggagtcatgtcacgcccgaaatttctatccaaaattccaaacgcttacatgtgtgtgaaccctcgtccaggaatcagccgaggcacacaataacaaattgataatagagtacaattattactctaattaataagcgaataaaatgtcattatagaggtagatagttcctctcaatcaataaagatctaagcagcggaaagaaagataaacggcgcagacggctccacttcacaggcagcttgaccaaggctacacctaatcctccacaccttcagcatcattgtagaactcttcctctgatgaatgattgcaaggtgagtatatgacatactcagcaagccacgcagcaaatatgcaagtgcacaggataacaaaggatggcatagtagagtttcatttgcaaaagcagcatttagcaaacatttgagaatttaataaaacagttaagtattaaacaatattaatccaacgctatacaacataccctgttgtacaggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgctggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaatcaatcacgattgaccatcgtgaactatcattaggccatcattaaataatagtgagtcataagttatcccaatagtgagctaatgtttctaaacagggctaagcaattatatctaatatctagttgaaccaatataaataaagctcaactagttaaattataataacccaaggtatcaaggaataaagtaatcaagaacaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaattcggattaaaacacttatattgattttaattgaattatgacgcaataatgaattatttttgaaaaggaaaaagggatttattgcgtcagcgggctagggtttgcggtggaccgggcgcacgggcgacggttcacgcgaacggacggccgagatcgatcggtccacgaccggctcacaacggacggggacgatgacgtcagcgatgacgtcaccaccggcggcggcggctcggcggctcggacggcgcacgctcgccggcgaacggcggcgctttggcacgaacggagagcaccaacgggtagcggacggcacggcgaactcaccggcgaccaaagcgacggcggaagaggaacggacggcgacggcgacgaagaagaaacggcggcggtcttcgggttgacggcgacggcgatgctccggcgttcttcggcgactacgaagaggcggacgaggacggtgacgacttggcgatcccgacggtggccttcccgagcgacggcgacgaccggaacggcggcggcgcacggctggagcgacggcggcgacggcggcgctaggttgcacggcgctagagctcttccggcgacgagaggcgaaggcgagggtggcggcgggtagaggagacaccgaggagccttttaaaggggctaggaggcggcggcgaaggcccacggcggccggcgacgagaaggaaagatcggggtttgaaggaaaaagaccgatccgattcgaactcgaatcaaacacattccaaaccgatttagccgatgtttccaaaagagaaaaggtagaggagatcccgaggatcatttcccctctatcaatacggccggagaaggaaagggacggccggatttggaaaggaacggcggcggcgcgaaactagggtttcgggcggcggtggcgtgacgaagatgacgaccctgacaggtgggccccacctgtcagcgggcggacgtgtgcgcgcgcggcggcggactgggccggactgggccgaggagagagagagcggttttgggccgactttcggcccaaagccaaaagagatttttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaattatttctaaaaaattccatttaaacaacaatttatatattttgaattttcagggtgtgacaagtcagcggccggctatatctcgtggctgaacggggcatgcgctcagctcgaaggcatcggcaagcatatcgacgaggccctgaagcaggagtgccgtcgatcgagctggtttgccgaagggcacgtgctggcatgtatacgagatcatcgtccgcagttgcacctcgagttcttccacgagggattttctcgttctcggaggactcccgcggaggtagacaacctggcgaagtcgatggcgccgctggcggagaaagtcttccagtcgatggattggcgttggccttcctggtagtctttgtatatctgtgacaagcatcttagattaagtgtaatatattttggaattttttgcagcctgtaaggaatacttgtgaaatagaaaggaagtctatctaactaagctttcttactctggatgtggtgtgtacgagtgtcttctcacttcgcgacttcgatcattcacttgagttatacactcttcctagcccccagccttgtcgtcggagaattcttctcggaagataaggctcttagacctttgacttgccttagttgaataaacactgatcctagcccccagccgtgaagttggaaaatccatttccgattacacggcttggttaatacgcacggcgagaactcttacacgaccagatcttatatggtctttcgtctctgaagaatccgacaaggccttatcagctctgggcatccccagccgaagttcccttagattcctcggaggccttgtcaagacggcgtaaagggacatgtgaataggtttcaacactaggtatcatctgggtaagggatcatcgggaagggacactttgattgaaatttgcatcttaaaacaggctttattgaagttgtaaggtgtcttacaagtatggatactattgacttatacataaaatttacgcaattggtcaatcttccacgaatttgctaactcgcaaccgtcgccgtctgcaatcttgaatacgcctggccgcaagacttgtgtgatcgtatacggtccttcccatttgggtgagagtttgtttcgccctgcttggctttgaactcgccggaggacgtagtcgccgatcgaaagtatgcgtgctcggatgcgcttctcgtgatagcggtggagggcctgttggtagctagctgccctaacggcacccgttctcaatgttcctcgagttggttcacgtcatcgtttcgctattcctcctgatcctcgtcagagtacttctgtactcgtgtactctgatgtcgtaactcggtagggagcatggcttctgaaccgtacatgaggaagaagggtgtctccttgttggacattgtcggtgtggtgcgcacggcccatagtaccgaggggagttcttcgacccacttcttgtcatgtgacatgagcctgtcgtagatatgggtcttgatcccttgtagtactatgccgtttgccctctcgacctgtccgttactctgagggtgagaaaccgaggcgaagcagatattgactgtcacaccctgaaaatttaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatcgggccgttcctttccttctccggctgatttgttagaggggaaacaatctccgggatctcctctaccttttctcctttggaatctttggttaaatcgctttggaaagcgtcggagacgagttcgattcggatcgg

SEQ ID NO: 80327 - DNA, 12225 bp, Oryza sativa
agtatcaccaagctgaccaacctacggcatctgtatgtagatggttcagcattgtccaagattcaaagtattggacagcaaactgaacttcaagagttggagagcttcattgcacgaaagggacaaggattcatgataagagagttaaagaacatgagggagttcacggggaggctgtgcatccgtggtatcgagaatatcagaagtaaggatgaagcgatggaagctagattgatggacaagaaacatgtgggtgccttggtgatcgaagggaaaagagtgcccaagtttgcacttgaaggactgcaaccacacacaaacatacaggaactcaccatcaaattcttccaggaacaagattttcctgattgggtgtgtccagataacttggttaatctcttacaggtaaatcttgaaagctaccacttcttgtctaccattccaccattgggccatctgcctttgctaaagctcctcaccctaagaaagcttccctcagtgaagcatgccaacggcacatcattcggtggtttcccatctcttgaggagttcgagcttcattcaatggagaaatgggaggagtggacagaaccagatgcagcagctcatgcttatgggttgtcgcttttccttggacacctcaggaagctccatcttgcatactgtccatcactgagacgtttcccgcatcttccatgctttatctgcattgaaagagctgaagatctccaagcctggaagctggatcctggcattaccagcatgttctcaagtcttgtcatccctaataaccttggcagtcgagtactgcaaccacaacgttgtaatgtccgcgcaacagttcaagtccctagaaaatattgagcttatcaaaagtgaagggctacgtttggctgatggattccaatactttagcaaactgagaagcgcatgggtggagggttgtcctcaactcctaagtgccatcaccacctctgtctcagtgggctttggtcaagattgttgtgcggcacatgatgagaagcagcagcaggaagctagccttttaacccacctcagagccaatgatagcttgatgtatggtgattacttcaggaccgtgggaaagctcccatcactgcgcaatctgacaatctgcaatgaatcgaatggcactaatttctcggtcaagcaagaactgtggtttcagcaacaaaactcgctagagcacctctgcattgaaggttttcatgcattgcaacgtctcccttcattcttggttaccatgctctccattaagatactagagcttcatggcttgcgtggcttgcagtccataccagacaatgctctgcccctgactctccaagagttcaatataaacaactgtacttcgtgtttgagtactcgggtatctaaagatggtgccgattggccatatgttgctcatgttccatacatccgagttaacggaaccacggtccaaaacttatagacttttgtactgtatatatgaactcctgaaaaatctccgatacaaaaatagaagagaatggcttttggtattcagtaatccagtcaatgaattcttttacctgagccatatgtttccttgagcaggttgagtatatcctcgtagaaatgatatgtatataagcatgcctatgtaactaaagaaggtatagacaaacaaacaaaagttggaacttgatttcgattttcatatatatgatccccttgccacatctgaaagggcatcaatgccatatatgtgtttctgttattgtgtgtgcgcctcccgtgtcagtgcattatttgatttttaattttcagtcaaagcagagatcggtaaacagttctcctcatcattaggcagattcttttggtaaaagccacctacaacttccaacactgaattcattgtgcgagcatggcatctgcgattcctaaattttcactcttccctcgttgtgctcgacagcaagctagcacttgcatttcttcaatggcatcctgacaaaataagacctggcattttccttcttaggttgtagacagggggctcaagcagacatcatactgtgactccccctaagcaggactgtatgtctgcctcctgttgagatgtagaaaatgtagggtgcttaagaacaaattcttgcaggtttacttccaaagcagaaggtattccgaagtgtgacaacctttcaaatggtttcatattttccgttatcaagcacaaattttcatgaagaataccagcacatttctcaagctgctcaacattgcgcattggatgtaaatcatcctactcatagatctggtaaagggaagctctccagctcttaaacttttctcctaaaaccattccaaaaccttaaagccagtaggtaagttcattggaaaattacattttgtttcagatgcagccagccacttaatgtgttactccttcccttccattcttcgacatggtctgctgctatatttccatccctggtgaccaacggttggtactaaagagcaactgtagttgtcgagcagcaattcccttgcgagccacaatgcatgcatactcagagtttcatctgttgacatcatgagaagcttcttcaactctgaacaaatagcaggttcactatccccggtgacagggtctttttctaccatcaaaccagccatcttttagaccttgaaacattcgttcctttcgaaagggtgcatgtaaactttggggtaaagtgccaacctcattgttcaacctgacttcatgccacttccttgagacaaaacggagagacgtgcagcctttcccctgctgaaattaaaaagaaagaaaagaaaccccaatgaggatcgaaaccatcccgtgttcttcataattcttctcctgctacttgtcatacttcctctgatatttgttgattatcttagccgaattcacttgaaaaccctttgcacggaccctatcggctgattggccagctgtatgtaccatattaacaggaaaaggattactatcgaccttcattggcctcttcgaatcatcaaacttgatttttcctccctcaatagccgtttggatctgctgcctgaagaccttgcagtcattagttgtatgagacccagaattatgccacttacaatacctcttcttacccaactcttcagccgatggaattgtatgtccggcaggaagttgaatctgtttttctcgaagtagcaaatcaaatatcttatcagccttggttatgtcaaagtcatacctctcctcttttcctgagttcttcacccattggcacggtataacctgtttgctcctaacccactcggctgcagctatttcggaatcatcatcctcctcatccgacccatacatataaggatagacatgattaatctccctagagttcttcctagcttccgcaaacctttgttcatgcaaagctaccttctgtgtaaggtgcgacaagctttcgaaattttcatatgagaatttttccctgatcggagcaatcatcccttgaaaagccaaatcggataactggcatcagtcaaactcaagctgtaacacttattcctcattttcctgaacctttgaatatactcaccaccggctcatcatgcttttgcttgattgacgtgagatcagacagtttcatctcattaatcccactatagaaataactatgaaactacttttctaaatcggcccaactattaatcgacccatgcggcagagaagaaaaccaagtaaaagccgacccagccaatgacaaccggaataacctaaccctcaaagcatctacaaccgatgcctcaccacactgagctaaaaatcggctaatgtgctcataagtcgatgtagtgtcttgtcctgaaaactttgagaaatctggtgctttgaaccggttaggtaaaggaactctttcaaaccattcaggataaggttgtcggtacaaatttccagtctcttttggtttaagcccaaattgctccctcattacatcagctatcacatcagcccatggtcgctgctgaggtgttccttgaggttgttgtggtgtgggctcaaactggttgtaaaactgaggttgaactgatcctgcctgttggtactgaacttgtggtgatggaggttgatattgataactcaaattgccccctggtaattgtgaaggttcggctgaataccacgcgccaaatgctcaggaataacttgaggtactactgaaccatctggttgcacatgatgaaccaggtgttccgggacaacctgatttgtagtgtactgcacaggctgaccaccaggcattgcaaatccagccgacgcgttcattgaggcttgctgctgaatcggctgaacgacctgctgtctcaacggtgtctgctgaatcggctgtaaagccggtcgtcttggtggcgtctgctgaactggttgcacgacctgctggattggggatgtttgttgaataggctgcacaacctgttgcctgggcggcgtttgctgattcggctgctgctgagccgaattaatagcattctgaggaggtagaaacatagatgcaaccgggtcttgtgttatctgagtcacattcggtccaggatgctgtgattgctctcttaccaatatttgaggattgactaattgacctgaggccgacgacggcactgcaggtgctggagccgatgctggtaccgtcggctgagctgatgatgtaacaggaggaactccctgagtaagtggatgaacatcggtaatcaaagtccgataatttggaaaagtacccccttgcaaataaactgggcctgcagcctgatgttcagctattgaaccatcggctaccgatttcatcatatttgacaaggtattagttaatactccagattgattgatcaaagcattatacacggcatagtcaacccgatcttgaaagttattgaaaaaatcttggaatgcattgtcattctgattaagatttcccctttgcggtccctgagtgccgtcaccttgaactccatgtacttcacgaaagtagtcaccctggttctcctgggtcgacccatctgtaacacctttgtcactcggctgggctgatccatctggaacttgtttcttttctccctctttaaaagagccgatcccaggatcatcaggaaccaccttcaccttgtacttctaaacaaatgtgcccttgcgagtctgcatgaatgaacttaaaaattgatctcgtgcttgttgcatcattgcatcgaagtctttcttctgttcgggagtgagcttctctggatcaatgggcacaacgtttccttcatggacgtcagtcaaaccgagcttctggatcgtttctttaacattactcgggctggccgacgacggcgacaatggtggtttctcagccatgagggaagctgccttctgacttctaatcagtcccaccaggcatgccaaaagcgtgttgacagaaaacacgaggcctgggagatctgcttaactccagtgcaggtccaaaactcgccttcggatgtatgagcgtgccagttgatttgatcatgcaatcaacaagaaacaaagacaaagaaaccgtgattaaatccataaatgatagccgatcggctaaatgccgatgacatatcatttatctttgagccgatgtcatatgtaaatcgatcggcatgtgttaagtaaacaaatcagaattaaatctactcgatcggctgtagatatcaataatatataatccttatatcgatatatacttgaatcaagtgattgggatagatcggtcaccttgccgagacagtataaatcacttagatcgaaatatatattaataatgagattatacatatattcatagcatagccgatcagatagatctagcatgtatcggctaatactccgataccacatcgtgttaagatattaaagcaaatagaatataccaaacataagcctaatatacttaaatgcaacaagatcttaacataaagggtagatctaacatgtcaatcgatcatataggataaaagcaattagatcagataagatcggctgaaactccgatactaccctaatcggcaaccagtaggcaggctagagattgaaattcaactgatacaacattaagtatgaaaagaagaacaatatctagacaatcaagctgctggatgtttcgtagagtggtggatatctcatataatctaagccaacgtcgttatttaacctaatcggttgccttctggtaacagatgttagccgattgtaggttagatgacgatattgtcaaggattatgcaagatataggataacttgacggattacatgaacaagattagagtatcataaagatggaagcactaatctcgagaacacaaaccgtcataacaagttttacctcatgttgaagatcgaaaccgatgcagctcaacccgaaagtaagaactcgtcgaaataaaactaaagcaaaaagggtggtgatgcgccgaaattgttttgaacgtgtgtgttctcaattacatagggctcggggactatttatacccaagaattataaaatatgtccatattggacacgactcttatccctaacaaactgtaagataccataagtctttgcggcagacttttgcccacatttatctctaagtaatttacataaaatatcctaattaatagatacaattgccttcccaggactctatccatgcgtggcaatcatcttgaagcacatcaattcgaacccgatgtcgtacacaagttgtattatcggaatcggctgtatcacttaacctaatctgactcagacttagccgatcccaatcatagtcgatccggactccagccgattcttactctgtttccgcaacaacccttatattcgattccgcttcgatcccatcttcatctccgatgctgatattaccaaatttggtcgttaacagccgcagacgccgccgccgcatctcttgggtgagagccatcgctgcctctctctctctctcgatctcgatctctctctctctccaaaccgccaccacctagctcgttgcccacgccactgccacgccacggtcaaccgccaccattgatgaccgacttcgacgcggccgccaccgccgacgacgctgtcgccactgccactccgccgtccccgcctcgagctcgccacgccgccgcccccacctcgagctcgccacgccgccgcgccacgccgccgcgacgccacgccgtcgggcccccacgccgccgccgcggcacgccgccgccacgcccgcatgccgtcgggccggcccacggcgccccgacgccgctgccgcactgccacgcccctgccgcccgcgcccaacattgccgaacgtgaacgaacgtgattgaaacgtgaccgaacgcgaacgaacgtgaacgaacgcgaacgaacgtgaccgatacgtggacgaccttgaacgaacgtgaacgaaacgttaacgaacacgaacgaacgtgcacgaaacgcgagtggacgtgaacgaaacgttaacgaacgcttaacgaacgtgaacgaaacgttgacgaacgcgaacgaacgtgaacgaaacgttaacgaacgcgaacgaacgtgcatgaaacgcgagtggatgtgaacgaaacgttaacgaacgcttacgaacgtgaatgcacttgtaataaaagtgtgagaacgaacgcgtttagactaatacattttactggtaatacatatatgattatatatgtaacttggcccgtttagactaatacattttcctggtaatgttgcagagaagacgtcgtcgtcgtccctaagccgaagtggtagctagccatcgaaggaattcgcgcaggcaagtgatgtaaagaagtgattgttagagatttaatataagattgttagacttagcatatatgattattacaattttaatataagatttgtagcgatttaatataagtttgttagacttagcatatttgattgttagagatttaatataagattggtagacttagcatatatatatatatatatgattattacaattttaatataagattagtagcgatttaatatgagattagtagagatttaatatatgattattacaattttaatatgagattagtagagatttaatgtaagattagtagcgatttaatataagattgttagacttagcatatatgattattacaattttaatataagattattagagatttaatataagattgttagagttttaatattacggttagcaaatacatcctatagacctaataaatattttttgtatgcacagatggctgatcgcgatgaggaacagatactatacgatacaatcgcagagggaagcagccagtactggaacgaagaagaggggaacgaggatccaaaccagtacttgaacgaggaggggaacgtggagagggatgcggaggggagcgaggaggggaacgatgaggaggctagtggaagtcatccctcctacggacagaagagggcacgcggacaacgaggtgccgcgaagaagatagagggtcggcacatcataactgaggtgaacgaagacggccgacctagtgccccggcagaagcagccaagaattttgtacgccacagcggttgggttgtgagggacaacgtgcctgtcagcacggtgtactggcgcagaacaagggcacgcggggataatgacagctttgtcccggactcagagaaagagatgctgtagaccacaatgctcgagacgttcacgctacccgcgggtacggagaacatagtgaaacagtggactctgaagaaaatggcagacagttccagagcttcaagggagatctctacaagaaatacatcctgaaggggcagacaccgaacttcgacacattcccaaagctaagggatcactgggacgagttcattgcatataagacaggtcaacaagggcaggcgatgatggagagaaacaaagaaaatgctgccaagaagaagtaccatcaccacttggggtcaggcggctatagcgtcgcaatgccaaagtgggaggagatggaggcaagtttgattgagaggggtatcaaaccagccaccgctaaatggccggatcgatcgaagttctggtactatgctcacggtggaacgcttaactcagttgatggctcccttgtcttcagcgatcagatacgcgaggctgccagtcgactaacggacgcagtggtagcctcttctcagggcacatttcgacccgacagagagaaggatgagctgtcactcgccctacagactccagagcatccaggacaaacacgagggaaaggcgtgattcccaggaagattggatttaaggaggacatccacacgtacaggagttggatgaggagcaagagagataccgaggcgaatattgcagatcttgagtacagggtatcgagctacgagctcagcatgcaagaggaggtggcaaggaaggtggatgaacgtatggccgcacatcggtcctaggatccccagccgtacattaatcctgcaatggtcagtccatcaggcaatcgtagcagctgcgcctcaacggggcaggtcggatcacagagcatggacgccatgcaaacccaggacgaaaccacctgcaccgttgatgagatcacatagtggacaccatgtgagctgcatattcccttcaagaacttatcaatcaaggtatgctcgtagtttgatgatttttgacttgtacattccgcaagttgctgcttaggttgattactaatagataacctcttatcacgtgaaggtggcgtcgggaatggccatcccaacggacccttccgggacttaccactgcaggccgattccagcaggatactctagggtcgaagttgagctggtggaagccgcgtacgaggacctcaagttggactacccaggaggagacggtgagacacatctacgagacacaagccacgccattatactatggcgcaagtggtacatcatcctccctgggcgacaagcggcgtctcgtgtaccatctcctccggctccgccgtctcctccgtctcctcctgcaccatctccttcggttcctccgccacgtcctcctgcaccatctcctccggctcctccgccacctcctcctgcaccatctcctccggctcctccgcctcctccacctccacctctaccgtgtccgcctgcacctcccaagacaaggtctcgccaagctccacctcctgcccgcacaagggcaacgaagaaggtgaaagttgacgccaccaaaaataaggagccgccgtacgattgcagtcaagaggagcttgacacttatgtggcaggagaagtgaaaaggcaactcaagcctcggagtcctaaaaagaagatacctattgacctgagcgtgaagaagttcttccagggaatgtccaccgcaaacaaggatgccttaaagctatcggactatgaccgaacacttaggaaagcctattacaagaagtccaaaccagttcctcagcttggagaacagccaaaccaagaggtcaagtcgttggtgaccggcgaagactttggcataacggattttatttcggacaccggtctaacggtggatcagttggttggagccgcaccaatcccgaaggcggaagtggcatacaagtttgaactcggtaaaccgcttgtcaggcctgagcagctgcagtccctaccgacacaaatgtacaaattccatgaacggtacatggaaatgagcgccaatggtagagaggtgttcggagcgaggattagaaactccaacttcttgcaaggagaaaatgttctatggatccatttcaaggatgtcttcgatctgtaccatctggacgccctcgacgtctctcttctgagcgcatggattttgtaagtatctttgagttcgatttgtttcgttcaataattagctcctggcatatatgaaaacaataataatttcctttcatcgttgtagaatggagattcaaagggcccgacggcggggggtttacgatactgggttcatcgaccctcggaaaatcaacaccgaaatgatcgacaattacgagaaagacacagaggacaatctcgtccatctcctaacgcagcagcatttcaagacgttcatactactgccgtacaacacagagtgagtttttattgtcgtttggacaaatttcattcccatccatataacatatacattctgatatttatcttatctcacgcatattccagattccactgggtcctgttatttttcgacttggacgcatgcagagtcactgtgtacgactcaatgaataaagaggagaaggtttttgaccaggtcttccaactgatagacaggtaatataatgccatctattccaaagtggcgggactctgttgctattatgttgatctcgagtaataattaattaatcatagcttgcaactgcacatgtagggcttgggatcggttccgtcaattggtccgcgagacttgaaaagaaaaacttggacggaggtttcattttccagtgagtacatgcatgatccaaaattatattgaattgaatctctaataccagttaatataaagagtatattaaatctctcattttttctcatgtagtgtgcaaagcaggaccagggaactaacttatgcggctactacgtatgcgagtatgcccactgcctatcaaaccaaatatacccacacgagaactcgatgtacgtatacataaaccattcaaaatttcattgcgtatcgatttgttagttgtttattaatttcatatattgatatgtcattatttttcgaatgatagcgtattcacatgagggaaaatctcccacacaaggattttatcacggctgttcaagaacaactgatggggttcatcaacgaagaagtccttaatcccgatggtgaattctactacgacggatcgacaattcataacgtcggtccttcctcttgtgacataacgccggcgtcgaagtcgtagctatagctagcgagcaaatgaattgtactatacatgcatgtatatatatttatatatgtacgtacatttactttagtgttaatatatattttggtaacatatatgcacataaaatgttaagtgctttaaattataaatatgtgtgtaatatatgtatttatacatatacacatatgcacatatatatatacacacacacacacacacacatatatatatatatatatatatatatatatatatatacatatatata

SEQ ID NO: 80328 - DNA, 19524 bp, Oryza sativa
  unsure (1)..(19524): unsure at all n locations
gaaaaaccgtgcaaaatttatcgaaaatttaaattattttttaaatttatttgaatttaaggaggttaccgcagtttttctatatcgtaccccgcggcaagaccggttaccgtggttactagcggtaatgtaaacccgggtgaaaaccaactaaaacagtggaaaaagaaatagagttgtttcaactttcaagaaaagaaaagaaatggaaaaatacacacaacaagggaaacacgatttaaaaggattggacttttcctcgcaaaaataaaagaagaaatcgattgggacttggggtttagaattatagcggcgatctctacgatcgatctgttgcattgccacctcgctcgcgcttttactttaatctgcggtgatctgtatgattaacacgtacgattctcaaactttcgtttcaagaaagaaaaggactcaaattcacattgggttttatgtatatatatatatatatatatatatatatatatatatatatataggtaaattaactggtgctacatggagtatgggtttcaaaattcaaattgagtatctacccaatttgaatgagtatgaattttttttaaatgtttagatatgatcaattaacttctttcaaactgaattttttttgttagattttgattctagttatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttatgtgttttatatcttggagcccgggcactatggagtcccatatggatatatatatagttgtacaatctcggattaattaacttatccctccatcgatcgatcacatcgtgctgttttatctctccatcatccccaccatcgccaattcaattcaattcgacgtggccatgacgcagacgaatcaagccatcgaggtggacggcgatcggctgtcgccaccgccaccggcggcgtcacccgccgtgtccgccgtactcgagaacgatgacctcgtcggcgagatcctgctccggctcgcctttcccaccaccctcgtccgcgccgcgctcgcctgcagacgctggctccgcgtcgcctccgaccccttcttcctccggcgattccgcgagctccacccgccccgccttctgggcttctacgtcacgagcctcaagataccgcgggctcacccgctcttcgtcccgatgccgccggctgcacggccaccggagctcgaccccgtcgtccttcgcggtggcaacttcagcctcgcttacgagggttacacgaccagtatctaccagtgcaggaacggtagcatcctcctcttcaaggagaggcatgatcggcgcgagctcaaatacgcggtgcacagaccgctgcagcatcctgagagaggcctactcgccatcccgttctcttcaacacatgacgatgacgatgacgtcgagcctgatctcggcttcgacgacgagaatgtgtgggggttccacttcggagaggatggcggcagccagctataccggttatcggtgatgttcaccccaaggggagctacttccgcgtggttctacgcattccgggacggcggatggcatgtccataccaaggcgacggcacagctacctggcttgccaccggaatcagctgggttcgtcgtggtccgagacaaggcctacttggcagccacttcgagcagcgttcttgtgttggacttgaagtcctcgagcttgtacaccatccagcttccagatggggtggagttcccacctgtgatgatgtggtataatgatcgaagccacgacgttttgttcggacgagcgagcgatgattctggggtttatatcgccgatctgaaggagcctcagcttcgtatttggctacttaagcatggcagcactggatggactctggttgataccatttgtttgcggtcgatgtgcgctaatttgcacataaattgtgtgggcggggatagtcgtgttgtttacatggattatgtaggggacgatgctgagtttttgttcttgaaaacagatgaatgtgcactctacttggatgttaagagtaggcaacttcacaaggtttacgaggtgacatgaaaaggatgaaatcttgttttcaatcatgccctttatgatgatatggcctcccatattccctgtgaggaaggaaatatcataataatggtgaattctcttgcaatgttctttcatgttattattatttgttccacaatgacacctggtagtgcttttgtacaatgaacccctagataaaaattttttccaaaggtttttttttttttggggcccctttcccttttataatattttaaaaaccccccgggggttaaagaggttgacatatatatatatatatatatatatatatatatatatatatatatatatatatatatatatatatatatatatatatatatatatatatatatatatatatatatatatatatatatatatgcgactttttttatatactttagtggtggttctggagttccatgtataatgtatggttttgctttaggatgcggaaacttggaatacactaaaaacaaattttggtacatcaagatatattttttttgagatacttagtatctggaagtacaaaggcaatagaaaatatgatacccttgtacctttttaaggactagcaaaaatatttgtgcgttcaacagataaagataattttcatgattgataagaactctgccaatttaaacgataaaaccgaaataagacagacaaaacaatggaaataattcaataatcacatatagattgaactaggttgcgttcgcttcatgcgttatcgcacaaaggatcccttatatacaccattccatagcctcatagatccacgagtggatatgccataagttgatacatgggtatttcgctatatcttggaccaaatattgaaattttgattattcaattagtgaaagttttttttactgtagatagcagggggaggcctatccaccagtggagcatgagccaacaccaacgcccagaaaattccctacatgctgccaactgtgagggatgtcgcctcgtcatgtcgcgacagcatctcttgcaccatatgcatcggccacgatccgaacaggggacaccgccacaccggcagtgacaccgtgagttgcccccgccatggccaaccgtcgaagtgccatgaccatggcgacctccatcctaacgccgccgactcctccctccttcctcgtgcacagcagccacggccagatctgcaccgccatcggcaaccttccgaaactccgccatccgcgcacacagcgtgtgctaaatttgagcatttcattgcatgtgttgtagtggttcacttgcttagtgagatgtcacgaagtcccaggttcgaatctccccctcgacgtattttttgcctttatgatcatcgctcacgggaaatagcgcaaaaatttacaaaaaaaacatgggaaccgggtgatcaaaccacgtgtctacttgtggttttaaaaaaacggatgaccaacaccacttcggtacaagatggtttatgtacgataggaacatatactctcacttaacagatatatagggttagcgccatgattgctggcacagagccattggactgaggtgacggcttatttttgaaataagtttttgatatagttctcttttcaaatatgttttctaaaagcgttagattgtcaaaattatagcaaagaccattggtgtcatgtgacaccattgctataacactagctccacccccgagtcacaggtttatctatccagaagcggttgaactaaatagccaatatatagcagaagaatagtaggaagagctcatgtaaattattttcaaaatgaatgaacatttttcatcaatttgtacatgctgaagtttttttacagtatatatcagcgttagtaatgttaaggaacaataatgagatgttagggttagggtttatgcgccacccgggcgaccgggcggcggcagagctctcgcgcgtggcgagatgggtctggatggagatctcctctgatctgctcctgatgtctccgggggttttacccgccgtgggttgttctgggggggatttcctccctgtgttgaaacgtgatctggtagggtggcctgatcatactcgtataggagataagttgaaggctttccctttaggcggattgatctatgggaaaggttcgttctctgctttccgtattgttccaggggatctgtggcccttgcgaaattctagaagggggaggagattgaatctgttttggtatccgaagttcgagttgtattggagacctaattctgtggcattgcagtataaatacaagtcacagtggtggccgaaggtgcggttcaaagtttttccggcgatagggctaggcgttgtcaaccccgtctctttgtttgttggatctagcggaagtctcatggcggccaatgtcggtgggggtgataaagggatcgtcattgggacgatttcccacccgaagctgatgagcggtaatgagacggacgcggtgattctcgacaggattcctctgaagatgatcgagggagcagcgggcacatctgatcagggccaggaacacacaacggctgcgaggaggggatctgcagagaacaaccaagttgatgcaacacagtgtcctgcagtgttcactgaaggagatctggtggaggatgaggaggatgtggttgcggtgaatattgaggatgatgaactgcagactgctggcctgtggacgatcttggcgaggttctattctctgagaactccgaaccaagtggccctgtttgacgacatgcgcagagcttggaggttgagagcagatatgagctacaaatcactacgtgacaacatgttcatcataaccttctcggtagagggagactgattttgtcattaaagggggtccttggattcacagaggagatgcactcctggtagcgagttttgatggcattacgtgcccatcgaatgttcctttggatgttgttccgatctgggtgcgcatatatgacctccctctggtgttgatgacaaaggtaagaggtgggatgtttgggagcaaactcggcaaagttcgtgaggtagacgtgagggatgatggacgcaacaaacatgacttcttccgcattattcgtgttgatctccctgtcaagcgtcctctgaaatcacagatagctataaggatgactgtccaaggcaaggaggtccttcgcaggttcgatttacgttatgagcgggtaccgcacttttgctttatctgtggttttattggtcattccgacagagattgcaatagaagatctgccaatgaggatcaacctttccaattctcagctgagctacgatgctcccccccttaaaccttttgagaagaagatcagtaaagtgaaagctgcccaaacatcaagtgttgcacgtaacttgttcttcagaggggcaggaagtgctagttcatcgtcctccagacacaaacaagatggtcagatgcaggaagcaataccgcccagagttgatgcccatgatgggtttgagtttaaggaaagggaaggggacactgcaattgatgagatgttagctcaacaggctgggaagatggatgttacgggggacaaaactcaggaaacatcgatggttgtccctgctgggaagctagcccagcaacaataggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgcagagggtgaggacacagacgatatggaggcaaccagccatggggccgctggtaaactgacgggacctgtgattgggtcccgtcaggagcaatgagttgcttggcttggaactgtcgcggtatagggaacgcggcgacagttcgtgacctttgtgccttagtgaaggaggcaggttcccatattgtgtttttaagtgagactaggcaaaagattgagaaggttcgtaggctgcggaatagattgggtttgaagggttttgctggggttaacagtgatgggatgagtgggggtctggctttattctggcatgagtctgttcatgtggaaattataagtatgaatgagagatatattgacgcgtatgttcgtttatctgtgaatgctcctgtctggcatgctacttttgtgtacggggaacctagagtggaaaatagacatcgtatgtgggcgttgttaaattcagttaagcaagtttcggatcccccgtggttagtggtgggtgattttaatgagactctttggcagtttgagcacttctctctgaaacaacgaagtgagctgcaaatgcaagcctttagggatgtggtccagagatgtgatctccatgatctggggttctcgggggtgccatacacttatgataataggagagaaggccgcagcaatgttaaagtgcgcctagactacgcccttgcagatgatgggtggaggggactgttctctacagcacaggtgtttcatctgtcctctcctagatcagaccattgccccatccttgtcaaattttcttctgaagaccttcacaggaatcctgtgaagtgtgtccattatgaaatttactgggaaagagaccctgcaatctctgaagttatagcagaatcttggggcgtttccggagttaagcaggatctgcgcgacattaatcaagctctgtttaggatgatgtctgatcttcgcacatggagtaagaaaaagttcaggaatgtcagccgggagattgagaaaaatagaaagaaactatctgaacttcttctaagtaatgccgacaatagggaaataagacgggtgtccgatcaaatgaatgaacttctgtaccgtgaggagatgatatggctgcaacgatctcgaattgcttggctgaaagaaggtgatagaaatacacgtttctttcacagcaaagcagtgtggagagctaagaagaataagattacaaagctacgggatagtgacggtactgttcacagtacgacaaaagagttggaacgtatggcaactgagtatttccaaaggctgttcactgccgaccccagtattgatcattcgtgagtcactagcctgatgaagccgaaagtcacagatgcgatgaatgagaaactatgcaaacctttagtgaagagaaattgcaaatgccctgttccaaattggtccgttaaaagctcccgggccagatggattcnccggtcggttctatcagaggaattgggctatactaaaggacgacattgtgcgagctgtacaagaatttttctcttcgggtaccatgccttcgggggtcaatgagactgccattgttctgatactgaaaactgagcaaccataggaactaaaggatttcagacctatcagtttgtgcaatgtggtctataaaatagtgtctaagtgtttggtgaacagactaagaccaatcctggatgatctggtgtcacagaaccagagtgcctttgtccctggtagattgatacaagataatgccctgatagcattcgaatgcttccaccatatacagaggaataaaaatcctgagaatgcttactgcgcatacaagttggacttgtccaaagcgtatgaccgtgtagactggaaatttttggagtaagcaatggttaaactgggtttcgctcactgttgggttaaatggattatggcatgtataacctcggtgagatatgcagttaaacttaatggaaccctgttgaacacctttgctccatcacgaggtctgcgtcagggtgatcctctttcgcccttcctattcctttttgtggctgatggactgtccttgttactagaagagaaagtggatcagggagctatgaacccaattcagatatgccggcgtgctcctgctgtgtcgcatttactgtttgcggatgacacgctgttgttctttaaagcggcaaatgatcaggcggtagtgatgaaagaagttctcgaaacttatgcttcctgcactgggcaattgataaatccttgcaaatgctccatcatgttcgggcaaagctctcctactgctgtccaaaatcagataaagcagaccctgcagataagtaactcctttgaagataaatatttgggctttccgatgcctgagggtagaatgaccaaaggaaaattccaaagcctccaggagagattatggaagagaattatgctgtggggggagaaacttctgtcaactggggggaaggagattttgattaaagcggtcctacaggccatgcctgtttatgttatgggactcttcaagctcccggagtcggtctacgaggaattgacaaaactggttcgtaatttctggtggggagcagagaaagggaagaggagaacgcactggaaatcctgggactgtttgattgctcggaagttgaagggaggtatggggtttagggatttcaggctgtttaatcaggcacttctagctagacaagcctggagattgttggacagaccagacagtctctgtgctagaattttgaaggccaaatactacccgaacggttctctcattgatacaagttttggaggtaatgcctctccaggctggagagcgatcgaatatggtttagaattactgaagaagggcatcatatggcgcattggcaacggtaaatcagtcagattgtggagggatccctggattccgcggagcttttcaagaagacccatctcagctaaaagaaattgcagactgagatgggtttcagacctgattgatcagtccgagtcctgggatactgacaaaatctcgcagcatttcctgcccatggacgcagaggccatcctaaacattcgtttatcttcaaggctggaggatgacttcattgcttggcatccggatagactggggagattttctgtcagaagtgcttatcatctggcaatagctctggcacaggttgatgaaggctcgagttcgtccgggaatggaaatagcagagcctggaatgccctttggaaatgcaatgcgccccaaaaggtgaagatttttgcctggcgagctattactaacagccttccaacattggaaaataagaagaagaggaagcttgaagtttcagacatctgcaccatttgtggggtggagtcagaatatgttgttcacgctttgtttcgctgcccacatgcccggcaattctgggaagcgatgactgttgatatgaagcttaaccctctcagcaacattcgcaatggagatccgaaagtgatcttggacctattggagcagtcgcagccggaggaacaggttatgcttttaatggtactgtggcgaatctggcacacacggaatgaaatagtgcatggcaaaccagccccaggaatactagtgtccaaacgtttcattgaaagctatgtcctctcccttgctgagatcaagcaacacccccaagcaagtcctgagaaggggaaacatgttgtggatgtggttctaaagaagtcgcacaacatcaaacggagtcaagaacctgttcctgacaaatggtcgaagccgctcctaggaagcatgaagctgaatgttgatggctcattccaggagagtgacggcaagggtggtataggcgctgtgttgcgcaactgcacaggagaggttatttttgctgcttgtggacatgttgatcgctgtagcagtgctttggaaacggaactccttgcctgcagggatagtcttgccctcgccctacaatggaccctgctgccaatagtgattgagacagactgcttggcgatgatccatcttttccgcgatgcaacaggtgctaaatcggagctggcgtttttaatcagggagatagattctctcttggtgggaaatagggatattagcttcagtaagtgtcttagaagtcaaaataatattagtcactatttagcaaataagggccgttgtgacaagatcacacagttttggccggacaataagtgtacttttatctcgcagtttatctgtgaggaggctaatgagtaattatccctttcccctgaaaaaaaaaggaacaataatgagatgtataggttatcagggcaaaaacaaagggattagtgcatatgcatatgcagagagagtaggaaactcacaaactttgcacctctctttgccgagatgacacatgcttttcatggctcctatgctataaaagggcagcatatacagtcatacagactagtattaattagttactaagcagattagaattagttttggatcatcactgcaaattgaaggatcacacaaatcaatggctgagttgcattgtcgtttttgtgttttttggcattctgtaacttgaccgccccttgcatatatatgcagccagctgaaattagccttggctggcatcctcaagttagagaatgccaaaaacacaaaggcggccgggatgctgtgtcttgccggaaggcacgaagctgacgctggcgcacgacgaccacggcgtggctgcagcggcgccaaggttcatcatctacaaggacaaggccgacgccgtgccgtccaacctccgcgccatggacgccatcctcgccatgttcggcatcctccctggatccgacaaggcggcgcaggtcgccgacaccctccgcacctgcggcgaactgacggccgccggcggcgaggagccacgccacctcccgcgaggcggtgctcgacttcgccgcctcggcgctgggcaccagcgcgccgcgcgcggtcaccacgctcgtgcacgggagggagccccgcaggtacgtggtagcggccgacggcgtcgcccggatcggcggcgacgccgtggtggcgtgccaccctatgccatatccatacgaggtgtactactgccaccggccagccgacgcggtggcgctgagggtcgacctccacgccgtcgccggcgtgggcctgggcggcgccactgccgtcgacgtgtgccacgtcaacaccaccacctgggacagtgcctacttcgagctcctcaaggcaagccgtggcgacgccatctgccactacatgccgcagggctatgttctgtggctagccaattgagacgatattagtatttcctacaaacacctgatcgtagctactcaaccttccatgattgatgcttgatgcatctctcgctactacttcatccgtttcacaatgtaaatcattctagtatttcccacattcatattgatgtagaatgacatacattgtgaaacagagggagtatcttaataaacgcaaaatctatttcgagaggcatctcgatttagacttaacgagcgacgtggacaattacgtgagaagtattagtagcattacagacatgcatgtaagcagtttttctattaggttgtgcatattttttcttcttataaaattttcacttaaattacttatccgatctataatccgattacaccattgtgttcgttgcaattaaatctttataacaagatcttacatgataatattatgataaaaaaaacatttatgttataaattacttttataatatatgtaagttacttttatcttatatacaaattacttttagatttgattaaattacttctcataatttcataatgctttgagttgattacttttattattattgtttttactcagtttcataatttgtgttgattaaatttaatttctaaatagacttatatttttattcctacgacgaatttacttctaatatcataacaacttactttcattttatactaagttacttttatgatttttgtaaattactttcaggctttattaaatttactttcataaatgtatttacatgaaaatcttctctacacttttgaatttactccacatagtttcttattggaactcactcataatgtaattacttctatatagagttacttctattacatagctaagttacttttacaatttaaataaattacttttaaattaataaaatattttaatatattcaatctggatctcgttttatcacatattttaagtggagtacaatgatacaaatagatcttaaaaataatatatgatttaaaagatacaagtgattaaagaggtaaaaaaacatgcactatagtactttttaagctaaaataagatttaaatctaggatggagtgatcgctgctttaggcaaaccagagaccggtcgttgtgtagtcatgaaataaaactgatgctgtgctctctgctcgtcctcgactcctttttccttttttctttttttttatcgaagaacagtgaaggaagctatactaattactgttgcaatcccatgcctgttgctaacttctgaggaaggatgaagatgtcagagtccaaaaagaatcggtagactgaaattccaagttttcaggaaatttgaacccaaaaaagttgaaaatcgaatacatttttactaattgtcaacaaattagtaaaactgttacactgttcattcatcacctgtgttcgaccgtccgatctgcctatccaccaagctgttcatgtgcagatggactactcgagtagtgtggagatgacgaggacggcgccagagcctctcgctgcagctgatttggggatttccatttcctttattactgtgggggatttacagattttcattggctctgctcgctgctaatttgggcagtacaaattttgtgcagccttccaccgatttcgagcatccagtatgcatgccaaaaagggtttcccaaaccgtcagggccagggttaccgcgccgtgaaaaaccgtgtaaaatttatcaaaatttaaattattttttaaatttatttgaatttaaaaagattactgcagtttttctattaccgtaccccgcggtaaggccggtaaccgcgcggttaccgaaagaagataaacatgctattttatctctaacacgcccccgcagactgaacgtcgttcgaacaaacgtttaggctggaccgaaactctgtgaagactggagttggaagacccttggtgaagatgtcagcataatgtgtgagcacattaagagcgcgaacggaaccaatggcgaccttctcacgaacaaagtgtagatcaatctcaacatgtttcgtgcgctggcgttgcaccgggttagtcaagagataaactatgctgacattgtcacagtagaccagagtagccttgactggaggagcatgaagctcatggagaagctggcgcaaccaacatgtctcggcaacagcgttggcaacaactctatactcagcctctgcactcgaacaggaaaccatagtctggtgcttggaggaccaagaaacaagattatctcccaaaaacacagcatatcccgaggtgaacttgcgagtgtcaggacaactggcccagtcggtgtcagagtagacaaccaaatcatgtgaggctgagtgacgaatgtggagaccaagatccagggtgcctcgaacatagcgaagaatccgcttgagagctatgagatgagactctcgaggatcatgcatgtggaggcaaatctgctgaacagcatactgaataccaggccgagttgctacacggtttgcagtcgaacatacctacacgctccaatatctccaagccatactgccgttgagtgagaaacaagccgaaggaatggcgagagactgaaacaccgagaaagtgatggagctcaccaaggtccttcatactgaactcagactgaagagaagagattgtccagtgaagcagcgatgtcgacgaagcagtgagaacaatgtcatcaacatataataagaggtaggccacatcacctccacgtcgacaaataaatagagaagtatatgccttggcttcaacaaacccaacggagcggagaaaagtggcgaaccgactgtaccaggcgcaaggagcttgcttaagcccatacaaagacttgttcaggcgacaaacagagttgggctgagcaggatcaacaaacccagatggctgcatgcataacactgtctctgcgagggtgccatggagaaaagcattcttcacatcgagctgatggataggccagttacgagagactgccaagctaagcactgtgcagactgtagctggcttgatgatggggctaaaggtctcgtcgaagacgatgccggggcactgagagaagcagcagaggacccaccgcgccttgtagcggtccaaactcccatcggcgaggaacttgtgacgaaagatccacttgccggtggcgatgtttgtgcccggtggaagaggcacaaggtcccaagtgcaatttgacatcggtgccgagtactcctcttgcatggcatcacgccagttggtgtcggcgagcgcagcatggtaggtgcgaggtatcagggagagagtggcggcatggaggttcaggcgtgaagtggcaacccggacgccagccttgccccttgtcaccatggcgtggttgttgtcgatgggagagatgccgaagcctgtaaccggtggccatgtaactagggcgcgggcgcttctggcgcacgtcggtaccgcgagtggcgacggctagagaagcggggcacgcagcaagcgcgtactggacgcgccgtcatgagctggggaaggtgcgccgtcatgagccagggaggaagcgccgtcgtggacatgaggagcgccgtcatgggccaagatggcatcatcgtgggcagaccgagccggagaagctggccctaaagtagagaccccatgggccgtcggagatgaggccgcaggtgccggcccaggagagaggcgcccagcccagcccggcaagcagggaggggtcggccgatcgatgcatgcgccggtgggcccaagagaagtggaggcagccttccccgagcgattggagccaattggagcctgtataggagaagtaaaatcctccaggaaagcaagatcagtagcacaagcagtgtcaccagtcatttcggcaaagggatatgtatcctcatcaaacaccacatgccgagagataataaccatgttggtgatcggatcgaaacaccggtatctcttacgttcgctagggtatccaagaacacacacttggtggaatgtggcgagagtttgtggggtgcggtggcggataggttggggtaacgacaaccaaagacgcaaagatgtgtgtatgaggggtggacaccgtgaagggcgaagtagggagtgtgttgggctaaagttttggttgggtgagactcaacccataatgagccggggaggtgagcctgaaatagaagcgagcgtacaatgttattaagagaacgatgagtacgctcagctttacccttttggggcgaggtgtgtgggcaggaaatgcgcatggcgacgccgttggtgaggaagaaagatcgagcggcggagttatcaaactcgtgaccattgtcgcattggatgttgcgaatgggtgtagcaaactgtgtcctgacataggcaaaaaaaatgcgaaagagtggtgaatgtgtcggatttcaaacgaagaggaaatgtccaaacataatgagagcaatcatcaagaatgacaaggtagtatttaaaaccagacacactgagaactggagaggtccacaaatcacaatgaattaactcaaaattggccttagccctagacaaagaagtagcaaaagataggcgtatgtggcgaccgagctgacacgcatggcatacggtggaggagccgcatttgggaggagagatgaccaaggagtgagcaaaacgggtgagggcgtcgtgaccaatgtgtccaagccggcgatgccagagtgtggtggtagtggcagcgaaggaactggcaatggaggtgaagaagttcgccagaaaggagtacaagtcaccgaagctattgcacctggcgatcacggtcctggtaagtagatccttcatagtgaaaccaaacttgtcaaactcaatggagagattgttgtcagtgacaaaccgacaaacagagattaggtttttgataatgttaggtgaaacaagactgttattgagaacaaacattctattagcgtgaagaaatgaagcattgccagactgctagtagcaatgatgggcaaaagagaactgttgccgacgataatgtgggacagagtggcgtaggtaggttgggtgagaggataggataccggtgtccgatgtcatgtgtgaggtggcaccggtgtccatgtaccagccgttggaggcaggcgtcgtgagggtgtcggtttgaaacagacttgccaaagtctgttggtcccaagcaagtgttgggctggaggctccgtaccaggacgttggttgggccgatggctgcagttgttgttgctgctgagtgaggccggctggaaggtaagggccggcctgggagaccggctgcgggagggcagcttgcccaccggacattgccacgcccgcaaaaggagaagtgggccgagggcccaaaatccctggagcacgcagcatcgggccgcccagccacatttgaatcgtgccgacccaggggtgctgaggagtgggccaggcctgtccagcgcgaggctgaggggcagcctgccctacgctttggccacatgtgccctgagcggcgccgccattgccgccggcggtgccgcccccgttcccgttgcgtcgacagcgatttttgttgttgccgccgccaccttgtgtgttgccgccgccttgatttaggttcccgaaccccgtggcgtgcaattcatgagggcggtggaggagttggtggagcggttggaggggcccttgttgatctcggtgagaattagcttactcgatccgggcttcgacgaacatcgggaagggacactgcagaggaataatagtttggagaatttcatatttagggtttaaaccaccgatcattgcaaggacaagttgctggtcggtgacggggtcgccgagctcaccgcgagtgtcagccatagccttgagacgtcaacagtagtcgttcacgccgaggtcaccttggacgaacgtgtgaaattcagccgtgaggttgatggcgcgctgttcctagtggccgaggaacatctgctcgagggagagacagacgaggcgtgcgttaccatcaggctgaatgatggtctccaggaggtcggtggcgatggtcccatagagccacgagagcacgacacaatccgtccgagcccaggacgcatgatgaggaaaagcgtcgtcagagaggacgtggtcggtgagggcatatttggtaatttgcggcgccaaggtcgaggacgacggggacaagcaccttgacattgagaacagacaccgcctgggcatgaagggcatcgacagtgtcagaggttggcagagcgcccccggacatggagccggcgggctgttcgtgctagggtgtggctgatcggcgaccaaccgcgcgggcctgcacccgtgcggtcagtcctgcctgccttagtccattagtacaacaactactgctacaatactactactactactaatactactaccactagtacattattactactacttgtaatactagcactattataattgtttatatatatatatatatatatatatatatatatatatatatacacgtatacaaagtttatatatgatgtatacaaaatttatatacacgtatacaaactttgtatacgtgtatttttggtttttatatacatgtatgtataaaaataaaaaaatacacacatatatataaactttgtatacgcgtatacaaacgttgtatatgcatatacaaaagttttgggtttttatttacatgtatgtataaaaataaaaaatacacatatataaactttgtatacgcgtatacaaagtttgtatatacccgtatacaaactttgtatagaagtatacaaagtttgtatagacgtatacaaagtttgtatagacgtatacaaagtctgtatacgtataaaacgaaaataactgaaaaagatacgaaaagaaaaaaacagaaaaaaccaaaaaaaggaaagaaaaaaacagaaaaaagaaaaaaagaaaccgtccaccagaaaaaaaaaatttccacgcgccgtcctccaccctcctccccgcgcgcgacacgcgtccagtcgcgcgggggagggggcgcgcgactgaacgctaattagcgttctcgttcgtgctgtggtggttgaaggctgagtgcagcgaacaggctagcgtggtcggccggtgaagaagagccgaggccgatgggcggttgcgtggtcgcgctggctggaggaagtccgagggtggcgcgaagagccgcggcgtcaacggtgaccgttgtcgggaaggtagaacttgacgctgtggccaccgtgtcgttgataggcgtgatgacgagagcagaaatcaccgcttggacggccttggcagtcgcggccgaagtcgcgtcgatgagagccgtggcggcggcacggtcgtcaggtgaggccgagtcgtcgggccgaaggacctgccggatggcagaggtggcggcgtcggtgatggaggcgaccgccgcggtaagagccgtgtcgtcgacggactacatgggcgccggcaggagagagagccgtcggcgatgaggttttagggtttagcggaagcgattggatcgggagtatctgataccatgaaagcagggatagctcaacgcgatatcgattaatcacggaacatgtgtacatatatagctacatccataccagaatctctcaaccgatgtataacagaatcgggaagattggataggagatcggcaaaagcagaaagaagataaacatgctattttatctttaacatatttgatttacaagacttgtcaggggcctaggaatgccttcagttttcgactttttacaagataatagtgggtaaaatgagaatatgcttgcaattagtacttgcctcataatgtaattagtaaaacaaaatggcaaaatttgctacaagacacacaaaaaatatgtaattagctcaccccaccgccccgctcgcgccgacctcgccgacctcaccctcaccgcgcgcgttcccggcgaaggagaaaacgaagaaagagaagtggcaatccgggtatttaggaaaatatctcatctcttttgacccagaaataataaaataatacgaccagtgtcctaaaaccaattacacaatttttgtagtgtccatcagccatatcacgttttcgcggtgtctcccagctaatcccagctaattacatgttttttacgtgtcctgtagcaaattttgccaaa

SEQ ID NO: 80329 - DNA, 23926 bp, Oryza sativa
ggacaccttccttcttccacaatagtttaagatcttcgaccagtggtcttaggtacacatcgatgtcattaccaggttgcttggggccttgaaaaataatcggcatcattatgtacttcctcttcatgcatagccaaggggggaggttgtagatacacatcgtaacgggccaagtgctatggccgctgctcatctctccaaaaggattcatgccatccgtacttaaaccaaaccgtatgtttcgttcgtcctttccaaagtctttaaattttctgtcgatgttttgccactgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagttgcccgtcaacttctcctggatcatctcgtctaatcttgtatcgtagtgctttgcaaacagggcatgcttctaggttctcgtactcctcaccgcgatataggatacaatcattcggacatgcgtgaatcttctgaacttccagtcctagaggtgcagactatcttcttagcctcgtacattgtctcgggcaatttgtttccctctagaagaatgttcttgacgagtttcaataaatcgccaaatgccttgtcactaacaccattttttgccttccattgcaaaaactccagagtggtatccaactttttgtgcccctgctcgcaacctgggtacaacgacgttctgtggtcctctaacatcttgtccaatttatgggcccccttttcactttcgcagtcctccttggcatcctgcaacatctaaccaagatcatccgcaccgtcgttaccatcagcatccctttcctcctcgcctgtttgatttccttcaaatccagcgtattgagcaaagtccggaatattgtcgtcttccacttcatcttcttccatttcaacaccttgctctccatgggatgtccaacaattatagcttggcatgaaccccgactcaaacaagtggaaatgaatagtcctggatgtagaatactccttctgattcttacacttattgcatagacaacaaataaaacccttttgcctgttagcttcggccactctaaaaaaataatgcacgccgtcaataaactctttggaccgcccgtcagcgtacatccattgccgatccatctacatgacatgaaaaaaaatcgtatacaaataattattcgtacaataatgacagtcatacaataattataaaataattacaaactctttcaacagtcatacaataatgatatatcattattcatacaaaaattatgaaatattacaccaaataattcttatttactatttctaaagttttaaactaatattaatgtgttgtacttcttttaattttcattttagtttgttttctattattcaagattaactttcactatattttccttctcaactattttataaaaccttctttagcaaataaattaaatttctatatattctttcttccccacacaaattttctctctcatcaacttacaacaaaattttggagacaaaaaagtgtgcaaaacatagctccgaatgtaatatgaaaaaaaacattggaggattaagttgctaaccttttaggcacctccaatttgtatataatcaccaaaataaattcactagaaattttggcatgacctcccctctttttttaagaaattttgaagcttgctcgggctggaggaggaagaagacatatatatataggggtgggactttagtcccggttggtgttatgaaccggtgctaaagatcgccgggatctttagtcccggttggtaaagatcccgggggagcctgacaagccctgacagcatttgaaccgggactaaagacggttggtgttaccaaccaggtctaaagatcaaatatgcccgttaccctttttaaccggaactaaagatcatctttagtaccggtttttgttgtaacagggactattgtggaattaggccgaccgacgaaagatggtttctccaccagtgtattttaactgtgggaagttagctgttatggaaagcagtgtgaagattcttgtgtttttgtctaattaagccgtgcttaagcgtgcggcttccaagttgttggagatcggatcgtagagaacatccaagttatctgattcagactatttagattgcgttctgatgagaccatcaaagttccatctatctctatcgatgcttctacatgtttgcataatagctcatctaggagtattgttcaggttggatctttcttttgtaccgtgcaacaacgaaagaaaggagaaggcctagctgcgagcagtacttttataggttaattaaggtaagtgctattagcggcatcgttaccattaatcacataattagattactttttatttgtttgtttgggcctgctcgagtaggactctgatcctgtattgcctgcgtgcaatataaaagcccaacgtggcctgtaatcagtggcggatccagaaaatcgattcgttggtgtcataacgtgtatattggtgtcatagtatgttaattatgtttagatcataatgttataacatatggataaacagttttgctataggttttgccgacaccgcttcagtggcgaatctaggatgaaaatagagggggtgcttctaatatcctatgtacaacccacaatgcaatgaaaacatactaaaacatgcctcagcatgttgtcctgatggctgagttggacccttcaacatatatgccctcctcacttgatctataatctccttaggataatcttcaatttgtttgcgacacgctggatcggcaacaatttcactaggatctaaaacatgcctcggcatgttgttctcatttgttagattccttcgtgggtaaaaattatgcaatgtttgattctccatccttgcaaattaactgtcctatgtgtgcttaaaataaataattgatttactgaaatttactgcagtgatgataaaataaactgaaactgaagagactagtgttagagtagagagcaaatagattgatttacctgtactggttgtggctggttgtggcgttgtgctggccagccgggcagcagatgatgagatcgttgtaggctgcaactgcaagcaactcgtcgactcgtcgtcccgtgatccgtcctgcaggacctccgcggtggcgcgatcgttgctgccgccggcgctgtcgcctgacgcagtgacgcctcgactccttctgtatcgcgcctccttctgcgtggcgctgtgacggcttgctttctcggtcgccaacccaatgggccaggcccagcttgcgagggaggggagggggggggggggtgctgtcgggtgaagctggggctccagccccaacagtacatccgcccctggcccctgcctgtaatgagagttagtttttgcttttggtgaagtcgtctagggtttattcctgtcgaactggaggatggcgatcccatcttgttgatttgccgctgccgccgtgaggtgtggagggagcacacgtccaggatacttctccagggagtgttgcttggagtcaggtttggttccatcttctctaatcgtgtgtattgccacacgggtggagttgcagatcgttgatatgtatcagtgctttaaaactactatctgttattgctgtttgttttgagagacaaaatcaattcactgcgacgctcatatacatactgccggttaatattgttcttactgctttgatctactcatttgtttaagttggaaaaataatcgggactgtctagtgcactgtcgacagatttttggacctccgatcttgtcaatttttttaaccaacagatctatatccaacagctaatattatttgacaaataaaaattaaaaatacataaatgaacaaacacaaataggtttggaagcccattttcaaagggctcaacacaacccgacccaatcaaatagcctagattgagcccgaatacaaaatttacatcaaatgaaagcccaaattaactttgtagtcaatttaaaggcccaaatcaaagaacaacggctcagaaaggatttagagggagaaaaaaaattctttgaaccttcttgatatgaatcttcatcagaataaatcacaaaacttaactcaaatcttctgatattgatctacatttctgtcgaatgagattgaactgtaaaaattaaacaacaagttaaagtcactctgaggacccttctaatgcagcacaccacaactcaaattagataaccaaaatgtagagttgcagacacattactgtaaaaatgtagaaattcagagaacagaccacaagtcaatcagaaatagaggagtcaaacacattattgcagagctaattaattaacaacaaatttagaattaagcccacaagtcaatcagtaattcggaatacagacatattactgcacagcaacaaaaatgtcagaaaatttagaatttaggacacacctcaaatcagaaatcagaaatgttcaattggtgatatattaagtagattgacttcagactgttcacagatcgaaatatttgagtgtttagcttcggattttcatatgaatctccatcaaaaaacttcacaaagcttcatcactccaaaaaaatatcttcttgagttatgggtctacattttatacataaatcttcatctgtcaaaattaatcaccagttaaattcataacaaaaaaaattcttgacttaaaactttacagaaacatcacagaactttacaaaacaaattaatggtaggaatttatgtactcatatgtattagttcagaataagaaaattagatgcaatacctctattaggcaaaacaaacatatagctgcaaataaacagatgttagagtatttagataatcaaatcaaacttcaaaactaaaaattataatataaaactaaattaaaaattgctcctagttgtcataaaccattcacatcatgcacaatgcttcataaattgagaatattcagcagcattctaatttttttcttaaattacagttattttgtacaggaattacataaaacaaacattgtaattttaataatataaagatgtaactgacatcttgtagactaaagactttatataaacatcacatatcatattatcttagaattcaattgttatgtgtattcttaggttgcacaacataatgacatatgacttttgcattgcatattttctggtcatattagaactcatgcaaatatgtactgcatatgtactgtattcagaaccgaacttatatcaaaatttggatttcagagaatttatattacatccaaagtcaacagcaaatatgtcaaaaaaatcagagtatatcagatttaggcatgtatctagaaactgcacaaagtatatctatatatcagagaatttatattacttatgtaccaactgcacaaagttcatggaaaccagatttcagatgaagcatatcagatttcatatactttgcaagtaaagttgcaggtacaagaaaagtcaaaagatcaaattcaggagcaaaagcggatcacgaacaatgcatagggggaaagagttgaagtcaaaattcaagcacttaataaatctgaagttacatttaccactttttgaatcttgttttgaatcttcttctgaatctgaatccagtggcatgttcatttgtttcttgatcttcaaattgcgtctaaaatccagaattcggaccacacctcaaacttttagaatcttcttttggttttttgatttggatgttgatgtacaaagtacttcgactctgctatcaaatggaaacaaaatgaaacattcagtcaaattggtagacggaaaattaacatatgaaaataccagtgcagaaatcaacaatgaaagcgtcttgctcgattttttgtttcagtgttgtttcaggctaatatgcaagataacttatcaaaaattagtatactatgaatcttgcatactaaattgttttagtttcaatctttgcagcataagattactgactaaatcaaatcatcagatactatacttgcaattttcaaattgacaggattaagtttcagaatttggcacaccaatcaagatacattattttcatagctgaccaaaccaaactccatctgaatgaggaacatacaaaataaactaaatctgaatctgaaacttacagatacagtaaaacgttaaaaaagtaagattttaactgaaaaaatcttacaatatcatagataattaataactgaaaaattatacaatctcatagttgagttcgagtttgaatgatttcatatgttgttcattatctacaattatttgcaggaatctcatcaaacaaagggaacttatcaaaatattacaaaaatggtggaagaggacaatcgacagtctggaaaaaattgcacaggtttgcagattacatattttctgcttaattattttgaaaacaagtgaattgagcacacacacacacacacacacacacacacacacacacacacacacagatatatatatatatatatatatcaaaagtgatttctggaatattccatttgaaggtattaaagatgggaattttcaagatagtcaagaaacatagacaaagtacatgtatgagccatctttataaaattacagtatttttatatcaaatttacagttataaaaacctgtaattttagattcaatttcatgtaaatgatacaaaatcaaatattatggtcacaaaaatcaaacctgcagatataacaaagctcccctgtcagtgtagcaaaatattttagtttcaatatggctgcaccatagccgacaacaatcacccgcatcaacaaaacatcttcaaggttcagagttcttaattctagtcaggattaggtgcaaaatggtatacacaaatgaaatggagtaaaagttcatttttttttatgatagtttgatacttgccgatatgattctgagcaactttgttcaggtaggagatgcagcgcttacttaactgattaagactttctccaccaccctaaacatcatctgaaacagtgataaacttttcaaagttatatagtactacagctacaaaatgttatacacttattccattttttatttaacagacctagacaaagttacatttctgggttataattgttccaaagaaaaaatacggtttggaacttaccggcaattcttggtttctgccatcaaagtacaaaccatttttaacttcaaaattagcaaagcctttgaaaacgcctgggcttttattcacagtgtcatcccacgtcaaaccttgcagatatcccatgtgcctttctcttagtgattcagtcaacactaactgaaacaaattattggtgttactcatagaggaacaggcaggacaaaagtaggctagaactcacatttgatacatcacaggctttctctatgatttctgcagtctcagcagcacgcttcaaatcagacgattatacaacaattggcctagcttctcttgccagacgatgagccaccttacaagtttgcatcagatcgattcatttcaaacacattttacaaatccacagcaattgtacccataaactacaggattcaccaaataggagatccaccgattcgcatacaaataagaaaaaacaaacactcaaataactcacctgagatgccagctccaaatcgacgcttcagccaaagaaataacctacaacccaaacaaaattgagattaaaactcaaaatcacaacaaaaaacaatgaaaataggggcaaaagcaacaaaaactcaaaagcttcaaccacacacacggccgaatcagggaagaagcaaatcactgaagaaaaaaggttgacgaacagatccgccgtctcctcgcaaaaatagagattaaaactcaaaatcacaacagcggtgatacgcaaccgttgatgaattctcgacagcgaacaatgaagaagagaacaaatccacataaaaagttaaggaaaagagcaaaaaaaatggatccatataaatcaacaaaataagacgactcatcatatttaactcgtagaaggagatctagattgctgcaaaacacagagaaaaccctataataaaaaaaaataaaaacacaaattagttgaacaaatcgatgcaatcaccaccttacttggcactgaggcacgcaagcacggcacggcggtgatacgcaaacattgatgaaaacttagcggcgaacagtgaagaagagagcaaatccacaaataaagtaggggaaaagagcaaaacgtagcagaatgcaagcacaaatgctaatgaaaagaggaacaagcaaaccacaagagacaagccggcgagacgccggcgagaagccagcaacgagaagattcgccaggctaatagcctcgacggagacgacgagagaaaagaggaaaaagaaagaaatttcgcctcactctctccccgtgtcaaaaggaatcagaaagcaggcgcggatttcaaaattgaacagtaaaggcaggacccactaagcccaatccaatctagataacccaatccagcacacagagcaaacccagactatgcacgaatcacagaacaaaacgaatggaccaaaaaacgacagattgagcagtcaataatctgttgacagagatgtagcaattccgaaaataatctggttggtttattcagttgttggtaccgtgaaagagaggaaaaatccgggcattcactgccgggtgctcatcatctattatctttattctagaataaacaaacctactactccctccgtattttagtgtatacgtcgttgactttttatttgaccattcgtattattcaaaaatgttatgcaaatataaaaatatttatgtcgtgcttaaggaacatttgatgataaatcaagtcacaataaaataaataataattatataatttttttaataaaacgaatggtcaaacgttggttaaaaagtcaatggcgtcatacattaaaatttaaaatacagaaagagtataaaataacacatcataatactatgaatcatagaaaggccacaaacgaaggcaaccttactctaacagctccacagcttaattattagtgataaaaaagcaacatatagataaaacttttatacatgtgttatcaagtgacttaaaagccaatattaaaaaataaaatactttaaaattatcctaaaaccaactttaaaatttaaaatttacaatttgacagtgattccatatagaaaaaacaatgagactgtgaaaagcacgtgtagaattgtcaatacctaacctgtcagcaatcttgtccgagaaacagggatccaagccaaaatcgcagtgggtcagtttgttttttttttaagtgaaacggtggatcagtttgtgacgaggacatcccttccaacgatacaaccacgcctattgcacagcaaggaccaatgactagagctcgagctcatgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaagtttgacccaggctgctcagaatgacgaaaatagttctttacaacagaaacttgggcttgggccttgtatcattacagcccattaggggtccacagaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgtcgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcgcgatttcgtcaccgcaaacacttccaccatcacttcatttatcttcatcccgctgccaccatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgtttcgatttgttggctgaagcttgtgaaatttcgaaaatgtttgagaaaaggttattttgctaaggcttgttttgacttgttggctgaagctttgagcttgctgtacaaaaaaaaaagaaagaaaacaaaaaaaaagaaagaaaaaaaatcagaagtgaagagaaggaaaaaaaaaggaagggaagagaggaagttgttgttgttgctgttttgtttgtgttattttcgtgctattttgagtggctacgcttgtgactaggctcgcgtctctaaagggttttgcctaggaccagcacaataccatcgttgaatgattattcaacttgctttgattaatgtggttctagctgtaccttgatattacttgcagccacctatagctccacaaatttttatctactatatcacaggatcgtgcttgttgtcggctccggtactactaaccgttgttgctgttcttgctgtttgccaacgccttttacataacaaagtaagaacatgtaagaactcgtttgcacaagtttggtagaagtggagatggacaacacctagctccaatagttgataggacatatttcttgtgaattgtttcttcccattaaccatgacaggaggatcgggggagcaccctcaacattcaccacgtacaaggggcatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctgtgaatacttctcttgcaggtatcttgaatacgttggagagaatgggccaagatggtcatgatggatcggctaggcgcaaccacaatggccatgatgctaatagcagcatcgcagcaagggaagaactggagtacgctgctgacactgagcatgatgaggaggtacttggtcgtccacaaagacaacagcgccggcagcgccatggcatgggcgctccaccacggcaggaggtacgtgataatgatgattctttaggcaagatcaagtttaccattccttgctttgatgaaaaatatgaccctgatgcatatcttacttgggagttagccattgatcagaaatttgcttgccatgattttcctgagaataaacgtgttagggctgctactagtgagttcactgattttgcatccatttggtggagtgaatttgttcgttccaatccaaataacactccccaaacctgggatgcaatgaaaagagtcatgcgagctagatttgttccttcatatcatgcacgtgatttgctgcacaaattgcaacaacttagacagggaaacaaatctgtagaggagtattatcaagctttgcaaacaggaatgcttcgttgtggattggtagaaaatgatgatgctggtatggctagattcatgggtgggctgaaccgagaaattcaggacattctagcctacaaagaatataattcaattaatcgtttatttcatcttgcttgtaaagctgaaagggaagtacagggacgaagagctagctttaggactaacatttctgcaggtcgtgctagctcttggacatcttccaacgttgctgcaccgtcaactcgagcagcagcaccatcgtcctcaaacaacaagctgcgcccctctacaacaaactctacaccatgcccgagtgaaccaacaagaggggttgctgctacaccttccaagagctcatcatcagtagcttcatcaggaaggacaagagatattcagtgcctacgctgcaagggctatggtcacgtgcgcaaggactgcccaagcactcgtgtaatgatcgtgagagctgatggtgggtactcctccgctagtgatttagatgaagaaacctatgctttgcttgcaactaacaatgcagggaaaggtgacgcgccccaccaagatgaggaacacattggggctgaagctgcagagcactatgagagcctcgtggtgcagcgagtgctaagcgcacaaatggaaagggctgaacagaatcagcgccacaccttgtttcaaaccaagtgtgtgatcaaggaacgctcttgccgcgtgatcatagatagaggaagctgcaataatttggctagtgctgaaatggtggagaaacttgcattgagcacacagccacatccgcagccctactatattcaatggcttaatagcagcggcaaggtaaaggtaacacgattggtaagagtacattttgccattggttcttatcatgattcaatcaactgtgatgttgtgcctatgcaagcatgttctattttcttaggtaggccatggcagtttgataaagattctttacactttggcaaatccaatcaatactcctttgtgcataatggaaaaaaacttgtgttacatcctatgtctcctgaagttattttaaaggatgaacttgctagagctagcaaacaaaaaaatcaggagcatactaggagtgagcatcttattgcggctaatgaacttgagaagcataagaagaaacccaccaactctgttcaaaataataaaaatgagattaagctgaagggatcttgtttcattgcaacaaaatcagatttggatgaagttgacactgacactgttgtttgctatgctttggtttgcaaagaaaccttattccaattgaggatactcctatttctttgcctcctccggtcactaatcttttgcaggagtatgctgatattttcccaaaggaggttccaccggggctgccaccaattcgagggattgagcaccaaattgacctcattcctggggcctctctgccaaaccgtgcgccatataggaccaacccagaggaaacaaaggagattcagcgtcaagtgcaagagttactcgacaaggggtatgtacgtgagtctcttagtccttgttctatccccgtgcttttagttcctaagaaagatggctcatggcgcatgtgtgtggattgtagagcaattaacaacatcacaatcagatatcgtcatcctatccctaggctagatgatatgcttgatgaattgagtggttcacttgtgttctctaaaattgatttgcgtagtggttaccaccagattcgcatgaagttaggagatgaatggaaaacagcttttaaaactaaattcggcctatatgagtggttagtcatgccctttggtctcactaatgcacccagtactttcataagattaatgaatgaagttttacgtgctttcattggcagatttgtggtggtatattttgatgacattctcatatatagcagatcaatagaggatcatcatggtcatttgcgtgctgtttttgatgctctacgagatgaacgtttatttggtaaccttgagaagtgcacattttgcacagatcgagtctcttttcttggctatgttgtgactccgcagggaattgaagtagatcaagccaaggttgaagccatacatagctggccggttccaacaacgatcacccaagtgagaagctttctaggacttgctgggttctaccgccgctttgtgaaggattttagcaccattgcagccccattacatgagcttaccaagagaaatgtcacattcacttgggctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaaggcaaacctatagaatatttcagcgagaaattgagtgggcctagtttgaattattctacttatgataaggaattgtttgctctagtgcgaacattggaaacatggcagcattatttatggcccaaagaatttgttatacactctgatcatgaatctttgaaacacattcgaagtcaagcaaaacttaaccgtaggcatgctaaatgggttgaatttattgaatcttttccatatgtcatcaaacataagaagggaaaagaaaatgtcattgctgatgctttgtctagacgttacgcaatgctatcccaacttgacttcaaaatttttggcttagaaacaataaaagagcaatatgcgcacgatgatgattttaaagatgtgttgttgaattgcaaggagggaaggacttggaacaaattcgttctcaccaatgggtttgtgtttagagctaataagttatgcattccagctagctccgtgcgtatgctattattgcaggaagcgcatggtggagggttgatgggacactttggtgtgaagaagacggaggatatccttgctgatcatttcttttggcctaagatgaggagagacgtggagaggttcgttgctcgctgcacaacatgccaaaaagctaagttacgccttaaccctcatggtttgtatatgcctttgcctgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcgtgagattgttcgcttgcatggagtgccaaacaccatagtttctgatcgcgatacaaaattccttagtcatttttggagaaccttgtgggctaagttggggactaaacttttattttctactacatgtcatccccaaactgatggacaaactgaggtggtgaatagaacattatctacaatgcttagggctgttttgaaaaagaatattaaaatgtgggaagaatgtttgcctcatgttgagtttgcttataatcgttcacaacattctactactaagaagtgcccttttgagattgtttatggccttctaccccgtgctccaattgatcttttgcccctcccaacttcagagagagtgaactttgatgcaaaatatcacgctgaattgatgttaaaactgcatgagaccactaaggagaacatagagcgcatgaatataaagtataaacttgctgggagcaaaggaaagaaacatgttgcttttgaacctggtgatttggtttggttgcatttgagaaaggataggttccctaatttgagaaaatctaagttgctacctagagctgatggtcctttcaaagtgctacaaaagattaatgacaatacatacaagcttgagctacctgccgattttggggttagccccacgtttaacattgcagatttaaagccatatttgggagaagaagatgagttagagtcgaggacgactcaaatgcaagaaggggaggatgatgaggacatcccttccaacgatacaaccacgcctattgcacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaagtttgacccaggctgctcagaatgacgaaaatagttctttacatcagaaacttgggcttgggccttgtatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggcagttgtagtcggaccgccaacgtcgtatccttccccaaatcaaagtttatcctcctctcatcgaacgatcaggaacccccgttgctgcatcagtttgtcgagcaggcataatagaagcagtttgtatgtgttctacttcttactctctccattctcgagaacttgcatatcgaactccattatagtctgacaaatttacttgattgtaatggaaaatgaactagtataatcagttcaaatcccgtagagaatggaaaagttcacatgtttgaagcaagtcaaatttactccgaaatttcaacgaaattccaataatccaaaatacactggtattaactactcataccctccaaaagcccaaatttgtggttaagtacaatttctaaatttctatattcaatatatctaaagaatatcactataaatgtccaaaaaaaaatattagcatcatatctacataaataaatactagggcgaaagggcctgtagcccagtggttacaacagcctcactgcctcagtagcacttgaggtcctgggttcgactccccatgggagcgaattttttaggatttaacaacgttgtgctttcagtggtaggcggcgtacccatggacagcgaggcgcctgtggtgacttcgtcaatctctccaggatttgccggcccagtcttcgaagatactcatagaggtagggtttacgtgcgtgtgttcataggggtgagtgcgcgtgcgttgtgagtgtttgtattgtactgtgcaattcttaaaaaaaatactaggataagtattctctagtttctactctctactgacagccaataaattaatttccctcaatccggtatgttggtcacagataggaaaagtatcaaagcttagtgaactagtagtagctggattcagatctctgatagtctgacaaacgacaactaattaaaattactacttttttctataatggaaatgattttaatctccgacctctaccataagacacataagatgatggggcagaccttcaactttctataaataagttcaacctaaaaatactttccaaaatcaataaattctagcacgtcactccgtaagtactacaccatctaaaataaaacaaaagactcttagctatggatgccaagagttacttcgcaaaaaaaaaaaaacaattactactaagatttggcagccaagccgtgtgacctcacctgcggacacaacacagaaaaagccaatcaatcaacggctacttgtatgtaatctccacgcattccaatggcggctgcctcccacaattcggtggtcactcgtcagtcgtgtcgtctgctcacgctcgccaagaaagattggccatggagaagccggcggcgagcgtggaggagccgctgcttgttggcgctggcgagaagaagggcgagagcgcggccgcggcggagctgaagcggctgctccggctggcggggccgctggtggcgagcggcgtgctgcggaacgtggtgcagatggtgtccgtcatgttcgtcggccacctcggcgagctccccctcgccggcgcctccctcgccacctccctcgccaacgtcaccggcttcagcctgctcgtaagcatcggtcgaacaccttgcgcgcacgcaaagaactgcttgatccctgtcgatttattggtcggatttgtgaatgctttcttggttggtcgatttcgatcgtcagttcggcatggcgagcgcgctggacacgctgtgcgggcaggcgtacggcgcgcgccagcaccacctcctcggcgtctacaagcagcgcgccatgctggtgctcgccgtggccgccgtgcccatcgcgctcgtctgggccagcgccggcgagatcctcctcctgttcggccaggacccggccatcgccgccgaggccggcgcgtacgcgcggtggctgatcccgtcgctcgtcccgttcgtgccgctggtgtgccacatccggttcctgcaggcgcagagcgccgtgctgccggtgatggcgagctgcggcgtcacggcggcgagccacgtggccgtgtgctgggcgctggtgcgcaaggccggcatgggcagcaggggcgccgcgctggcgaacgccgtctcctatggcgtcaacctcaccataatgtctctctatgtcaggctgtcgcgctcctgcgagaagacatggactggcttctccatggaggccttcagggagctccgccagtatgcggagctcgccatccccgcggcaatgatggtctggtaaggacaacatcatgtacttcattagaaattttgtagtccttgagaaagcaacgggaggtaccatgattttacgctagaaattttggtacctcaagatgcttagtatctagatgtactaaattttacactagaaaatgtggtacgacacattttcaaggatggtaaaatttgcagagatcgaaaactgcttacattgtctaaaattatatttatagcttgactaatgttggattaatttcttgattacgcagtttggagtggtggtcatttgaatttcttgtgatgctctctggtcttctgcccaatcctaaacttgaaacctcagtgttgtcgatatggtaatcaatcacaagattatgtctctgatacaaatttaataaattaacatgaatgaaacgaagtatgtttactaaattgtttgctggattctgcagtctcaacactggtgctctgctggtcatggttccaattggtctcagcacagctataaggtcttgagattctgcaataaaatgttcagatatgatactctgctattttgatccttttttctgcttagagtctggctgatttctttcttttctactgcctagcacgcgtgtttggaacgaactaggtgccggcaatccccaggcagcgaagctggcaactcgagtggtcatatgtatggccatgaccgaaggctcggtggttgcgtttacgatgattctgttgcgcaattcctggggtcacatgtacagtgatgaggctgaagttgtcacctacattgctcgtatgatacctgttctagccatatcattcttcattgatgggatgcacagcgctctttcaggtaaaaacctcctgcatggatgatgtcagtgacactgccacattataagcatgtaaatgaagttacctgatgcataagtcaggaacagaatgatcagaagatcattgtctgaatatttttcaggagtgctcactggatgtggcaagcagaagatcggcgcacgggtaaatcttggcgcattttacttggcaggcattcctatggccgtctttcttgcatttgtgctacatctgaatggaatggtactgctatttgtctgaatattccctttcgttttttaaaaaatagctgcagattcacatctagcacttcgcacatgtttcagtataaacaacatggatgtatctctgaaagactgaaaattttgtgctttcattagggcctttggcttggcatcgtttgcgggagcctcagcaagcttatcttgctcttttggatcacaatgagtataaactgggagaaggaagtaagttatctgaggatgcctaccattttatatcagggtagctaccaattttcctttcattgtaaaatgtgtcatatgctcatgtttgcaatttcatttcagtcaaccagggcgaaagaattggtgttcagttcatctcttcctgtagcatgaagaaaaacaatgcatcagaatttcatgatatggtgcaattgttattgtgaaagcaacacagaaccaaatgttatgaagctcgcctttcatctttaagcacccagtttattaacatttgtaacatgaatttttgttcttgtgataacacctatttaatattttttttcttgttcagattgtactctgtaaactaaggatatatcttatatgcatcgattaattgaaaatctaagaagcatattataggaaattaaacggttctaccagttctacataaaacggtgtgtgagctataatcactctgatcttatcttagtcgtctgttcaaaggtactagtaggtctctactagcctccaagatataccccctcattctctaaatgtttaatgccgttgacttttttaaacgtgtttgaccgttcgtcttattcaaaaacttttgtgaaatatgtaaaactatatgtatacataaaagtatatttaacaataaatcaaatgataggaaaagaattaataattacttaaattttttaaataagatgaatggtcaaactttttaaaaaagtcaacggcgtcaaacattttgggatggatggagtactaacgtttggttgcaatgtctgtgtacacgaaaattttcattgcatggactaactctgcagaaatttgcaaacaatgacgaagcattttggaaccttcgctaactttttctgaagaaatattgaaaatccataggacattctatgaaatttcgaatcatgctgaaaccttcataggagccatgagtgtaaaatattatcagagcacaaaggttgtgataagtccttgtttgtcagatttatcaacctggtgcttcatctcttctgatcgtattacactgactgattgagaagtggtcagatttgtttgaaaatttgaaacaaaaacagtggacgcaaagtgacttttgaaacattgcgtgccggatcatgtacagtacttccatgataagacggtgtatcagaaggcatgaaactacttctgtacctattacagatctgcaatgtagctgtgcattttccagttcagattttgtacaactccctctgaaaaatatagcgtgaatgttattttgaaaaagtattgagcaaacaatcaatttctgcagaacaaacattgtatgaaagccatttgaaatatgaatatgttgatgtaacttacacacactaaatatatttgtagtttaagtaattgatggtcaaatgatcttataaagttgaccttttcagaacactagcatgcactattaattggctcaacattttctttaaagcataatggtaatctttatttaacttagcctattacatcaaggtgagaatatttctgatctctgcataactaaaacacacaccgatattaattggtcaatataaaagaacactgtctgggacgacgctctacaagtgccgagcaaggccacctgagcttctcacacctccatggatgccacaggattctacaaaatgcaaattccacaaaacattctaccaagcatagcagcatacatacaaaaaacattttttaaagtgcaattacgtagcatcgatttaacttgttgtgtgctcaagtcaatgcacacatcaaaagacgcgctgtttacaggtcatacttcttgggagttgggaaattaacatgagcatttggacacatctgtcttggctatttctgcagctgtgatgatccataagcacaaataatagtcgaatacctcttcttgcaaacatttccctgcaaataaaaataaccttccatgaccaccagtaaaaaactattctcactagttattcggcacagttaaaactcaactgtaaaatcatcggtgttgcacaaagtgtaggaatccctcactcacacaaagtgaagtccaaactgtcttaaacttgctgcaccgtgtttatccaaaactctacctgttgtctgtttccttgaccatcgtcatgcctgacgtcctcttatatacacggtaataattgaagacatatgagtgttgctgacaaatacatggattgatgatactatcaccatcgaaaaggttcaagcgtattacttttcttcacccatcccgcaggtaacgaagaccacgaaactgaacccatgcaatcttcgctgcaaaataaaaaatacaatctccttatttaagtctcggaggtatggaaactataaatatgataatctcatttagaaaacaagaaaatgaaatattccaacttttggttgaaaaaagagtattatatatgagagcaattttatggtccttgaggaggtactatgaggtaccactttttctattgtaaaattggtacctcttgatacttaggtactatatgaggtaaaaaaaatagtgtaaaatttggtacctaatgatacctcctcaaggaccgtaaaattactctatatataaagcatgcacggatggggtccactatatatctcggtgacaatgagttgatggtgatgtggtttaaagtgttacatatgatcctttcacctgactttgaccatcggacaattacaattagacaataatttttttatgtaaatatgtaggagagtgtgtatatattgatataataaataatttatggagttacatatgtacaatgaagttgctttagatagttccagcatcgaagtgcattcaaactacttgctatagtgaacggcaaagctcttgccttatccctcaaaaatgatattctggtgaccggtattaacatccgaagaattcactaggtatgtgtgaataatgaaagattctcaggccccagagtcaactagctctgatgtacccatacgtcagaaccgcttactcttatgcccaccagtgatgggctgaagagctcgtcacggatggcctcacctttatgggtccattgcagcccgtaacagataggcatccggtcacggcttgtcataggtggtcacctatgcgggctgaatctgacacccgttaaagtgatacctctatcggatgctagttccagcccgtcaaaggtaaacacgtacctgtgatgggccataaagatatagcccgtcagagatggccttcactcatctcaaacgggctctagccctaactcgtttgaggtgagttgcggcctatttatacccccaacctaccaaccactttccatcccaacccagtatactgttcatttttcgggtaggagagcaagggg

SEQ ID NO: 80330 - DNA, 3897 bp, Oryza sativa
  unsure (1)..(3897): unsure at all n locations
actcatagactatcatttttgccaagtttcgtgcaatttgcatatgtggttctaatcaagagatagaatctgccatttctttgcttgtttgttgatatacctcttgtgtgtaacttgatgttgtagctaattgatggttgatgttgatgataccaagtgtgtaacttgatgttgtagctgctgttgtgatgtacctctacatgttctagagaagactccatttgtacccattgttgattattgtggaagcttggagtggaccgttggttccatggttttttactcctcacaccgaggaggttttttcacgtaaatcaccgtgtcttgtgtgcatgtgtttattgttgtttcgctgctgatttgctagttaaaactatcctcaaagttcatggaaagatgaggggttgattgtgtgaaatacgtttgtcggtttgcgaattgtagtttgcagattgaaagtgtattggttcagcccgaacaattattatactcattatttggaattttcattagttttgtcaaatattttaaattaggatatatgcagccttttgaaattaggaacttagcctatcaaatagggaacttagcctttaaataacccaaaaattcgctcctatgaagatttgacattaggacattcagtgctactcagattactgcaaccactaggctatataccctttcataatttcatcaaacataaagctttctattttgtgctatacttgagttgattaatgaattgccatccaaaacacagcttgcattgaccttgttaatttgctgcaaagtgtttttcttccaaatatccttgtcgatggtaggattcatgacgaaacaaatgagaaaggtgcatccagtgacaataattacagatgaagaattggttctttgaatagtggtcagcattctcccgtctgtctactgcatcttcaatccaagattacaaatttttatcatatctaacgttcacgtgttggtgttcagtaaggttagacatcacaacatcacaatgtgtgtgttctctgtaccttttcataaaatagagacagagaatgttattgttactcattgtactaactgtttatatttatgttgttcaatatacgagattgttaattccaaatgggcacatcgcaattatttccatggaggtgatttctattgtgaatcaataatggcacaaccaatatatactggatgttgcttccctaacagtggcaaacaaaccagacaatatggttggtgtttgacaattaatgatgacacatgctgcaccatgctgaactgatccagaagtgttaatggttataacaagaggattagataattttgaggcattagagaatgcattgagggatcttctatataacaaatcacatagatgtgacaatgctttaaatcctaactttttgccagcctaaccgaatctaccacgggctaagctacccgagtcaatcttgtccaagtgcttgtattagatttttttttcatcatgtttcattgaacttcttttgtggatatagccatactcagtgcgatgacatttaagctctcatcaatatttctgtttgtcgaatctccaaaaacgtgtcaagactatactatataaatatttaattctggtaaagattgcattgacatctcataatttatgaaaacatcttgatgtggttaagcatatgcgtacgggatggttcaacaaaactaagtgtgtgggtaagcatttgcatcaaaatgacttatagagtggaatatcaaacttcaagtgccgtatgggatgttttttgcaaattcccctagtttttaacaaaagcttttaggggtgggcctggctgtcattctctctcttctctctttctccttttcttctcttctcccgtctgcgcgcgcgcgtgcgcgcgcactctagtgtgtcggtggtcctgttctaatttgggccaggcaattgttcctagagtgggtgagaaaggtgccggagtggtggcttgccatggaatggtcggattgtgatgattgggcggtcgcgatcattatcactgtagggcatagcagcctgtccactagtgagcatgcatgcagtgctgcggtgttggccaagagcacagtggcggcgtcactgtaccatggcggctgcggcatcaatgaaaggtgtcaatgagggggacagagtggaaggcaatgagtgctcaccgggcagcagcccgctagcgcatgtgagggcggcgagcagcaaaactatggtcattgacgtatgggtcgggaaagtgttaactcactggttatccatgcgctcttgccgtggtgcgataacaaagcacgcatgggtcatcctcattcacgacgaccccctcgctccaagcgtagtgttgttggattttattacataatggtgctcggttttattacgaccatagaataatctgcaagtatacagataccattatagtctttacctaagagtattctagggtatcgtatccacagagaacatgtgtgtataatttaagaacaggattcttccaaggacaacaactaaattgtatagcatatcaataatgatgtatatagaagaacattaacacaagagcattatattagcctataaaacataatttatattttctttaaaagttaacacatgcaaaataaaaatcttgaaatataaacatacttctatattatgtaaggaggctacgtaaaataatttaatttttttcgtaactttaattgtaacctcttgtaagtcttgaatggcattttgggtattttttttaaagtatcttggcccccncccaaaacttttaaagggcccccccaattaaaatttttttggggggcagaaaaaatagataaacgcaattgtgttaagggcaaatccttgaactacagtaaactccggtgggcatagaaccaattctctcagtagtttaatgaagtggttgtcgcaaggaaccgcctacactaataactgtttagtgcaagctattctctatgagaacaatatacccaaatctttttgtcacattcattgataatacattaatactaaactttaaaatttaaaaaattgctctatgaccgattgaagcgaacaatctaaaggtttgatcaatgtttaatatggttagatcaatatttccctatataaatattttttttctaatgtttcttcgccaatatcaagttgcgacagaaggagagaccaaaagatttcaaaactgatattagttggcaaacatatcacaaatgtacctcaacatctagctagacaaagaacaaagcattgatgtgtccatttgcataaaccccggctgaacacaaaactaacacggtgtacaatcacctccttctccatgggtttcaactaaagagagcaagtggcatgttattgttgagaaaatatcatgaaattaaattgacaaaaatgagagaaagaaagggttcaaaccaatatttcgaatgaagtatatttaagaaagaatgccatggaactaagcgatttagcatcaaatgtttcgaaaatccatgtttggaagtgcgatgaaattgacatcataatagatgttgggataatacacttgctattcttagctgtgcattgaaagtacaatttaagtagcataggacacttaaaatatttagctgtgctatagaaagtatattttaattaggaaaatctgccacatccgaagtggctttaataacacatcacctaaggataagatatacgtgcatgctctgacgtgcaattaaactatatctcagcataatcttccagattctgttagagtaaaatcctcaagatatgaaagtaaataattattaaattctttcatatataacatcttctatgttctatgtatatatatgtgaaccgcagctcctgaagtg

SEQ ID NO: 80331 - DNA, 17553 bp, Oryza sativa
aaaaagcggctaattccgactctgtgtggaggcacttcttgccgaaggactacctctccatcctggctcgtgccgacgatcgtgtgcatttcacttccgagaagaagctcctcgtcagccttgtcaaagaccacgtcctcctcgaccaacacagcaaggtacgtaatagggaaaatatttctatcccttaaaaggacattctttgttttttccgttttacctaaatagctatcaaattttctttaaaaaaattatatgataggtcaatataaaatatgtcattacacggacatgtaatttcaaatttaatatatataagtacaaacaaaaataacaaatttgattgtgaataatgtgtattattcgtagtggaatttattatttccctttctatctataaatgttaaatttgaattgcatgttttttttataacttttatggtgatatgcacaaaagaggatatcccttaagttctagttcgattaattcctcccgcaaaaggattaaggagaatttggagaataattccacgcctattgaggtatgggattaatcctctgtaatccctctctcttgagattaaccgaacaaagtctaaaggatgaaaacccgcttcccacgtactcccttcgtcccgaaaaaaacaaatctaggcctgaatatgacatattatagtacaatgaatctggacagaggtatgtcaagattcgtaatattacgatgtgtcacatctagtactagattggttttctatgagacggagggagcaataacataaagctttagtatgaatttcttcaatatagtattaccaacttttgttatcgtaatgttaactgaatgaaggcgattcattatacattgcacgcagagtctttggttggaaagaacaagcctagccaagtgctacttgctatcatcgagatcattaccgatagcatgggaagaccatcccctgaaatggagatggatctccttacccgattccaggtacgcgttccaacctactgtagcaatgtacaagataaatttaacgttagctcatttgtttgtttcccttttgcaaagataggtatatatatatatatataggtaacatatctcatgcacacaaaccttcacgtgtacatatcatgcacaccaactaacaaatattactaaaaattctataaaaaaattgtacatattgaaatactttcaatagtattatacatacatgtaaagcatcatcttcaaattcattttacatatagagaaaaaaagacaataatgatataaactcgtagttttaaaactgtcagagtttttgttttctaggctaaagtatatggacatttttttctagatttttagtgacgtttgttagttggtatgcacggagtgtgcacatgaaacttgtgtgcatgtgcatgggatatattccctcatatgcaatgcacatcttttagaaatgtttgtcaaagaagtacgtagtctggacgaatatacaaaagcattaagaaataaactacaaagaaattatccatcagataatctttaaattcaatataataataactagtattcggtttgatttgattttctttttatcaatttaagcagaaaccaaagttttctccctgtttcaggtttgaagaagtaactgagcttctaaaggtctgctggctcgatttatgtggcagagtcaactgcagagagctctcacccaacacagaatatgcagcctacctcgtcttcaaattgacagatgattcgtacggccttgattgccagacacaagaggcagacatcaccatggacgatcaagtagtgtctgccaagcggaccatctctttctacccacgcccacgcccacgcccacgcccatccacacgagagacactttctaacatgggtagaatcgaagaagcaggacaagcagaggagccaagctacccaagagaacgaggtgatggctggctggaggtacaactagggcacttctacaacgacctagaagacactggagtggttgttatccgcctcaaggagcatatccagctcaactggaagaaaggacttatcttggagggtatggaaattagacacaacatataagtctttgaggaagatacagaaaaatggagcaagtatgttagaagacaaaattaaataatgcagcattgaatatgcacaaagagcagtcatgattcaaccagtgttcaaaaatcctggctgtaagcaattggttaccgctccaaagccgatgaaccaacattggcatactgaacagaacaatttaaattcaactttggaagtatgccaacttcttatctttcatggttatttgttgttatatttctaaaggaaaatgaaatattcgcattcagttctataattatatcaattgccacacttgtggtggaactattgatatgttgtatgtatacttctgtgatgcatgtctttatggactattgcatcataatcattatgttctatttgtgatgaattcaataatgctatatatgttggatcttgaatttttttcccttttcttatgccaaatttctggcaggttactgtgatttcgaaattcaaaatttcggaccgacattttgtctgataaaaaccagttatctgttttcaggggtaccaatatttaaaagagagttttttttcactaagttttcacttaatcccttctatatccctgacttatgtttcgtcccttgtgtgcctttaagtgttcatttcattaccctatgtttatgggtatgtctcggtaattgcacttcatttactgaaattatcatatcagtgaaaacatgtctataattggttaaagcaagtatgcattttgtatatctacaaggtataaaatcctttcctaccagttccatcagaagaaccatgatgaatgtccacaaccacaagcatccattgaccaaaaggtgacactagatttcacagatgcaacattgccaggatgacgctgaccacccctcaaagtaaaaaaatcaacccaatgtaacagcagattatgccaccaggtattattattacatgaaaagaacatgcagacatcttaagttggcagtagtacttgcagccaactgcaatcatcttttcactatttggcctccattcaacagctttaacatcgttttgtcggtcacttgttagaatgtaggattctttaatatttgtttgaaggattctttaatattctttaataatttttctgtttgcaaatgaagacatattattcgtaagagtggcaaataattgagtcactaagatatgataaagaaccaactcacatcgcacgaagggaagagcatttgtttgaaggactcagctatggtggaagctaaacttgttctggggacaatctcagaaggctcagcagcttcagtgatagcaggaggctcgtgggtggcaacaagagcatccgactggaaaggaatcgggctgaagaccatttccctggaaaccccaaattgaagtttcaattagaggcctaataataaaattagtcttgtgaatgaaaaaagaaagacgaaattatgcgaggcggaggaggaagggggaagatgggagtgtactgacgaggacatccccgtaggcatccttggctccatcgtcggacaccgcatccgccgcaactgcaacaaacagacttggaatgagcttggagacagcagagagagggggagcagggagtggagatagcacacctaggtcgcggttgatctcgcagatggtgacggcgccgggcggagggaagctgggcatcgtcgttgtcttgcgtcggcgagcggcggccggtgctccgcgtcgcaggacggcgggttaaacccttgactcccccagagacctgagtgcccgcaggctacagcccaaggcgacttgggccggaagcccacaagcatactgggccgatattgtatgtgatggaattggagttctgggccaaaaataggaaaaagtccacctcgattcccttaattgttcaccgaatctaattcgtgacccttaactagaaaaccgggtaagacgactcccccaattagtaaaaccggtacaaattgactcctaaggcagtattgtgggcggtatccgatgacgtggcaccttgaccgttgtcaacactactgactcaactgagtatggtgagaaatagatagctgacagtgggccatcgtgagctgagtcagattaggaccgacatgtgggctctttttttcattgaccgatggggcgactgcttgggcggcgctggggggcgcgtgcgcgtcggtagcagtggactgcggccgtccctccttctcttctcatcaagatccagtgatagcggcggcggtggagaagaccagcgcgaaggccgggtggagtggtggcggcgacggtggcgcccccctctccctctccttcctgggggccggcgttgcatgcgagaggaagagaggggtcgggcgtggcgatggcggcgacgggcgggggtgtgcgcgctggagcggaggtggtggtgtgaggggccggaacggtggcggagaggcgcggcaccatcgtcacgatccggtgatggcggcgacggtggagaaggccagcgtggaggccaggcggattagtggcaacgtgtcacgcccagaaattcccgaatagaattctaagcagaatgtgcattaaaatccctgtccaggaccggccggggtacataaacaacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacaaagcctactcctcggagaaacctccatctgacacatactcgtactctggggttgggaaaaatagagcaagactgagtactacccactgtactcagcaagtcataccggaataggggtatgatgcagggaattatcaaaggagagctagagtggttcatttgcataaagcgagcatttataaacagaagtttaaagaagaaaacagtcgtaataattaatcaatattaatcatccactgtccaacgctataccatggtgcgacaggcccaaccatccacctatactatccaatttcaatagactaaactagggtgagactaatcacggtgaatctggttgaccacccataaccgtgggcatggctattcgaatagttttactctgatcagaggtgtacaactgtacccacaagacacagccccacgacacgtttccgtgcgccgacatgccaccacgacataccgaaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgtactagttgaactaagcatggctaagcaactcctagtccaacgtctattcatgttataacccaagctaacaaaggagcaaggtaccaaaatagcatagctgtaacaataggtaaacatcccataataacattataaaacgatgcagtatttgaagaaaaaaagtagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatgcaaacaggctataatactactgaaacagagaacaaaaccatttttaatggattctacacatttttcttgatttactgagacttgaatgggcttaaacggagctcggatgaattagttatgaattttagaagattcactgtgtttattactataacaaaaagtccttaaataatttattgcgcaataatttctagggctgacgtcatcaagggggggtggcgccgacgggcggggcccactggtcagcggctcaaaggggggagaggggcgccggcaagtggggcccccgggtcagcggcccaaggctgtcggtccaccgtggaccgggaccacgcgggtgatccaccgccggtccacgggactgacggcccagatcggccccgagccgatcgggcggtggcgatagaggtggccgccgggctcggctcggcatcaaagccggccggacggccaaggctagcggcgacgacacgcggccgacggcgacggcgaccggcggcacgggaggcggcggcggcggccgaaggcgacggcgcatgacttgaagcggcggcgcggcactaggagggagagggaggggagtaaaggggagaggacgcctcaccgagggtggtcggtgcggaggaagacgacggcgaacggcgacggcgagccacgggaggacgacggcaactggcggacgggcttcggggtgccctaaggaaggaggagagagagattagagagagggagatgaaccacggcggccggcatccatggccgaaggcggcggtagaggtagaactcaccggagcgcgaggggatgcgaattccggcgacgaatcccgacggggaaggggcggaccccttctagaagtaatctagaagtaagtaataatactactatactccctccattagaaaaaaaaaactcaatccgaccccttctaggatcatgaatttggataaaggtagtccagatttattgtattaggaaagatcaaatcttcttctaggttgatttttcttttttacgaaaggagtatagcactagtgattacattagtttaatcgtcaaattaaacatatggtgatggatttagtatgatgtgtgcgcagattgcagcggcatatggagtgaatgggccatatcacggtgcatcggcgtggcttcctatatggaaagttggggtgggaccctctaaattctccaagagctacctcgccatcgccagtccaacagtcagggaatttacgccaatcccaagcaaagatccacccaacattgacaaccaaattgctctcgaaatcgccgtacatgccagttaccatttctatatatttatttttgtactccctccgtccgaaaaaaaacccaatccgtatgtccagattcaaacccaggattgggttttttttgggacggagggagtatgtgtatgttaccggccagttatcacttttatatgtatgtataccatatgtgtcacgtatataccaacgtatgttacattaatttgtatgcaggtttaccctcaatttgttggtgacgatcttcctcggctctacatatactccactgtaaagtgtctctcctacttcctccgttccacaatataagtcattctagcattttccacattcatattgatgttaatgaatctagattatattgatgttgatgaatctagattcattaacatcaatatgaatgtgggaaatgttagaataacttacattgtgaaacagagggagtaccttgtaacgaattgcatacatactgttttcattagaagtacaaaaattatttggtcacttttatttaatttgaatatatttcacagaaaattgaatgtttgaattaaataccaaaaataaatattcagttgtttcttgacatgtaggcccctatgaatctcctaattcttagtacgataattattattattattattattattattattattattattattattattattattattattattattattattattactactactactactactactactactttcctgtgatgtattaatagaaggatcacataattcttttattcaatattgcacatgatggataatcaactttcaggatcagtaggagtcctctactcctcttacctgcatatatagtggtaagatagttagatagagcactagctagatttaaaacagctagctaattttcttaaaactcatttttttttctttaagaagatgacacaaattaattaggtgcatgctagttaaagttggtgatgtcagctggtatgtacagcacagtctacagtgctctatagctactcactggtgtaattgatgcatgggatatactatatatgcagaacgatggtggcgtgaaattaaagtgcttcaaccttgagtgttctttcgtccagaccagcaaaaagcacgccattggtgctaaatacgacaagttttccacggttggtggaaccacctacttcacccacgccgtaatatatacagggtgcgtacgtcctctgtcctaaaacatactttctttctttaatgtatgacatcattgactttttttatcgtttaattatttattttatttaaaaattatgtaattatcatttattttattataacctgatttatcattaaatgctctttaagcatgacataaatatttttatatttgtacaaaaatttggaataagacaaatggttaaacgttgtttaaaaattcaacagcgtcatacattaaaatacatagggagtatataatattatcttgttgcattgtgtataaacatcactcagctgctagctagttagaaatactttttttaagtatctagaaatatacttatatattaaggatgaagaagagaatggtacgcggcacgtatatatttattgcaatgattatgggatacatatatgtaataaaaggagattgattaattatatactagtaattaatatatccatgctaacgctacgacgatatttgacaatataccttaatgcattttgaataaaattttctttataagaaaattatttgtcatattataatgtcctaaataattatatactttgatgcttatctccatatgaaacacatgtgatattatcttgttaaactgtaagtctatatatataatcccaaaaatcacaatttagaaatcacatctcaattttcaaccagcaaacataacaataaattacatgctccacacattttattcaataaaatcaaccatagaaatcacaaatgactaacacttgtgtaggaagacatagagctagcatgagtaatctatgctatatattgggaaagggatagctaggaggcttctcaatccgtatcgcaggaccattaattttgttttatcaacagaacttgttttagtattcagaaattaaattgattaattatatatgagtggattatgcaggatgatgggccggcggtgtggtgggtgtcgctgatggatgagccgatcggctacttccacgagagcgcgttcgcggcggcccttcatcgagagcttccacaacgagatgggagggcatgtgctggacaggaggccgggagggcggcacacgctcaccccgatgggcagcggcatgtacccctccgatggcctccagaacgcagcctgcatccatgcctacctcgccatcgcctacaccggcgccgaccaggtcgacgaccccgtcaacaccatcgtcacccaccccaagtgctacgacgtcaaggacgatggccccgacctctaccgccccggcatcaatgtcgccttcggtggccctggtggatacgactgtgatcacaattagtaataattaattaactacctcatctctctttcattatgtaacatgaatgaataattcatgaatgtggggtagtgtttgaaaaactaatgaaaaatcaagtgttgttttgggaagatgttcattacacagcgacaaaagaagtaaaaaatatacattatttttagagtttttgcagttatatatatgtttatgaaagaattatgaaaatatacacataccgtggtacgaggacgtgtgactaattgtttggcgcagtaggggacaaacggctaggtcaatcttcccaatcggctaccacgtgccacggcgcgggattgtcccaaccatcggtccggcaccttcgcgccacgccaaataattggtcgtacgttcacacgtaacggtacgtgtatatatttttctatttttttcaagagtatgtatataactgaaaaagccaaaaacaatgtataattttaatttcttttctctgacgtacaccaagtaatggtccatagctagcaatagctatgtattgtgcatacatatagacaagtattttttttaaaaaaattaaataactatagtggtatgtgagaaatgaggaatatttcctcgaatgaaacagttttcaacgtttcttatccatcgagagacaaggaagaagtgttgaacccgtggcgtcggctccccgctcccccaactcgcgcggttgctggttgctgccgccatcgcttcctcccattctcttctccacgacggggttaccgagctccggcgaacccgccatggcggactggccgacggcagagccgaggcgaatcagcggcagacaggagaacctccccaatacgctctccttttccagtttccccaactctagctagaagccaatcagaagcgccagccaggggaaagcggggagtcgtcgatccctctcgtcgccgttgctctcgtcggcatcacctgacattattgtgcatgagcattcgacgacctaacacccggtatagtttgcttcctccacctcgagcacaagctgttcgatgaaatgcctaccaaggttaaggttctgtcaccttttttttttgaattcattgaatatagaagggaacaatatttacaagtaaggagtaatgggatttacagaaaagacgatcggaactacggcaacatctctgctagtcgtttggctcccgccaaagcccaagatttcgactcctggttctgtcactttcttgttccaaaactgatgagcatcctgcgttcctttgctattttgcacaaccttgtggaacaataataaaagaaaataattagtcttccatatttggttgtagttctatagatgacaagttaaagttagttcatctttttggtatattacacataagaatccttcgaattcgtttgttgcagattgataagtcgacattgattcacatatccatttttgcatgctgatggtgttttctgtgctctaagtaaggtccggatctgaatataaaactgaatggcatctgtagtgtttggtcaaaggaatgtgtgtgtctttcccctgaggaggcacatattggatgaggtgtttcagcatggtccttgtaattgtagcacacagaggaggtggaaaaagccaattgattcagcaagaactcgtctggagggcagaataagggatcataaactggacaagctgatgattcaactgaagaacctgaggctagctttggatttgcatgagttcatatctcagcagaggaatggctacgcatctctccaactcctctccaggtggagacatgaagtcgggctaaacattgagattggggctttccttaagaaatatccccacatcttcgacatttatgtgcacccaataaagaataaccaatgctgtaaggtcactccaaagatggctgatttgattgcagaagaagatgctgccatctgggaaaatgagcctgctattgttaaacggctgaagaaactcctcatgctgtcgacagatggaactctgaatatgcatgcactgtggctcataagaagagaacttgggttgcccaatgactaaaggtgctctatactaccaaaccatcggtcagagttttctctaggttcccccgatactctgacatttgtcactagggatgaaaatttagctgtagccgatgttgaagaatggagagtgaaggaatatacagaaaaatggttagctgaatctgagacaaaatattcttttcctataaactttccaaccggctttaagattgagaaaggttttagggaaaagcttggtaactggcagaggcttccctacaccaaggcttatgagaataatgaattgcatccaatccataatgttgagcagctcgagaaacatattgttggcattcttcacgaacttttaagcttgacagtggaaaagatgataccacttgagaggttctcccatttcagaagaccttttgatatggaggtaaacctgagggaacttattcttaagcaccctggcattttctacatctcaaccaaaggaagcacacaaactgtcctccttagagagagttacagtaagggatgcttggttgatcctaaccctgtctacaatgtaagaaggaaaatgctagatcttattttgtcaggatgccatgggattgatgaaacggatggtccaattcagttagttgaggagcacaatcaagaaagcagtaatgtgtcatagaatcacatgtggcagacagattccggatgccttgtcggaagctcaaagtgacatttatcaaagaattagctattttaatctctgacattgtttatgggcttatgggagtacaatgttgataatggtatgaacttgagacgtcggtggtggagcatcatcggttgaggaatgtactgatgtgcaagctaagaaagtcagctgtcctgagggcctactctgcacccagggaagaatggatgcatcacggtgcttagcagctaacaaaggaagatgcgcttgagcagaatcagttgtcaaccttggttcctgttcgacagatctactattatttttacggtactccactgatttattttcactgaagagataggtccaatgaagatttaagggcagtcattgatgctttgaactggtctatcataaatgttgaaacagaactcacgagtgttcaactagtgtattgctctcgatcccccttcagagggtaacatttacatatttatactagattacatgcaaaggaaattacaaccctacccctatctctgtagctaccctgaggtggctgacaagtgggcctgccaacggtctgggagtccattcgccggacagggagacaacggcgcccattaaggggggcggtatggcgccatcatgatgctagcctttacccgggtaatagcgggcttcgggtaaagactagcatcggccttcacatcgccagtcgtgccatgacgtcggtggtggttggaggatgagtaatgcgcttttatggcgccccatactcgttcctggtgtcttccctaggctctggcctcggagccatgtcaagagctctggagcccttgagctggctcatgggcctctggggcccccgaaccggcgccggggcctccggtggcccatggctgggctccgggatcctccgggccttccggttagcttcaaacttcccggagccaactgccctcttcgggctcggccggcttcctaggccatcggaatgggtcctccctacggagacgggctccgcagggtgctggcggcgggcctccgggcggaggccctatctcctccggagccaccagggagtgaatggcgcaagatcgcaatccttcccccaacaataaaaacacttatcatttcttaagtggaatttttttaagaacaggagctgtgcatagtgcaagacctgtcaagctaactggaatatagaagagacgacagcagccaacagaggtcagaagctattgcacccaattatcatcatcctcaaatcaattgaaaacttgctgaatgaaaggtgctgttgataaggagtgcaacaatttcttccatacataaatctctatttagctgtgttgtctataaatttgttgaccaatgaataatattttagtaatagttataatgcagttgtttggaatatgatactatgattcttcagaagtgaatcacttttctagcatccatatttctacatgcatccttaccaagagtcacctggactttggacttactttccataacttgcatcacactaagttacagtgtttgttccaagctataatataatcgtagtattgtttgtccccgtatggacggacctggacctggacctgaagcatccacagaagcatagcccaagatgagagatgattgggatagttctctggacagtgatgtggcatcagaagttcagaactctcaagttcatgtccctgttcaacagcgacttccctgactttgatccatctatttccttgaccattccagcaagtcaaatgaagagataagagtcatcctgaagaaacgtcattcggctgtaactatatgcatgagggacctaccgattgatcaattgtttcaagcactgccgaatgtttcttgggcaaatactacggacacttgttttggcaatatattcaaggcaaatgtcatttctcatagaaaagtccaattagaagtgctcctctgcagcataacaatttttaaaaattcaaaatcggcagataagtattccaaaatgtcacaccagttgcactgtgaaattatgactaaagaccagttctttatcatgcaacaaactagtagtcaggctatgctcatccaaactctaaagctcagaccatctctccaagactgcaacaatggatgctccatttcttactacttcccttgctgttctggccatcctctttttgcttgctctaccatggagtgctgcaactcatgatattctaccactgaaatcctctctatttgttgaagagtatgaaaccaacatcctgcagtcatctgatggcacattctcatgtggcttctacaacatcactaaagcctacaacatcactagcgccttcaccttctcaatttggtactccaattcagctgacaaggccatcgtatggagcgcaaaccgtggccgtcccgtgcactcaaggagatcagagatcactctgcgcaaggatggaaacatagtcctcactgactatgacggcacagtcgtgtggcaaactgacggtaaattccctaatgttcgatatgttcaattattgaacactggtaaccttgtcttgaaaaactccagtgaaaacattgtttggcaaagtttcgattcaccgacagacactttgcttcctactcaacgcattctcgctacaacaaagttagtctctaccactgggttacaggttcctggtcactattccttccgtttcagcgatcagtagatattgtcacttatatatgatgacgctaatgtttccggtgtatactggccagatcctgattacctgtactatgagaataataggaacctttataacagtacaaggataggtagtcttgatgattatggagaatttttttcgagtgatcttgctaagcatcaagcccgtgttgcctctgatagaagtttggggattaaaaggaggcttaccttggattatgatggtaatcttagactctatagcttgaataactcagatggaacatggacaatttcatggattgctcaacctcaaacatgcatgactcatggtttgtgtggtccatatggaatctgccactattcacctacaccaagatgttcatgcccacctggttataagatgaggaatccgggtaactggacacaaggttgcaagcctattgtcgaaattgcatgcgatggtaaacagaatgtaacatttttgcaacttcgaaacactgatttttggggttctgatcaacaacatattgaaaaggtaccctgggaggtgtgttggaacacttgcataagtgattgcacatgtaaggaatttcagtaccaagaaggaaatggtacatgctatccaaaatcttttctctttaatggaaggactttcccgacaccttttgtgcgaacgatgtatatcaaacttccttcaagtttggatgtttctaaaaaacccattccacagtctagtatacatgattatacaccaagtagacttgactgtgatcgtgtaaacacaataaccacagaggcagttcgtaacatgaataagattggtggggaggaaccaaaatggttctacttctatgggtttatcggtgtgtttttcattgttgaggttttcttcttcgcatttgcatggttccttgtcttgaggaaggagatgtggtcatctgaagtatgggcagctgaggaaggctacagggtgatgactagtcattttcgaatgtatagttatagagagctggttaaggcaactgaaaggtttaaacatgagcttggatggggaggttcaggagtcgtctataagggaatattggatgacgatcgagcagtggtcataaaaaagttggaaaatgtcacgcgaaatagggaggagtttcaggatgagttgcatgttatttcaagaatcaaccatatgaacctagtaagaatttattgtttttgctcagaaagattccataggttgctggtcttagagtatgttgagaatggatcattggctaatgtactgttcaacagtaaaatcttgttagattggaagcaaaggtttaatattgctttaggcgttgcaaagggactggcttatttcaccatgagtgcctagagtgggtcattcactgcaacctaaagccagagaacattttgtggatgagaacttagaacctaagatcgctgactttgggttggcacagctgcttagtagatctggctctaagcagaatgtttcacgagcacgagggaccataggttacattgctccagaatggatatctggtttaccaataacagcaaaggttgatgtatatagttatggagtcgttcttcttgagctagtgtcaggaaaacgagtctttgatctgatcataggagaggataagacgaaggtgcatgagatgctcaagaagtttattaagatgatttgttatagattggacaatgagaaatcattgtggttagcagagttcgtagatttcagagtgggtgatgaattcaactacttgcaagcaaaaactttggtaaagttggctgtgtcctgcttggaagaagataggaagaaaaggccaacaatggaatcaatagtcgagagcctcctttcagttgatttagctagaagttaataaaataataatgtaccaagggagaatatttataatatggagtcccttagtggtatgttattgctaggactatactaattctagaagtcttcatttcctaggatcaccgtaatgtatataaagttctatataattgtgtgtcttacttatatcttgtaaatttttcatgttatttagtaatggtctaatggaatggtggtggtatatttttctagttttttttatattggcaaagtaatgcacattttgaggttgcagttttctgaattgacctttgatcaaatttctgctcagtaaatttagttggatcatgttagtctattttccttgatatgcatatcccataacattatctattttaatcacatatacaattt

SEQ ID NO: 80332 - DNA, 14464 bp, Oryza sativa
  unsure (1)..(14464): unsure at all n locations
aaataatgggatggtacatgcatcgagtttgttatccgagtaaatgcgagaagactaattagcgcgtacgcgcgagatgagttactggcgcgcacggacatgtgtcgttagtgtaacgcacgagcggtgctatggaaaaaaccgatacaaaaaaaagcgattagcatttggactagcttggttagttctggatttgttttcttttcccggataattaggcataatcaatgttgttttttttgtaacttttcaaatataatttaagtctttcgattacccaaagttagaaacttcatattccaaattgaaaactttcaacactaatttgaaactttcaactcatatttgcaaactttcaagttaagatttgaaaacttttaactaaaatttaaaaactttcaacttaaatttcaattatttaaaaaaaatcaacttaaaatttaaaactttcaactcggatttttaaactttcaagtcaaaattttaaaactttcaactcaaatttgaaaattttcaacttaaatttaaaaactttcaacttaaaccatgaattctttattcatatttgaaattttggtgtatccatataatatgatgatcaattaggaacggagggagtacatgcctatacatcatataaaccttatagtttttgcctacaagttttgcccatggtactgttttactatactactgttcagccaacagaaagtcagcgtgtctacttcgtatgatctgccacgcgtcaacgatccgtcccctcttgtgtgatctgccacgcgtcaactatccgtcccctcttgtctgatctgccacgcgttaacgatccgtctcctcttctgcttctaccctcccatgaaggcgcgattagtttctcctttggtttccctgtcgatcccctaccgcgctacctattcttgttcgccgccgcctgctagggttcctgcttcgacgcggccaacgccactgacgtgcaccgccattcttgaccgccgcggctggccgggtgagcttcttctacgcccccggtgaccatctagcgtcgttcctccggcatctgttcagcacctccactaccctcgaccttgcggggctggatccggagtcgcctgccttctttctaggctttcatggccagccgtcgctgtctccgtgcagggccagtgatcaccatcgttgcttcccatcgtgctaggtgcggatgccggtgtcttcttgcgggtcacagtgttaactgtagccgttgttttatctcctccctgcattcctcgcaggcttggttttgcaagatttatggtgcatcgaccgcccataagcacgtggtaaccaaaacgtgaaaattcacgtgggtgttcctgctgattggattcctcaaattaattgttcagttctccttgcaatcctttttctcacttctctttttcatatcaactttgcatgactagcggcagcctgtactttatttttctatttttctatggtgttggtaaatcaagtctaaagatatgaggtaaatcaagtctaaagatatgaggttacatatgttttacctacaatatgcttatgaactttcaatgttagaatgacatattttgttgatacctgcagttatttttttaagcacaaacactaagatcacatatgtatgttctgtttgttgattaccttttcctcagatacacatgctccagttggaatgtgcatagccattatgtcttgctttacatgttaattaattaactgatttagtgaatgtttactacagtgattggtccgtatcacaaagtacaatggacaagtgtgactgaaggtaattcactagccttttatgtatatttatagttataaaaatgtctgcagtgtgcatcagacaagcaaagagtatatatgggcggcgatggcacattcctatggaagggatttatgagtccaatgtcaaaatcctctctatcagtccatataatagcaattgcctaccatttatatgtatgtcaccccatcagagttatattcacgtgttcttatattctaaatccatatgttgttgagatgtgttcttcaatcgatatctatgcagagtgtcctatcataacattaacaatgttagaccatattttggcccttttcatagaaacctaccaaaatagcacttagactgacttggcaacaaagaagttacttggtcagatatatttttatgtttgagcttacttccatagtttccatctatgcagcgctcaaatttattcacccgtgttgccattcgcttaataaaccctattgttttgtcctataaactttccccacgttagatgtctacctcggctgccacgccgttgcctgatttcgcaccgtcgtagttgctcctagggttcaggttgagtttgtgccatcctttatgcctttatttttcacagtgatttaatttgtgtttattttctatcacttaatctctgctaaatgtgatctgcaagtattgattggctggtgagtttgcagtgcaagactcgtggctttgttttggttgacgaaggtagtttgatctaactataacttttagttttactttattttacttctatccatacagtctcgtagcctcatgctttcaactttctgatgctatagtacaggtgctacattcagctgtgctcttatgaattgataaataggtttattccactgaagaaacacttctggtagatatgttgtgccaaaacagcacttagattggattgacaggaaaaaatgcttgctcagatgtccttctattttgtgcttacttttatggttcacatatatgcggtcttaaaatttattcagctatgttgccagtgctttctacctatagaattgaacttctttggtttacctccaaggtaagtactatctacatataaaagtaaaaataatagttatagattcagtatgcagacatttttgttctccacaacattcttatgcatagaaagcaagtccatctgtttgcatgggtctagcaaatggtgtgggattgctatttcagtttctttttgattaatcggggcaacaacatcaaattaaaaaaacatgtgcatcttcctcctttcagtagcggagccaggatttcaaagttgggtattcccgtctaagcgctgaggcgctggccctgcccctcgtggccaccggccacccaaccggcctgaccgcccgagattggcggagtggcgggcgtcggccaccgctcgccacggcaatggcctccccctccgcgatagcacggtccagctcccgctgccggttgccgcctcgccgcgccgccgcctagggtttggaaatggggagcggcgcgaggggagccgagccagggagggatgggtcacggagagagagcaagagggggccgtctagaagggtggtggataagtgggtcaactgatgtctgatgggtcatgacggaatgggtcgggttggtggaggcgtcgcaagaggccggttgggctgtgtttggattgaagaattgaggatttaggtgcactaatatgtgtacatgtgtatatactagaagtatacttgttttgtgataaaaaaagttgggtattcctgggaatacccaggaataatggtagctccgcccctgcctcctttatgcagctgaagtgatgcttcttatacccaggttatgttcagaacacagccatatgtgcagtttagtcgacttgctttccacctctctatatggaaacatgcatatctatgtgttaggattaattccactgcttgtgcaatccagttcaaacactgaaggtttattctacttatcttttgcaccttaatttcactcatgagcaaactgtcttggtctctgcagctgcatgggaggtgaaacgcaggaattcggcaagaatgacatgctgcaatttcgtggtctcttcaagcacgtgtactaattatccttacattctgttgctaaactactgatatcttcatactagaaatatgaaattattttgtttgtcacatcaaggcttcgtagcagccaactgcatgtactatttcttttgaactaaaatagagtgatagaagcccaatgaggtactactgaactgctagcagcatctatcttattctccttatagctcaaaatgtattgcatagttatcagtcaaatgaaacatgactccactatctaacttattgttctatttctaccagattatgtagttctgcaacattcagcgactgtaatggcatatattttttttatggcatctcaaatttatgtcccgggtttttctgcgcacaatatttttccctttttggtaatttacataactactccctccttccctaaatgtttgacaccgttgacttttttaaacatgtttgaccgttcgttttattcaaaaacttttgtaatatgtgtaaacctatatgtatacataaaagtatatttaacaataaatcaaatgatagaaaaagaattaacaattacttaaatttttttaataagacgaacggtcaaacatttttaaaaaagtcaacggcgtcaaacattttgggatggaggtagtataatctttaggtgtaaattagaacatatcatagatactaatataatttaggtgtgaattactgatattataacatatatactaatctataggtataaagagaaaaactaaaatagatactaatctttacatatgaattaacacttgaactgctttcagaggacccagcaaagtggcatgacatggcttgcatgtaacatagctgtaccttgcaatattcttaggtattttctttggctctgtgttgactggaagtgaaactgtaatgtttgacataatcaagcactgctttgaggaactacaggagagattaatactttctttgctccaatacccaccattatgagtttatttttgttcttttcttaaactgcagcggttcagaaaggaaattttaatggttagggcaccaacaattgaagctgtaattccctgttccaagttaattcatgattctggagaccttaagtatcatggaatgtaagagttttatctttgattcttttccatgttacctctgtgcttgatattaggcactttgatgcccattaaaaaaaatatatcctttcatatatatcttgcctttttgtcatgtaaaatgagttcccttcatatcatctctgggacttgtgaagtcagttatacatataaaataaattaatcaagtttagcatgtttgcccatctatgtgatgtttgcacatttgattggataagtggttgcaaataaaattgaatataacatctatgtccatatatggctatgttcgcacccgcggcaacgcgcggggtaccgtctagttacaatgaaatctacatataaaaaataagatttagtttatttctagtctagtttttttatgatgtattggattttttacatttctttagagataatattttataacacttagataatttattgttttataaatagattagtttatcgtgcccctatttataaaatcctacatccgccactgactcatatatgttaaacttgatttacactatataatatatcacaaatagatatttttgaagtgcaaaatcactttctaatatgcacttgtttgtactacctaccctactgtgatgaatataggagtatagggctacgttgtaagcactgcccatgcactggaccagcggtgtgtcggtgtggacagcgtggggtcagcgctttctgatatgcaccttgtttgtactacctaccctactgtgattaatataggagtatagggctacgctgtaagcattgcccatgcactggaccggcggtgtgtgggtatggacagcatggggtcagcgcggacggaggcggtggtgacgatgtcttcccggatgtggaggtggcgacagctgagtggaggcgggcaacggatcggggatctacagtaccggcggcgggataacacgacggcagcgacgtgacagtcggcggtggaagagggcaaggggtgggaggggcgattgacagagggaggattgtgcagcggagaggaggagaccagtggtgaatcggggtgagggagtcgattgtgaggagggcgacgggatttgggggccgcgggttgttactgatgtaatagctaattaaagcaggactttgattcctccgaatgttattgtttccgaatgttattgttgcattgatttaattctttccatagcatcgtacgggcaatttgctagcatataataaaatttgactcgttaagtgctattctacaaacacttttaattcgctaaatgacactttaataaattaaatcgaccatcgattttcaaccatttagacagtaatatctattttgtaaaaaaaaaaccggaaaccccatcccgaactttccttgcattacttcatctgttttattatcttcatgacaaattaaaattatttttatgggcaaaaaacccataaatagacctctatctactatgtctagcggctctccctatgtcattttaagaatgttttctaactcactacgtggtgatactgaattagataaaatactagaaaatctaagaaaaacaaagtattcgactatcagtttcttattttaggtcgttagttatttcctttaataaaagaaaacaacccaaacatctctccctccctccgcccgtgtatgatgttaaagtccatttaacatcttatatatgcttctaagccactacataacattattaaattagagaagaatctggtaagttcttaataaaaacatccacaaaattgtgacttaaatcgatggacacattattttaggttggtatatctatttttttccaaaaaaaaaatcccaaacctcccctccctctacccccatgcagtgctaaaagtccattaaacatcgtatgctaaaagtccattaaacatcgtataaacgcttctaatccgctacatgatgttcttaattatggacaaaaacaaaacatccaacaatcagttttgactcaaattgatggacacattattttaaatcaattgagacattattttaggtcgttagatctatttttttttaaaaaaaaaatcctaaacctccttccctcacttcctcctccgtgcagcatgcggttttaaaagttcattatacattctataaacgctatgttacgttgttctcttaaatcagacgaaatcctaaaaatgatgataggaaaacaaaacatattatcattggttttaacttaaacatccaacccattattttaggtcattagattaatcattcagaaaaacatcccaaacctccctccctccctgattgcccgtgtgcagcgtgcacagttccttttctctttcttttttttatctccctgacaattaaaattaaaattaaggtagatccaaacaacaggctaatctagcacacagtgtttcttttttgttttctaagagaagtctagcagtactatttgatggcatcagagatctgtgattcttcaatcaaactctcagagcaagtacattcttatgtttcaaggctgagagaccccaagttggtagctttagcttttaggccctgttctttcatgattctggattctaggtttttgtttgcatgcttccaagctcttagatggtttgtttcgtgcaaaatttttataatataatttttattgtaatacttttctaaagcatcttttcaactttgttgtagttaatttattcgtttatcccttaaatagatatcataaaaaaaatagattatccatcaatccaacgtgtttagctatctcaatcatggccttagcgctagctaacagtgcggctacaagaattcatatatagtcgagcaaatttgcaacctaggaagagtttgtaccagtacatgcatttctgatttctgtatatactataaaaatacccgtgcgttgcaacgaaaaactaaaattataacaaatataaaaatattagatgattaaggtttagttttacatattgaaataaaaaaagttcaactgaagggacctaaagtgaacttattccgtgcggagtgtacatgcggtccatgaggtggcccaatagtgcgggcggcctgggaacaattcggggacaacttgagcgacataaagtaaacttatttgtgcggagcgtacatgtggcccaatagtgtgggcggcctgggaacggcgcccggcccgacgcgggagaagccgtagccatccgatctgatggacggtcctgattgatcccgatctatacaaatactcagcagcccaaaccctaaccctaaaaccatttcctcttccccatctctctctcactcaaaacaacgtcggcggcagagcctcttcccaacctttctcccaccagcgccggcgttcccccttccccttccttcaccggtgaccggcgccaccgttccatcttcccctctttctcctgtctcaccggcacggcgcggcgactgggaggggacccaccagcagcgccgtttcccttggccactccccccttccttcaccggcggcgctcttctttcggcacgaatccggcggcggcggcggctccctcaaccccttgtcacctccctcccgcggtatatccgncgncggtgncggtgncggtgncggcgtcgncggnagaaggtggatccgccagtgcggcgggtggctccctccgccccctctcgcctccctcntgcggcagatctagcggcggtggcggcctcgcggcggccatgggtggatccagtggtggtggcggctgcggaggacagatccggcgacagcggcggcggctccctctgccccctctcgcttccctccctcggctgaaacgacggtggtggcgggcgtcggcagcgcagctcggcaagccactgccggcggccactccgcgccccttcaccggttttggccatgggaggcggtggcagcagaggcggctatggaaaaatctgctcgatttctgttcgatttgttttttttatctccgtttgctgttcttctattcttatatttgggatctaacataaactggattaaaactttgtgtgttatttgatgcgcactctggatgatttgttgtttgttggacttatgatgttgcggacgaaatttttttaattaggttaggtatatatttgggagggagctatcggggtgggaatcggacataaaatttgggtgctacggatgcgatcgatctgagaaaaaatattgggagcgatctggaggcggagtaaaaaaaaccgtgcgccattgggaagttgaaaaaaagaccatgcgaaaaaaaaccctagcgctatttccatttgggggtgacttatgaaatttttcggcaaaaacaccttgaatttttatctatactaatataaaaagaaggagttcaccactccaatccaggagttcaccactccgatcctataggccaaatcaactatactccatccccagcgtcccacggccctcccacggtcccaccttcccaccatcgccttgcccacactggggataccatgactcggatacagaaacaaaatctgtcccacctcccaccatcgccttgcccacactgtggataccatgactcgaatacataaacaaaatcgcatgatttcctcccaacctccacgagaaaaagtacaatatgccactccattcggtgggtttagataaaatgctatccaatacattgtaaaggataaaataccactcaataggttacttttaggatattttgccactttgagagaatttaagaccaaaatacccctggccgtggatagagaggaagagggaggagcggaaggttgacccggacgacgctaatgctccccggcggcgggtggcgagcgcaccggggtgggctgcgacaggtggacaaggggaggaagacngcggccgaaagggaggaagaccacgactgtgatgggggaggaagacggcggcggcgatcggggagaagggcaacgccgacgggagggaggaggaggcgacgacgatgacgtggagggctctgcagcgctgcccgcgcatgcgctcaccccctccggtgccacccctgtgcgcttatcggcgtcttctttctctcctcgtcgctgctagcgggagcacggacggtgctcgttcttccctcgtcgctgcccgccgccgacgaccacggccgctgccgttcgactcctctctccggctctctctcccttcctctctctctctccaaagtaggggcatatttgtcttaaacctcctcaaagtggtaaaatatcctaaagataacctattgagtggcattttatcctttgcaatatattgggtggcattttgtcgaaacccaccatatggagtggcatgctgtcctttttctccaacctccaccacacaattttctccgccttcatcgccggagtcttttacccctgtgccattaagaaagttagaggttacgtgtgtgccacaaaaaagttttgagtcacctgtatactatgacacaaactttcgtttacctatgcgccactttggatggaatcagcactaacggagactaatggaggtttaaaggtttattttgcccttgctctatttcagccactttgaatgaaacattgaacatttgaaagagaaatcggctcacacaccgcataaaggctgaaatgtaggttgaaggaaaatgaaataaagtaaacattctaaaaaattgaaaataaagttaaaacaagaaataaatatggaaaaattagtaaataattttaaaattatggaaataaatagaaaactgggaataaataagaaaaaaattcgtaaataaattttaaaaaatcataaataaatatgaacatatgaaaaaataaggaaaattcgtaaaaagataaggaaaaaaaatgcgtgcataagtaagaaaatgcaaaaaaaaaaagaaaaagcagaaataatacttggttataggatcaacattcaagcaacagctagcattacagaatcacacccaaactgaacaaactctgaactctgcaacaatatgtagcagcaagaaagcaataaatgcaacaagctgttcgtcctcacagctgcttcagtccgtcggcgaagcatgagctgaaccgcgccatgtcggactccggcagcgccacgccgatctagatgccgaccctgccgtcgcgcgcctccgccatggacaccgtgccgggcgtcttgtcgatggacaggagctccaccttcatcggccggcccagcccgaagtcggtgtcgtacacggcgtaccgcgcgagccggcgatggacatcggccggtgcggcatcagcgacacgatcttctggaaccacccatcggcaccgtccagaacgccgttgtcgagccccctgatggcggcgccgatgcccgccgccgccgtcaccacgccgccggcgccgagcaggccggccatgtcaagcaagggcggaggcagttgccgaggtactcctgcggcaccgagccggcctgggggagccgggttaggcgcgccgccggatctggcgaggtgacgcgagactaggcgaggcagcggcggcggcgtgccggcgccggcgacgaccggcggcggctataaaggcggcggctaggctagggtgaaattgctcgggagaggagcagagatgaaaatgcttcaggggcaatttagtcattttcatacgtgggtcccacatgtcagagcttattatctaacaaaagatggatggaatggcagataggtaaacgaaagtttgtgtcatggtatataggtgactcaaaatttttttttggcatataggtaaccttcaactttcttaatggcatggaggtaaaatactctcgtcgccgcctcttccccttccgcgcggtgcctccatccaccgctgccgcatcggctcctgcctcctgtcgccgcttccgctgctcctgtcgtcaccgatgccgctcccgtcttcgccgacgacgccggtgactccctccaccgccccgcctccgtgccgctcgccaccacaattggacctgctggtccagggttccgttggcgccacagccccgtcgccgaccggtggtccagccttccgccagcgccactgctccgtcgttctccggtggtccagctttccgtcgcgcctccggtcttgccgccgttacgaggggcatagtctgccgtaggtacttccagccgtgcgtcaaaatttcttctgctggtgagatcgagtgagaccccattgactcaaattgactcttctgaatccccattagtcttctgtgtggattcttattcagctgaagggtatgcacatatattaaatctctcctcttaatggtgtgattcggttcttatcaatccatatgtgcatcattgcaggctatatcctatcaaggtgactggtgttgctccattcagactaacattgtagacttgtagttgccatgctgcgtctcttccagattactttatagagaaattatattgtacaggtttgagaattgttcaagtgatactgcattccaccatttgatttctttagctagggatactataaaattgtcgtaatacaagcttatacggatatgctggggatgggtgaacaggatggaaggcattttttataggcccttgtcagatgatggcttttggctttaagatgctctatgagaagggtcaaggagattttgttctgttatttatcattgattggcatttggttgatatatatgaattaatatactccataggcacaacaaaaaggtaatattcatatatgcaggattatttctttgctttaagtttttactaatttttactatggttattggtcactggtcagataaggtacatacatatatttgcgtagtataaacatattaaagaaactcagcttagtgtatgcaagggggcatggaacaactctgattctgaataggaataacttcttcctttttctgggctaggaatttgagtgtttactttttcattaacaagccttatgtgctcctagctagcagctgccggtgaattgataaaattttggtgattttgtcctaacgcttcaaattttgttttgggtagatccaaggacaaatatattctccaaacagatgaacttttattaaagaaaaataagatattttattttgaggcacaagtatgtgctatagccccaacctctacccaggggcacacgaccaaaacacattccatgatgctccagaagtctagcactgctacaacatgcataatttcatctttatattggcattgatccgggattatcctagccattgtcacatgctgctaagaggcggtccttttttccttctttgtgagaggaggcaaccttcatataagcctggtggcatctctgaccacatgcttggaggatggaattaggcaatgtgatgcacatgacttcaatgaagcgagttaatcggggttgtagatttggaggatggcatcagggaaggtgatgcacatgacttaagtggagcaagttaatcacgattgcaggtttgaaggacgccattacttacacataattccctgtcagaataatatttgacattcatatgcttgtacacatatgaaatcccaaaattatctacctgaatgttcttgtttgccacatgcataccacaacactattgactatttgtgaattatctgaaatttgcattttacttatgtatgctgatggttctctctgctcaatctcaattcaaagagttacatgtcattttccttataatctactgttaagttcctattgaatttatattcgctgaactctacccaaccatgtttgctgttgctccaaccaaaattaggaggctttatagtctttgtgtgccatacaactttatatgtgaatttgaatttagttttacatggtctgaacttgggcttgcattgctcaagaacttggttgacaacattctgaaattgtccttgcattatatggcatcctgtgtagtgtaattaatgtattgtttctattcttccctgtgaactattggttatgtactgagttaataattcctgacagcctttagaaatgtggaacactttccttttttttgttacaaatttcctaggagcaaaaaaatttccaatcacatctcatgttgtgtcctccaaaaaaacaaaaaaaaatgctgtaattttctgtcatgctgatgacaaattctttatatatacctcaaacatgctattcattttctatatttggagtctttgtccttgcaatatgtgtgaaccatagatgtctaacatttgccagattagtgattgaacatttcatatattattttctgagcatttggcatattagtttctgacttgtccttatgatgtaggagcatctgaatttagaatctgaacttcgacaagcatctaaatattgttcaatgttttaatttgctgtgagctaattaaagttatgaatttctcatagctcaagtacctta

SEQ ID NO: 80333 - DNA, 24300 bp, Oryza sativa
cgctgcaggccgccgacgcgcgccgccggcgctgcggcgcggccgatgaccacgccggagttgtgcaggtactgatcgattctgctgggagcgcgccacagctcggcgtcgcggacgggagcaagctcatcgacctcgcctccgtcgacgtgcgcctcccggcgcttgtgtacgtgtgccgcgagaagcgccgcggccgcgcacaccaccggaaggccggcgccatgaacgcgctgctgcgcgcatccgccgtgctctcgaacgcgcccttcatcctcaacctcgactgcgaccactatgtcaacaactcgcaggccctccgcgccggcatttgcttcatgatcgaacgccgcggcggcggcgccgaagacgccggcgatgtcgcgttcgtccagttcccgcagcggttcgacggcgtcgatcccggcgaccgctacgccaaccacaaccgcgtcttcttcgactgtaccgagcttggcctcgacggcctccagggccccatctacgtcggcaccggctgcttgttccgccgcgtcgcgctctacggcgtcgacccaccgcgctggagatcgcccggcggcggtgtcgccgcggaccctgccaagttcggcgagtcggcgccgttcctagcctccgttcgggcggagcagagtcacagtcgcgacgacggcgacgccattgccgaggcgagtgcgctcgtgtcgtgcgcgtacgaggacgggacggcgtggggcagggacgtcggctgggtgtacggcaccgtgacggaggacgtggccacgggcttctgcatgcaccggcgagggtggcgctccgcctactacgccgccgcgcccgacgcgttccgcggcacggcgccgatcaacctcgccgaccgcctccaccaggtgctccgctgggcggcgggctccctcgagatcttcttctcccgcaacaacgcactcctcgccggcggccgccgccgcctccacccgctgcagcgcgccgcctacctcaacacgacggtgtacccgttcacgtcgctcttcctcatggcctactgcctcttcccggcgatcccgctcatcgccggcggcggcggctggaacgccgcgccgacaccgacgtacgtcgcgttcctggcggcgctgatggtgacgctcgcggcggtggccgtgctggagacgaggtggtcggggatcgcgctgggtgagtggtggcggaacgagcagttctggatggtgtccgcgacgagcgcgtacctcgccgcggtggcgcaggtggcgctcaaggtcgcgacggggaaggaaatatcgttcaagctgacctcgaagcatctcgcgtcgtcggcgacgccggtcgccggtaaggataggcagtacgcggagctgtacgccgtgaggtggacggcgctgatggcgccgacggcggcggctctggcagtgaacgtggcgtcgatggcggcggcgggtggtggtggccggtggtggtggtgggacgctccgtcggcggcggcggcggcggcggcggcactcccggtggcgttcaacgtgtgggtggtggtgcatctctacccgttcgcgctcgggctgatgggtcgccggagcaaggcggtgcgccccattctgttcctgttcgccgtcgtcgcctacctcgccgtccgcttcctttgtctcttgttacaattccatacggcttaaaggcattcttaatttcgaccctacaattacagaattactacttttcactcactaggaattaagctggaattcacgaagctaaatggtatagatatttggggtgttacacttttaacccatgttgctcattgtttcttttctctatggtgttacaagatgttacgagcaagtttaatagtatagcaaactactagcttcaatttatttataatcaatttaatagctcattcatataatagttacatactacattattaatatatggtcccacatgtcatacacgcacagtgttttagagtccgtgctacagctgtctacaaatctgtagcccgctcctcttccctctccttatttatcttcttaaaatacctgctcttaactagcctatgtcgtcgagccttgaaaaagagaaattattttctgaaggctctttaccacacgatatgcaccaatgtttactacctactttgtgaataagggtgggccctacgtcagtgggtattagttattgttgtagccataatggtgaaataacaaaagtaggtagtaagctggaccccacaatcactagtcatgagagaaagatgagagaaatcatttgtttattccttatgactaggtagtaagcatattacctgatattagctacttactactcccataatgtatacaacctggtagtaggagtagtattttatttcttactatccactttagatgcacattgtgaatgccccaaggtttggacttatagctatgtgctccaatcgtatttccatctatatatgtcatttcgcgaatcgcgaggatcgatgatccaacggtgttcaagctaggtgcagctgtaactaagagtcctctagaaaaataagtgtgcatgagcttcgacattagttgctggctgcatgttagcgcgaaccaccactaacagagagttttgtgtactagtgcaaagcttatagtaagaggatggtgtataagttttgttgttagaaactactactctttcgtatgttttatgaaaaaaatacccgtacgttgtaacgggtaaaggctattttagttttattattgttgttattgttattatacagtttagatagggtgaaaattaccgtggaaatttgtttggatattacttttagaaaattatgatgcaattaggagtcggatatggattctaataactcaagtggacgtcctcccgtttattagatgtcaactagatggttacgaaaaattttcaaaaaaattgacaagatagatcaatatgtaatatatcactccacaaacatttaagttcaaattcaacttctacaagttgtaacaaaaataacaaatttaattgtaaatatacatatagtaatttgagttttgtttgttatttttgttacaatttgtagaagttgaattttaacttgcatgtttgtggattgatatattatatattgatctatcttgttcatatttttttaaattttttcataaccatttagatgatatgcaataaatagctggacgtccactcgagttgttaaaacagtttcccggtaggtgtctccctttcatctcaagttatcatgcgagttttttaaaagtatttcttatacgactccttctgtatttttaaaagaatcccaagttagcgtgagagttttttttaaaagagatttcttatacgactccttatgtatttttaaaagcgaaaaaaattaaaaacggactcaaacacgtatctatattttcaaaagcgaacgaactttgaaaccgactcaaatacaattgacctaccaaagtattggtaaaaacatcttcaatttttataatagtagagataagtcgctttggcttttttacaatcaaacttgtttaagtttaacaagtttagagatagaaaaacgtaatattatttttaataaaaataaacatgttatcaaaatatatatttggttttacatataataactaatctggtgttatatatagatgctataaattttctataacattttttcctaatcaataaaaaaatcatcaacatcatcaacaaattaatgtactgactttctcaaaagaaattaatcgttagttcgttacgtggcggtaaactttttgatcaagcaaacgtagtgttttttctacttcaaatcattttctgagagaaatattttagctgctagttccaggacgacgatgccaaatgtgtcacagattactcctaattaatgcttgtagcttatgtgatatccacatctttcgtgccaactgccagccaagggatgactataatcttggagatggtaattaagagcatatacaaatcacgacgaaacattacgcaccacgagtacacgatgtaccttagagctgcaagatcttcatccataattagttgctacggttgatgagctgacgtgcaccaaagcctcaaaagtcatgggccacatgcaccaaaatgaatttcctctccttaatttcctgtgaaaataataacttagttcaaaagcgaaagttccatggtaactaatttgttttcgatataaccctgtgataactataatttaaatttaaatagatacaatctcctataatttaaatttaaatagatacaataatctcctcgctcttttttatcgaacatctcctcattcgttaccgaatgtcaaattgcaaaacaccttttctaagcacaaacggaatgctatagtttttttattcgattacataaaaatcccaaatatgtatattatatccacacacccacaaagataaatccctagtcaccaaagtacactgttatagatcacttgcaaattattctaacatagtcatgcaaataaattagtgtccatacaccagaatatgttcactaggaaattgtgaacctccatataaactataaaagatttataataaagtagaaccatcttatcccaactaaaaatttagttagactttaccagtatagacattgagataaactaaatagagtttcatttttttcaaaagattgaaggaatcgttatgatcctctagatgttgaatgcaatttctatttctctccctctctcaaagtttctcaacctgaatagacaatccgctgttttgcttcaccaaaccgttctccaaacgaccaaacccatttagtaaaaaaaaagaaaaagccatcccccattgagttactgacaggtggggcccactctccacaatcccacctgtgggccccactgtccagccactgtagtgaccaactcttcctcatcctcccttccatgggaagccaaagaagaggagagaaggagagagagagagagagagacgccggccgtacgccctcctcctctaaatctcctccgattcgcacctcgcctcggcgagatcggatgccgctgaggaggaggaggaggcgctactaatcctctccgcccgccgcgccgaggggatcttggatcgacgaggagggggaggggagcagatgcgggcgagccggccggtggtgcacccggtggaggcgccgccgccggcagctttggcggtggcggcggcggcggtggcggtggaggccggggttggagcaggaggtggagcggcggcgcatggcggggagaacgcgcagccacgaggggtgcggatgaaggacccccccggggcgcccgggacgcccggcggcctcggcctccgcctcgtgcaggccttcttcgccgccgccgcgctcgccgtcatggcctccaccgacgacttcccctccgtctccgccttctggtgcgcccgctcgagcttccttggattctgtttacccccctttgtctggtccccctctcctaccaaatctttgcccttttaggattgaaattggtgtgtgttgttagtttggtctttggaaccgaaatggtagtactactaatttagcatgttcttggctaggcggatccctcgaatcacgcggctcaattagtccaacaaatttagtcgcctactttgcacttaatttgttctgttcagttacatcctggtcttatatatatattacggagtacttacgaaacatgagaacaaaacatgtttatatgaagaaatggaacttaagaataccgtttgtaagttctaccacaacccactgcttaggtcaaactacctcagctgaatgcacacaaagatatgttggttctgatttttttttgtttatcttgcctatcgatcaactttaagcgagccccttgttggccgagcaaattaacatttactcttgtaatagcattgtagaatagctttttcttagagcatcaattctaatgtgtaaggtgcattcatgttattctgctgcgcatttgggtggcatataatcgagatatatgtggtgactgtccaactttacgtcaactaaactacaaccatgcatgttagaggttagtggttcaagacaacaattttcgccttcagtgggcactcaggcactgattggaggcagcggagatgataagaggttcaggcctgagacttgccgttaatcccgttatgctttagttagagggaaaatgacaactacatgagaacagggataatctaaacaatcgccaactattggataatccaactgatatggctctttaaatttgtcactagcgaccaaagtttgactccttgtcgatgcatgttatgcccaaagttagactctttgtcaccccatgctaggtgcctatgttgtggattttctgtggtattcccttgtggtttttgttcctggcatgacaatcaacgatttttgttgactctctattgatgatattggaattaattctagaagaaaccattattgttgcttgattacttatgatttatgttgagaagtgttatttttccaggaaaaaagggacaaagtgttgatatctttctatgggattaaatgttgtatgcctttttttacttaatttggcaacctgaaagaggaactcaaaattgtgcatgttatttcgcatttatttttgcctcctttccaattcagtcaagccattttccttgatgcattaactttaacttcatcttgtttgctggttgcatttcgctatttaaattgcgaactctgtttagcatctttgctatcataattcataatgtactgatcataatgaactaatataaaaccattacatgcttctgaagggagcatgttgaaactgttttttaacatcaggggtcatgtttagtcttaatagtatgttcatttatcttcattgtgacatacttcggtaccataaagatccaaagctttcttcagtaagtcactaaatttactaatgtggttctatttttggtccagttaccttgttgcagcagccatcttgcaatgcttgtggagcctttcactagccgttgttgatatttatgcacttcttgtgaagcgttctttgcggaatccacaggctgtgtgtatatttaccatcggagatggggttagtgttttatctttctataaataaggggccatttttgctaagattccttttttactttttgcataaatagaatacctattgaacaacgttattgatttttgtagatcacagggacactaaccctaggtgcagcatgtgcatcagcaggcatcaccgtgctcattggcaatgacctgaacatatgcgcaaacaatcactgtgcaagtttcgaaactgcaaccgcgatggctttcatcagctggtttgcacttgcaccgtcctgcgtcttgaacttctggtcgatggcctccagatgaggacacagcttgtatttagacataattttgggctgtttgtcagccagatcactcggtgcaacagccaggagaaaacgtagtgcagctaattatactacgaccaagttgatgaatgcctgtgtaatgaaatttggtgtcgaattgtttgtacaaaataggggatagtttgttctgcaagagggtggttgtgaagctctgcaatttttttttttttgaaaacggcatgtttcttgtaagaagctttttgtgatctgaaaacacagagctcaacgtgccgatttgttatgtcattttattattctgatgtgatcttcattcccgagaaatatgcagttcacattttgcatcattagtgtcaggatagtagctcttccgagaactaggtaaccatgtgaatttaacgcaacatgaaccagtgcgttttatcagaagtatgttgaatttcaagctgttgacatgtgcttacttacaaaggttttttggatgttgcagtgcagaccgacacccaacattatcaaatttgtaagaacaggtgctcatttgaagcagtagttatttacaggttacaagccaatcgtgtggtaaaagttactccaatgtctaagaacagaagaatttttctgttcttctaaactgcacctctagtgtacaaaacacaaccatctgtacaggctgcaagacctgtagtcctgcagctcttgcgatacttgtgttaatagatgaattttcagccttctccaagccaatctatagcatcaaaatataggtactcaaattcttccgcaaagttcatgccacctagcactatacttgagacatcagtaattggaatacagtacatggagatgccactcaattatccaggcaaaccccacagctgcgtgcacaaaactgttgtttgccagttgtagcatcagcattctagctctatgtactgctgaattgcacaggttaacaaggctgcagtactgcaccagactgtttaaaatgttgcagatgcagcatcagcaaaactggtatatgaagatgattgttcagttcctctgggcttaaggcacacgaaatgatctgccggtccatacaatcaatccttcactgattttgctatattgggttgctaaatgttgtgcttcccatgtcaggttgtttcttcatagccaagacaatcttgcgagttatgatagaatcccttcgaacatacaaaacagtgttcactgtcactggcattcaactagctagagaaacaataccacttccccttttagtttcatcagctatgaattgtcatacacctgcattataaggaaaagatgttcataaatctgctgaacagtgctagtcttagaaattcctcaatatgactgataagtataagcaactttcatcacaaaggactcagtagggctaacactatgaacatatttttgaattatagatttatcaaagcgtacacctagcttcgtattgccctactatatagtagtaacatgtttttcttatccaaagagtttagaaatttccgaatattttatgcgcagaaaaagatcaacttaagaaaacatatacaaaaaacaactgcagaaatttggcaagttaaaaaaaatatcagttgaacacagtaaaaaatctaattagcagtcattgtcttgcaaattacattaaacaaatcataagcataccttacagactgctgatgaagaagtgcaagtcaatcgtgagacactagttgatcaaaaaagtcacaaaattgccttcatggcataaattactgaaacaaacacaaaacaaatcatagtgagttcaatgagctcatcaatcatataacaaactcaaaatacttggttgaactaggaactgaaacatttgggacagatagaaaaatactacagtacataagatataaatgagataaaattgaaaaagtgatcaattaatggcataacaatttatgggtcaaaattcaacataatggaaacaaaatgtcaaaatccgtgtccttaataagtaggtgttgtcaattacagattcaatctggtgcaaaacaaaacttatgttatatagcaccatggcgacaagccctagcagaccaattaaattacgaaaacattagattagcaaattccatgaacaatacaatatgttaaagatactagcaaagtaaaggcattgtaatgtataatcagacgcttgaaacaatctgtatttcacctctatttgataaaggtcccatcaaattaacattatgaaggaaataggaaaagtaacttacagactagtaaaacaacaattgctaggataagtaactgaataggacgtccatattgaacttgatactgagacctctgaagtagccgacggaatgcaccaaggcaaccataaagtttcttattgcagttatcctcatcatcagaggtgctcaagcaacttttgcttctttgaaacaacccatcaaacccctaaaataataagccaacattggcttagaacattgctatgtacgtaattaatagtatacaaataatgcgttggaaaagaaaaatgcaattcagattttttttcccacacctggcacgagcgagaatttgtcagaggaagagtttccacaacatcctgttggtcagctccagccaacttcttggctccattctttgtcttcattcttgtctttgattggaaggcattcattaatacagaagagctagggctcttaaccaaaggtaccttgggcagatcatcaaatgattgttcatcgatgccattggcctcatcaggaattgtaatagtccatgatccaatatcagcataggcacttgccgttctcctatgacctggagctgtctcctccttagttgacactaaacctgactctgctgagcccgaagaatcattcgaactatcaattgaaacaccctttttcacccttcttgcattgctaccaacctcaatgtcaccagcagatgtaattgtaaccacctcatcacgtttttgataagttcctgctgaaaggaaatgagctaactcttcacgttcaccctcatccaagcgaacccagctaagagggccacgcccttcagtagtattggattctttcaagaacttctccacctctaggatacgatgcccaatggctgaaacaaagtcatcatgccgagctctagtatctttgccagctaacacaacactataatttgatttaatagcccgctgcaactcatcaagctgacaaaagaaaacaaaaccacaatcagcactaaaattcagacctcatattttcataggtcatctcaaatcaatggtttgttactggtactaggtgttcccctttagcagaaaatttcacaagtaaaatgacacctttatttgcaagaaagaaaagacccgattgtccgttttctacttatgcataagtaccaaaagcaagctttcaagtacgacagggatgccatggcataccgaattggtgtcaagcccatatctgaagtctaaacaaatcaacgcatagtccatcttgtcaacgaaaagcaagccatcgttatgaacaaatgctctaatagaagaaccaaaaaggtagaaagcaacgaagcacatgcatcaaagtcaaagctttagtacttttttcaagaataactggaaccttaagcttagaagacggacaaactatactttggtttattctcacatcctaattcctaaaccaaactacttcgaatctttccaattcttccgcgcaatccccctcatcccaagcaatccaagaaacctaaaacgagtcaaaccaaaatcccatcgtttcaccagccacctagtattaaatcggatgtagcccagctcaaacctgccacttggcggtgccgagcgccgtgtgcagctcgcggcggagatccccagcgggtcgcccccatccaccaccaccacgttccgccggcgtcttcaccgcgccgccacctacttttttcctctcctgcaaccaccttctgtacaccgactccatcctacacgagcaaaaaacccaaaccctcaaaactccaaaaagaacaccagaatcagaaaccggaggcgcaccgaaggaaaggcaagaagaggaaggaggcggcgcaccggtcggcggactcctgcacctcctcggcggccggaagaaggggtccttctcccagcggtcgaacgacgtggccatctcgctggggactcggggggagatagattcgtgggaaggcgaaatcgaatcgaaaatgcgtcggccggtggcggtggtggtggaaaagaggaggaagaaggcaaaaggcagcgaagcaacagcggaattattcgccttttttttctctctctctctcgttttttttttttttttgggtgggaggtttcggcggcagttgattttggtggatgatattaataaatgaagtaataataatgcggtccgagtccgagtggtgggcgaggggcgcacgcgtgggcgaggaggggccttgttgcgtggaagcgtcgtcgtgccgcgttgggtgtgttaacttgctacgtgtaccaaatcggaagtaccgaatttctactttctgatgaatcgggtctcatcggcagcacttgggaagtgggagtgtgggactcctggcaatggaaatacaggtgtataattttgtgcctaaaacgaccaatgaatcaaaataactgttctatccgtttcagattataagtcattttgactttggttaaagtcaaactctttcaaatttaactaagtttgtatataaatataatataataataatatttacaagaccaaattaggtaactacatctataattaaatatattttcataatatattagtcttaggttaaaaatattactccctccatttcatattataagactttctagcattgtccacattcatatagatgttaataaatatatatatagtagtctgtacatccacattcatatagatgttaataaatatatatatatagtagtctgtatatatatttattaacatctatatgaatatagacaatgctagaaagtcttataatacgaaacgggggaagtgctactttttctaaaaacttgatcaaatttaaaacagttttactttaatcaaaattaaaacgacttatagtctgaacagagggaatagtatttatttgcatatttgacggcgtcagcttatacatccatggtttgaaactaaggatacaaatatttatttcagcaaacatgcattttaggaatttaggtcttccaacgtggaacctcatcgtccttccgatattatcactggcacatttctctttgtcataggattttatgctaattaatgagacaaagtgagacttaagatccatgatgtaatcaagaggtaataatttatgaaatagatagtaatgatgctcgaagagtcgtagagccttcgagatgggattaacgtggtagagttaatttacacgttacatcttcgtaaataagtgtactcgattaaagagggtataaaattgcagagacatgatgtatgagtgagtgactataatacttatggtgccatcggttgtcctaatgttaattacaagtcatacggtttattagtaaaaaattataagtaaaatctttataatgtgttcttagctattttaaagtactagaaagcaaaactatgagaaaaaaacttacaatcaatttcaaaattaaattaattgaaattttgatggtggctataagctgtagggatgggagccttataatttgggttatagacccaaacataattttgtaccagactattttcattatttagtctctaggatagcagaagcaggtgtaatctgtcaaattatttgatcttacgtttttagttaatttacaaattatatcttcaaacaatgattgcattgagtcaaaaacctcaagcatgtataagggcactgtagacatgtaaaaagagctgctagtctttacagtattggttcatattcatttgattggggagaatgatatttttagatggaattttcatcaaaatggtcaattcttgatgctttctatgtttttagctttaattaataatggttatgttgagaagaataaattcatatggaaacttaatatgccacttaagattaagattttatgtgttacctacttaaaggggttgttttgacaaaggacaatttggctaagaggaactggcatggtagtatgaaatgttgctttcgcataaaaaatgagactattcaacatttatttttgagtgtcatgcaaaatttctttggagagctttatagttttattctggtttatatactccacataatatatctcatatttttgagaattggcttgtgggagtggataaaaaaactagtaacttattcttgttggagaatccgttatttgttgggtcatatggttgtgtagaaatgatatggtttttggcaagtcaccttctatatcttatatgcaagttcttttcatggcaacatattagcttcggtcatgggctcaactattaaagtgtgatgatgatatcaagctagtaaaagttgcatatcgtaatcttgagtcaacggttatgcagcttttcgccaactttggttggagattcacaaatataattcaataatcatatgttcttcttttaggttggagttttaaatttttgtgtgtgctcctattttgaaaggagtgtgtttttagaactttgtgtgtgctcctgttttgtgaggagtgtgtttttatgtctttgttttgttagtttgagtttggttgaactagtgtaataattggctgtaactctttgagcaaacgccaagatttaattctattatctaaaaaaaagcatattgggttgtaggaaacggccgggatggccggtgcagtcaataatattagagaatttggatcaatgtgtaaaatcccttatatcttagtatagaggaagtatgttattagcgcttctgtttacatggttttctgtctatctataagagttgttgcttcgggacagtcggaaaagaatcatctacgagaacttaagtcaaaacgaaaagagcagataaatagtcacggctgcttatgttatggtttaatttctcaccttctactttatggtaacctaattcttatctcataggtactcctactaattaataatacggttttgctagctagctgtccacagttttggaggctagaaacattcgattttatagccgttcgatctagcgccatgattcgtgcgagattttttttctattggatccaaacctgatgaccaatagatgtgctacccgttggcgtgtatagctgcacgttgcctttttccagaaatttcttggaggcgaggtggcctaggcggaggcggagaccccgccagatgcagctctcggcgatttttttcgccgccggccggtgggtttcttgctgcccgcttcctcaccgatttttccccttcagctgctcgtgttcctcgcggtcgcagcgatcttctctgcctcatgctctctactcaaaatttcatgtgatttttccactttttggtgcattcatgtgatgttttgtgttcagatcctgcatcatgtttgccctataaatcgtttgtatgtttggttggtgttcttctcctagatttctaggggaatcgattcgttgattttcgcacacatgtattgttgttcatcttgaggatggaggcgtcaatgtttttccatttagttacataaattccatcgttgatgtttttccatttagttacataaaaatgtttaattatattccagttaaatagagcttataagttagttatagtctagttacagtccagttacaacctagttacacactagttatagtccagttacaccctagttacacactagttacagtccagttataacctagttacagagtagttatagctcagttacagttacatttagttacagtgtgcctagttattcagggtttcttaatgggcccacacgttctaaacggattggtttcgtgctttcagttggttcagacccgtttcctgtggtccgttgattacatatcttgaggtgaaaaaaattgaaagttttgaccttaaaaactgtcgacagcccaatagctaatcccttaataatataaaaataatatgtgtagaaaaaacgatgtgggagtatatcccaccactcctaggttttagggcagatatgtggacaaaaatcttaattttcaaaaagataccagcttttaaattaacaacagaacacatttaccatgaggctgcaaaacctaactcctaactcatgataacttcctcactttggcaagccgcaatcctacggtaccactaacagaatgtaggaagtagggtatcttttctgattttgagagagtggatataacatgcatctgctttttacttgtcctgtcttgtcttttttttttttttagttttgggttgttatatgctgctttaccattactttgccgtagtgaaggatgacaacactttcatgatcaaaagcacagggcatggtggaggttgagagacggggatgtgattttcttttataatgggcatataaaaactcgatttttgcttcgtagtaaggtacgtacgaccacttattataaagttctgagctcaaaatctaagtgctacagaatagaacaaaggtgaacgaaaaaacgatacaatgacactgatcaaaaggaaaataagcaattcaatgttgaaaggtcaagtctctattgctaaatctccataaaaaaattgatgaaaatctgtatggtgaatgattctaaattctaacatgcagcgcatataccctccgtattctcttcacccctttaaagttgtccctagaatcaaagcaagtgataggatgtaatggagatcaagaagaaatatagtgccaattggatctcttgtagggcgtggtggaagttaccaaatggattgatagatttggatgtgtaactcaacctgcaccatcaccagtggtatgcttgctagcacaccgctcactgaaccttttcattcatcatcaatctgttggtgctatatgacgacacaatagcagaggatatcgactagtggggtcatcgtggtcatgaaattcacagtggtaactgaaagaaaaatattatgatttacctatgaatgactgtacatatgatttataccactaaactatattagtacataaaacacactctgagctttttaaatgagacaaattaccccattgatcaagatgaatttggtcctacatgtgcaaatccatggtttctacactaatgtgggactctacactaaacagaaggtacagaaaagtcaaagcttggaggggagaacattgagaagtgaggggatggagaacaaagcataggcatctaggaagtaaggggaagctagacagaaagaggatacgttcccagaaagaaacagatgaagaaaaaagaggtaggtctgataggtgggcctccctactttatgtgcaagccaccaccatatatgatggcacataaaaccacaaattttgtttctacttaactggtggaacaatttattctgtttcaacaacttagggtgtggtctatattatatttgtggtttgagggaataaattagatgaacataaatatagttttggaagtaaatcagacattttcctatttcaaaaataaacaatacatatatacatatactggagtggcatatatcaatatgatattttataaaggcaaatattgtaagtagcaaattttttttgtcgagaacatttcaatgtcatatatctaactaggatattactagaaaacacgcgtggcttttctacgcgcgagtgaatatataacatgaaaaatgggtttccattgaacattgagtccaatactcaatattcacggtagtaaacatcatattacaaataatctgaatatatgcataaaagaaaggtacaagagagaattatcacactgaaatggattctaaaactccctccatacaaaaaactgaattatgtagcctttagatagattcatacattgctaaagaccagtttaactaatgtcgttatattatcattttgaagcttgagaaacatatctcagattcatcccaatagttgataatatgaatgcaagcctcctccggtcctcctatcaccctggatcattacaaatgcgcacggaaatgtgttaacagttctctgaactaatagcgaaataaacaggtgttctgtaaacaaataaaagcagaaaatatacatatataccatctacatgatagtgcttcctagctcatctctgaagatatttgcaagtgcaaccagttagtattaagataatacaagattgctgctacccagccatgacaaccattgacagagtactttcgacgatcagcaaaggctgcaattttgtctggctattcagagaaccccaagttcccgactcagtgcagtgctgtcatcattcatcaagctagtgaaatactcatctccttccattctcattattacatggaaaaaaaacaagaagtttgacatgatcagtaagcaattacaacaaataaaaacctgatatttgacatgataagtatgcaacaacaaataaaaactctctttttctacttgttagcacaattcatagtcctgctgtcagatatatttggatggatatgctatatattttcatgaactacaaatcacattcaccagccaacaacaatctgattacttccaactgcttattcagttttagttgttcatacaatgaagaaaaaaattattggcttccaaaagtgaaacttagcaaatattcagatagtctgtccaagccagcaaatgaactcctgagaacacggaaaatgaagtatttgtttcacatatcatctaaccaacactaatctgcataccccagaagcaagaaccagtaacaaaaaccactcagctagactaagtgtatgtttttaactaattccacagacacttctctacaaggatgcaattttctattttaaaccacatgacactttcttgattcctcctacctaaaattaactatattgtgactccctaaaatgtaatatacgaaaacttgtaaaactctctcttctatgctcaattttttcccttaatctttgaccattacccaaactaataaacaacacaatctgttaattaagatgtgcattcctaccagcaaatttcatgcaagatccacggtaaggaagatcctactgaacaaatgcaatacgtagcaattaaagagcttaaatctccccaagatccatggtatcttgcccctgcatcaaaatccacatggcaggtagaggtagtatgcctgtgatggcgaggtggatttgcagtccaaatccggtggtgtcattcaaagtggtacagcaataaacgacgctgcggccggccgtgggcgtcgcggccgggcgacggcgaggacgaggccgtgcggcggctccgtgcgatgtggaggccgagacggcgtggtggggctgtgcggcggacacgaatcccctcggcttgccaccatcgagctcctcccccaatccagcaaccaggaggaggggacggcggcgggccggatttgagccgcagccgctcgaggagccccgtcgccatgctgccccgagcttgagaggggagaggcattgtcttcgtcggatctcgtcgctgccggcgtgctgctccccaagtccctgcgcgccgtcaccgagctcctcgcccccatcaagcgacgatgaggaggagatggagggtcgccggcgcgtgcgaggagagggcctcgccctgctctcactggggacgtcatgggagaggcggcaacgaggacgagaggagaggtgggggtagggggagaggcggccactaagcggaggaggtggcggctgcgagcctgtgacgacgagaggatgcgaagcggcggcggcggcgaggcccgtggagagagggcagagtgcgaactattttctttttttttttctttcctctcttttattaggtggggattggggagaggcggggccgcgaaagggggagcaagcgggcaaagccgccgaaggaagggacgtcacgtggcacgatttcaggagaggcaacctgaattctcgctgcgccacgtggaccaatcaaagaccagggtttggacccgaaaatcggtattagagatcgctagtccaagatataaacctaggatattattaatatatcatgcaaaacaaggtattgtacagtaaatgattaattcatgggggcactcttataaaaaatttcatcgggtacgaacattctccctcggaatatgtctgaatttatagtaacgtgttatatgatatatcaaagcggtagccgtacagaaatgcttctcgagcggcggagctcaaggtgggaatcgtcgtgtactgtacgaacattttaattaaaaacaaaattgagtatatcgaaggctgagttgtgaattcgtgacttgtgaaaaaatccaccacgagtgcaggacaaccatctcacgcaagttgtcaatatgaatttatatatggcgcaccacgcgtcatatgcagatcgtgaaaaagaagagaagcaagattaaggccaaagataaatataggaaaaagtatgaattctccccccccaaactattacagtcgtctgaattaccccctgaaccacaaaaccggacattcttcacacccaactatacaaactggacgaattacccccctcgacccaatccgcggtggttttggtttacgtggagctgagttagcattctattcattaaaaaaataatgggacctacatgtcatactcttcctctctctcacgggcgggaggcggtggacacggagctgcggcggcggcagccggcgggtgacgctgaggcggcggcggtgggggatgagggtgacgcggaggcggcggcggtagcgcggcctcgccggagtcggacgtcgctgcggcggaagaggagaggtcacgcaatgaggaggcgaggcatgtcgcgtcgcagcggtggagcgcggtatgggcctcggcgaggagctgcttcagtgcttgagcaccaggggcagcgtagggggaccgaggacggcgatggccgggggcagactagttggggccgacggtgccgcgtgcgcacgaggaggcacacggcggcgtcgctttcttcccgcgctcgcacgagggggcaccggcggcggcgacagcgcacgagggagaaggctgggccagcgagcatgttcgcgcgggacaggcggcggacgggggtggaggccgcgcggatctggaaagatgatgcgggaccccgacggcccccgcgcgccgccgtccgccgcacgccccacgcgccgctgtcatccgcggctccacgccgccgtgcgcacttgcgtcgcccccacttgccaccatcgtccgcggcccgcgtcgccgtgcgcacttgcgacgcccccacttgctgccgtccgccgcgcgcccccacgcgccgccgtcgtccgcggctccggcgctgcccgcactcgccaccgtccgccgcccgcccctgagcgccgccgtcgtccgcccaccgctccatacttgcgcggttgttgcgcccgcatgcaccagtgagagagaacggagagagaaattaggaagaggtgaagtggaggcttgacaggtggaccccaccaatttttttttttaaaaaaatgctgattggactgtcacgtgtatgccacataggataaatccgctctgatttgggtcaaagagttaattcgtccggtattaaaagttcgaggtgaagaatatccggttttgtggttagggggtaattcggacgaccatgatagatcaaggggtaattcgtactttttccttaaatatattccagcagtataatgcgtcgacatccattatctgattccatacatgtggttcgcgttgataaatttctttggctctaaccagcacggatgtcgttgtcactgtggtggtgcggccggtgtagaagcttactggctttgcagtaaatccaacagagattcatttgtttcctattcaaaaggaaaaacaagaagaggagaagagaaattcagtgcgtgtctcgagttttcaactttttaacctgagtttttcccgggaaatattaacctccggattaaaaatttcatgatttttgaacttgttaatcccgggaaaatgatatactgtgagttgatttctttttttttttaatgatcatatccccgagctggccgccacgccgatattttttttttacggcaggcaattatattgcctggcttttaaacaaagccaaaagagcagaacagaacagagtcttatacatgacagaaaaaaggaaacgaaactatggcggccaaaagggttgaaaatacctaatcacaggaactttactaacaaaagactattgtcttgcaaaaaagattaagacaaatttttgctataggactgcatagatttataacacttgttttaggacactctagtttctgactgtgtaatacgacaatttagtttctgactgtcatatgataatatagttccaacggttatttaattatatatatgtgatatgtccttttctagtagagagattaaactttacaaaagatatttttagctttttgtcaccttgcataattcaaatttgaacaaattttagctgattttaaacttgtcaaaaaattaagttatccaaaaatacaaaaaacaaaatatttcaataaatattttttaaatccaggcaatattaatattccttttttgaaaagatttaatgtatttgaattccataatttaggacaaattttaaatttacaacatatattaaaatttggcaaaaatatgtaccaatttaaagtttggaaggtggcccaatggtaaaattgtttttttgacgagttttatttctccattggaacattatatattaacataatgtttgaagtttctttgaataaaaaccacgcaactagagtgtcctacgcaaaggtacaaactatcataataatgtcctaaagcaaatgctagaaattggtagagtctttagaaaattttggcaaaagttgaaggaattagactattgagatttctgaatgagtttcaactaaattggaaagaaatcaagaatagtgctcgactggtagaatgaaagtttttttattcgttttggtttatcagaaagagaagggtaattttttgtccctcattgtataaaaaaatttcgttgattttggcaattctgcacgtcccttaaattttttttgtataattaataacttttactggtggaatttttatatggatgtggaggtctctcaattatgattatggtcataactcataaggtaggggaatataaacttataaaaaaaatgcaacattgaactcacaataacattgtgaaatggcacgtatgagataaataaaaaaaaatgtttaggtgcatcgttgaggtgccttcaattctctcgtgttgttgtgttgaggagtttgtgctatatataccttctgttattttatttactctattcttttttataaaaaatgagagtacttctattgacttctgcagttctgctctgtcaaaactttaattatctataatataatatatctaaccttgcccattcaattaaaaatatataaaaaaaagaagcggagcttgcaaattcatcgcaaattccacaaagaaatgaagtatataaaaaagttcaagatcaccttggttagtggcccattgggctctttgctccaaccttcaaatatttctgatgtgcatctttcatggcagagttggccgactagcctttgatcgtgcggatatctggagcagacatggcggatatctgaagcagatatgcttcccgacaaacaaattaaattggcaaaattggttatatagcatcgaaagatcacgtttttggttttatagcaccgaaagttaccggttaactttaatagcacccaaagttcaccatgttcccatttttaacacttccgtcaattctcgatcgttttccgtccgttttgatccagccacacacacgatatgacgtttctacccctcacaagtacaagtataatgcatgttaatgaggggtagaaatgtcatatcatgtgtgtggctggatcaataaccatcaagacggacggaaaaattgacggaagtgctaaaaagggaatatggtgaactttggatgctattaaagtgaaccggtaactttcggtgctataaaaccaaaaacgtgaactttcgatgctatataaccaattttgccaattaaattacgcaacctgactgtgtaaccattgacaattaatattctactggctagttgaacgataaataacatctggtgatattaaaatagcccaactgcgagaacaaaatatttcagttgatcttgactttgttcgtacttcgtagggtgaataatgaatgcgtaaacgtgtttgacatgcagccattctccatctaagcatttttgggcgacatgcagaccagagtgcagaagaatactccctccgtccctattgtgatattttgcttacactatttgactgttcatcttattcaaagaattttagaattattatttattttatttgtgacttattttattatccaaagtactttaagtataactttttattttttatatttgcacaattttttaataagacgagtggtcaaacagtgcaagcaaaatatcaaaatcccttagagcaaggttaatagtacaaccaactgctagctccaaatcatttatagccaatttatacaatagttgcttactatattattaatatctggcctcacatgtcatacacacattatgtcttggagtccgtgctacaggggggtacaaaatta

SEQ ID NO: 80334 - DNA, 958 bp, Oryza sativa
attaggcacgttttcccttagtttatcgactgttagtttttgtctgttagtttgtgtgtttaggtttgttcgcttgtgggtcagtcgacggtcgatatcatgtgcctatgatatggctatcctaataagtattttgcttgctgttttaagtgttttaattctgatcagaacaattgcagtttaaattcctataaaataaagcttagttcctgagcatctgtttttcttcttttccaccccctccgtctgctcttccttcagatggtcaacaccaggaatggcagccgtgcagcaggtgagggcagcaacggcgaagaacgcaccgacggtgggcatcccaacagcgactccgtcaatggtccgccaccgctccccgagaatccgactctggcccaagtaatggctcatcagactcagatgatggcagccatgatgcagcagatgcagcagcagcaccagcagatgcaccagaggatgtagcagcaaaccaagtagcagcagcagcagtttggtccccctccccctctatccaagttgccggagtttctacgcgtcaggccacccaccttctccagcaccaacaacctcatggaggcaaatgactagctccatgccatagagaagaagctcaaccttctgcagtgcaatgatcaggagaaagtcgccttcgccacacatcagctccagggtcccgcgtcagcttggtgggacaaccacatggctacccgtccgccaggtatggaggtcacttgggcagaattctatcgcagctttaggaaggctcaggtgccagacggggttgtggcatagaagaagagggaattccgagcactccactagggcaacaggacagtgactgagtacctgcatgagttcaatcgcctagcgcggtatgcaccagagaatgttcgcactgacgcagagaagcaggagaagttcctagcaggcctggatgacg

SEQ ID NO: 80335 - DNA, 34610 bp, Oryza sativa
aactattcttcatcatgtaaagttgtaaacagtaaggtgtatgctgaatttatatgtccatacctaatctattttgttgttctatacttgtatgctctattttgttgttaataaattttattttttaaaaaaatcagtgcctagaaagcaaaaacgacttaaacatcaaaataacagctcaacgacgaccattctacctgatcctgctcctcaaggctgcacagcaaataaaataaaggtcagttccttattaattacttcatttgattgtgcaaatgcagagtagaaccatcatctgctagctgtatatgtccccaccatgattgctaggtttttatctggtcttgttgttttcattgatctgtcctagataaatcactttccaaaaggacttttagttgagctcgatcaggggtaaggtaaagtctaccttggaatgcctatcttcatactgttgtatacaacccatgcttcttagaattgcaatgtgctggagaaaaatctgacacgttgaaccttcagtaacacaagcaatggtgtgaaaaatctgaggaaatataatggtcttttttcaacaataacctttcctactaactataagattgagagttttccttgaccagttcattctcgtagcaaagtacaactgcaagtactcttcatcagggcaactttaaagaagtcagaaactgcagagtactcagctgtcacacaatttgaatgtaaattttagactaagaccaataatctatcagattttcatgcacgattcactggagaacctgaaataaagcagtactagtctatattcatctgaaagaagagggaatgagttgcatcagcaacaataagtctcaagaaaggaagcaatggcgtctgattttccaatccaattaagatgagagaaccacaattaatcctaaaggaagaaaaagagcggatacaacatgcttactagtgccaggaaaaaaaaaacaggaatgctgaactgaagttgatcggcgattttaatgagatcggtgcagaataaaacaaacttttgttcatcaaaatttttgctgtattacataactgtattatagatgcacttggcatcttcctgctttctccactgtttgcaatagatgaggaatgaatgcaagaaatgcaacaatctctgtatccagtgattctggattgttgtatacaaatgtgtgtatgcaagaaagctgtgttctagatcaatgtgtctgtggattaagtaagtaattgattgtatttgtttttgcacaaaaaatgagtatcagtggcggttctctgccctaacagggactgatgatccccacacggaattgtctgatggtgcttgagggccattagtgccagttccaaaaccgtcaaaaccgagagttatagcccttctgaaccggcactgatgagaggtctggggtgtttatcaagttgtctatgagaacctgcagtttcttacaatcttccaactaacaaagtttggtacccagtcatattatcttatatacaaagggtggaacagatgaggagtgaacctcgtattaagtttcacatacttatttcggaaccctcaggattaggtaaaggcatgagcttcatcttcagcagaaatgagcatttgcactatgtacttcatgcttggcctcctgtttctatcttcttccaggcatgaaatggccaattttataactagctgagcctgcaaatgattaaattcaccaccaaattgatcatcaattaagtccataatccatgattcattcttgctgtccagtttgtcaacaaccatcttaaccacgcttctcacatcagtttctactccatctttcccatccactacccattctgtaatcctcctccctttcaccagctcaagaagaacaactccataactatacacatcaaccttctcggtgatgggaaggctagaaacccactcgggagccatatatcctctcgtcccccgaatccgtgacatttcagaaccagacccatctctgttcaacaacttggacaagccaaagtcagtgattttaggctccatatcttcatccaacaatatgttctcgggcttcatgtcacaatggatgatccactctaggcattcattgtgaagatatgccaaccccttggccacacctagagcaatgttgaacctttgcttccatccaagaaacttgctggaatctctcctatcaaatagtactttggccaatgatccattctcaatgtactcatagactaaaatcctatgtgttccttccgagcaaaatccccacattctcacaagattcatatgataaatcctaccaatcacactcaactcggcttggaaaacatcctcactctggctcacatcttgtagcaccttgacggccactaccctctcatcgtctaaactccccttgtatactatacctgatccaccatgaccgatcttgttgttgaactttttagttcccctctccaactccgagtacctatatgcgcgaaaatggctagtaacaatcctgtacccttcttctagtaccgaaacctggcttggcctgaaaactcccttgttggaaaagatccagcaacccatcgcgatcagaaacacctcaatgacaaaaattgcagacaggaatccatagaagtagaaccatattgacttgccctgattattgctcgagctcgacgacatatcggaaacatcgagcaagaactctgatgagcttgagccactacatccagcaatgtcttcctcaatggcaaggccattcgtctgccattggtggacgtgcaactctggcatgtcgagatcagctgggaccttgagataggccgtcccaagatgggcagggtgtgttctgccattgaacatgaggcccttggtgtagcactctcctgtgccctgcttgtactcgaacaccacgcacgacggctcgctcatgcaccgcgccgtgcactcgtgcagcgacaggtgcgcgctgctgttgatgtcgaagccccagaagtcggtgtgcggcagcgccaccagcttcatcgcccgcggccggccgccgccgccgtcggtgtggttgaacgtcggctggcagcctcttgtccagtcgctcgcgtcggcgcgcgcgtaccccggcacgcagacgcacactggcgccggcgagtagaggcacacggcgttggcgccgcacacgccgtggatgacgcacgggttgacgaacgccatccacgacaccgaccatgtcccggccatctcatccaggctgtacagcctgaggttgccgtccgtgtccagcgtcagcctcctcctgacgccggcgccctcgccgaggtcggcggcgtcgaaggtcgcattgtcgctggacaagaaatggccggaggcgtcgaagaaagcttcccgggtgaagttgtagtagatgttgcggttgttctgccagtagctgtagtaggggttaggccagtagatgctgctgggcatcttgtggttgtcgtacaccagcgagagcatggcgtagtcgctgaagcggaggctgtagaagccggcggcgaggagcttgcctgccgagaccatcgcctcgccggcggcgacgatgcgctgggtgggaagcagggtgtcggtggggtgatcgaagctctgccataggatgttcccgctcgcgtcctcgatggcgaggttgccggagtcgtgcagccgcgcgcgagcggcggtggcgttggcgacggttgagttccataccacctcgccgtcgtagtcggtgaggacgagcgcgccgcggcggccgtcgagcgcaacgcgggagcgcgcgccgtggacgggggcgcggccgcggttggctgaccagacgacggtgcggcccgcggcgcgcgcgaaccagacggagaaggtgaagacggtgggcgagacgccgtagaggccggcggcgaaggtgccgtccggggagagcaggacgtcggtggcgtggtcctcgacggcgatggaggcgccccgggggaggctgtcgcggcgcgcctcgcacgggaatggacgcgacgacgagaggaagacgacgacgacgagaagcagcagcacggtggcggtggcgcggctacaacttttgcccatggccgtggcggtgaatgggttgatcagaagcgatgatttgcttctgctcactgttgaggtgttgagttaattaaattaaacaaattaagtagtgtaatacagtatgttattacagttatctgagagtgatgttgcatcgttaactctttatcaacagcgactgcatctttgtatttgtttgagagcattccagcaagccgagtgaagagataaagtcatgctgaagaatcgtcatgagtcatgacgatgttttattcatggataaggacataccgattggccaatcgtttcgagcaaagccgaatgttttctttgctagatgctccctacgtttcatattataattattacatattataagttatttaattttttttcttagttaaagttttttaggttttatcatgttttatagaaaaaattagcaatatctacaacactaaattagcttcattaaatttaattgaatatattttaataatatgtttgttttgtattgaaaatattagtatatttttctataaacttaatcaaacttaaagaaatttgactaagaaaaaaagttaaacaacttataataatacatatggagtaatttatagaggttacagagcaaaagccggccgaaatttaataagtaggagggtgaaaacagagatttatagaggttacagagcaaaatgacacctaccaccgcaaaggacatgtactccaatgtaaaaaaaaaaagacatgttactcccaccgtctacgtcctgcttagcccatctatgtctacgctggctttgctagataattcattcaacgtgcttctcatggggaatggattataatttttagaggggatgtcttttcatgtatactttttaaaaaaaatcaatgcaaatggttgtaagaaaaaactgaaaagttttgataatgtagagtatactatttgtgtattatttaagcaacgagaagatatcatctcgagagtttaaaagtgtttcccctttttgtggatgcttgttttgcaacaggaattgcctacaattactgctacatgttagctgttgttacggttgtgcactgacttataggggatctgttgtttcttgttttgatcatatattcaaggtaaatatgtgtttcttattttgaccatatattcaaggtaaatgtcattttttatagctaagtctaactagaagttcttctctgcaagataacttagaaaaatgtccaaatctgctaagaagtactaccaaaggttacatcaactacactgtgagtatctgactaataccaattctaacattagctgtcatacaagatactctacattgcaacacatgcaacaaactagttcttcctccgttgtaaatttttagtatataacaacttctctatccactatctcatcttgacccatcaatgattgtctcttgttaattttttccaccactttcatatatcaaacaatcaaaatcatccctcatttagttccacctcgctccttaatttctgtgaaaaatctctagaagtattcatattttatgatagatgaagtagtcactggtcaagccatgctagctcatcctagcatcatatttaactcatggcggtttgtactaaaattttgtaacaacttctattaattaccagcggctatcatgcccataggttattacaacatcaaactagcaaacaattgtaaagtatgtcttcatcatatgaacaatagaaaaggtgtatttgtgtatgctcccacaagtatctccatacctgaggctctattgttgttaatagtttgatttttttataaaaaaaaatcagtgcctagacagcgaaaacaacttaaatatcaacatcacagctcgaggatgaccattcttgcctgatcctcgctcctcaaggctgcaccgcaaactaagtcagatcatctgatttcaactacagaggagccacagtgaagtatcattatctgctagttgtacgggtgttgttggtatcattatctgctagctgtgcgggttgttggtatcattggtctgtcctaggtagattttccacaagtcttaggctgcgttcgggaggagggttccccgacacgcaaaacgaaggatgcattactagatgattaattaagtattaattatttttttgaaaaatggattaatatgattttttttaaaacaagtttcgtatagaaattttttgtaaaaacacactgtttagcagtttgaaaaatgtacgtgcggaaaacgagagaggtgagttgggaaaactagggaagaacacaaccttaagtctaactaggaatgcctattgtcagactgctacagcccatgcttcttagaattgcaatgtgctgaagaaaaatttgataggctgaactttcagtggcaataagccccaacaaaggagacaaaatatgtccaatttctcaaaccaattaaggaccagcaatcaatccaaaacgaagagaaagaacgcatacaacacgctcaataaataataaagacatgcaaacaaaaggaatactgacctgaaaagtatatcaacaattgtgatggattaggtgcaaatgaacttaaggaaaacacagtgaactaggatatattcataagatatttcttctatgggacaatatctcatagaacgaagggtctggatctaactgtacatgatagcctaggttcgatcatatctaatgaagatgaatcaggcttttattagggaaaagagagtcaatcaggtttgatcaaaataagcagatgggatctgcaaccactgttcattaaggcgctaggtactattctggcatcggacagcacccagcacctagattctgttcctatatgctgagtttctgcaccaagatgagcttcttcatgcgctgacttcatccctaccaaggatgaacacaatcacctattaaaattaatttaagacttacattcctagtaaaactatgacaaataaaagatcacactaaatggaaattgcgttgatgttttgaagacatacttaggaccacctgtcgtccatagattgcatgttactttatgatttatacatgtctacgatgttatggagggacatttgcaaatttaaaaacaaaagggtaatatttattctgttgcaattatttttagtttagttgtacgtgcaatattctctcaaatgtttcatcataaaaaaaaatgttaagagataatgtgaacagaaagaaataaaagctaccatctctcctttattacttgcaccaacaaaatttacaagatacgttatgcagctaccaaatttctaattgtttatttctccattgaccaggataacggcttaactatgtgtacggactctacggaacatggtaacctgcaaaaataacaaaagaaacataagtcttttattcattgcagaacagggagaactttatcaaaaggttaaattaaaacagatataactgtatgtaatcaactaagttagtatgaattaataactaacctgcgcagttagttcctgcgtgtaacggattgtcacatacttttgcaacattaacccactttgacaaagcaattttagccttatccgctgctgtaaatgtgcgacagatgcaattgacatctgcgctctgcactgtttggcagcaatgtgagtgtctttttgggaattggtcacccaaatgtttttcaatattgtgatagcatccatccttattcatcacaatatttttctcgttctcacagccttcagcttgtaaatggctcggagaagaagagatggctacaaagccaagaatgcaaaacactcctacaactttagcactaatcatcttcttgtagtggatgctaaaatttgtgtgtttgttgatcaatatgtgtgcagcatatgcagcacaaatatctagattcggatcaagtgcagtcacagtagtgactgcaactttggcagtacccaatcatccaaccatccagcacatgagggatggtctagatttaactgtgtcatgcatcattttagctatttgaacaagcacagaacagtagttcagattttgcctgcaatttctctccttttgatctgaattttcttgaactttcagaaaacccaaataatgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagctatgctactgctagattaacacagtaacaaaagctttcataatccaaaagtagatcatcatctgcttcccaaatcagcacgatgccttctaagttctattgacacctcttcaaatgaacttttgagataagatgacatcttcaacgtcaatagaaccctagggaaaaaaagataatatccaaattaaaataatttgttagcacatatatttatctttgaagaaactggtcagcataccagtagaagttgggcatagctgctaattgcttcacattcttgatgttcttccacatcagtttgcaagttttcctcctctgccttttcttcaggctgcataacagatttgagaagtggctcaatatatagttctcaatatatatagctgcataacagatttgagaagtggctgaaatatatttacctttctcttttttgttttctgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctacagctctggaagccaaaggaagaaattgttggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacattcgacaactacacgacacggtctgatcaaaagggttggcagtcaccttgtgctcatcttcaagtatgaactgatcatcaagtgagccaattgcaattatgaaatcattacttccatttgatcctttcgtataggtagccatggatttctcatattcagcttggaagacttcaaataaagcaggtgtgtaaagcttacttgcctgtaccaacataggtgtcatcatcataattcttggcaacttttttcttgactcatattcagattgcaattccttctctctcttttcttcaacaacacgctctacacgattaaggaacctgccgatgtcaagatctgatttcaaatgacctttcaagttactattcaaactttcacttaattgtgggcttcgcatccctattgtgaaaacatctgacatgtagcactcagcccacttttcttttaaattgtatatgctatccaaccaagtcactttacgcaccttttgtctcatggcatcaaatacatcttcaaattcttctttttcctcatactcatacatacatgcactgaaatctgctaggatacttgaaccttctgtttgttgaggactcaaatgctttacttcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacaaccacttgaatgattcaaatgtctcatcatacatcaaagctgcaccaaaaaccactgtctctctaaaatggttgaagccaacaaacataccaaaaggtctactttctttgtttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcagataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaatggcttgtttgtggagtttgaagaagatggttgtgttctacagctaagtcatgaaccttgtatgtcattgtttccctgagtaaagtgatgcccatgcgaacttggcaaccagttcgagtatgagctcgattacgttttgctacaacatatttcttttcttctgctctagaaccctgatttgaacaaacaaacctactggatgttactaactgatcaagatcacttttgttagtgtaattatttcgaacatcaaagccaatacgaccaccatatttgacccaaaaatcccaagcttcttcataggaattaaatgtcatgccaatttgaggcatccaacagggaggtttagtagatctgttacattacagtatagaggaataaaaagtttgacgcatgaacaacacaggaagaaagaagacaaaaatcagaagacaaaggatcctatcgcgatctgtacctctccaggttttgctccatggccttctcaacggtcatggctgaacagagaagagaaagaagcgtgtgatgtgctgcagcagtaatgggtaaagtatgcttcccatggtagaattggcgccaattctcacctccctctcagacttttccctccaaaacacttctgctggagtcagagagtaggtgaaaagttgggggaaattgagcaaccaatctagaccatcccttgtgtgctggatggttagatgatgggtactgccaaagttgcagtcactactgtgactgcacctgatccgaatcccaaatatatagtggtcatgcgaagtcctgtggggtctctacatactattcacttgtttttgaatatctactataaaagatatctaatggctaatgtttgaacttataatatctccaacatatcttaagatatatttattttcctcggatatgtgcatttatttattcttttttaagaactggaagatatcttcatttattaaaactattgatggattgcttggatatgttctcatttaataaaaatatgatatgctagatggattattctcatttattgatctgctactacacagtaatttattctcatttattatagagtaaatttcacaaaactatatatactttcatcaaattatcacaaaactacagatttaaggtgatatatcataaaactatatatttaatactaaatttatcacaaaactaaaggtttaagactaagtatcgcaaaactatagatttaataataaaattatcacaaaactacacatatggggttcaaatccttatgtttgagttatcaacgtccaagttttataattaaattgacgtaaacatgtggttttgtgataattttattattaaatatgtagttttgcaatacttaaccttaaacatatagttttgtgatatattatcttaaatatatagttttctgataaattaatcaaagtatatgtagttccttaaaatttactctttattataagtttataactaccaatagaccattagaacgcatgatgctggtaagtagcatgtagggctaacgatgtcccacctgacacactgaaccaagctacagattatttgtgattaattaagtattagctaattaaaactaaaaatggatgtatgattttttttaaaacaatactttctatagatttttttaataaaacacatcatctagcattttgggaagtgcgcgcacgaaaaacgagagtgtagaagttgggaaagtagggaggatagcatagccctagagtgagttctttcttgatgttgggaactcatccctcgcgcatgaaaaatgaagcgacttattagcgcatgattaattaagtattaactattttttaaaaaaagttaatatgatttttaaagaaactttcatatgtaattgttttaaaaagaatacaccatttagaagtttaaaaagcatgtacgtggaaaacgagaaagttgagtttagaacttaaccgaactcaaccctattgatgttgtgaagtctctgttaaaaaaatagaatgatctaaagtaagttgtcttgactactgtctggacaacaggttgaatggtgattttaatatgcccaagaaatttacaatattgaaagtggttattatcttgtggttgtggctagagggagatccaaaagaaatgctataaaagtatagattgttgcatgatatgaaaataaggatatcaatccgtaagcccttctctatttatgatgggaaaataatttgtgaaaagttggcttagatattcatctaacttagaaatactcagttgcattttttttagttttaatcatttgctagcataatttcagtactatagtgatgtttatcaagttgtccttaagaacctgcactctcttacaatcttccaactaacaaagtacagtgctcttgaatttgcatagtttttacagaaagggtgaaatagataaagagtgaacttcatattaaatctcaaatacttgtgttagaaccatcggaattaggtgaaggcatgagcatcatcttcagcagaaataagcatttgtactatgtacttcatggttggccttttgtttttatcttcttccaagcatgaaacggccaattgcattagtagcctagcctgcaaatgattaaattcaccatgcaaccgatcatccatcaaatccgcaaccaaggattctatgttgctctcaagtttgctgacaaccatcttaaccacacttctcaattcggcttctagttcctctttcccatccaacacccaatctgaaatcctcacccctttcaccagttcaagaagcaccactccataactgtacacatcaactttctctgtgattggaaggctagaaacccactcaggagccatatatcctcttgtcccccgaatccatgacatgtcagaaccagacccgtctctattcaacaacttggacaagccaaagtcagtgatcttaggctccatatcttcatccaatagtatgttctctggcttcatgtcgcaatggatgatccactcaaggcactcattgtgaagatatgccagccccttggcaacacctagagcaatgttgaacctttgcttccatccaagaaacataccagaatccctcccttgaaatagtactttggccaatgatccattctcaatgtactcatagactaaaatcctatgtattccttctgagcaaaaaccccacattctaacaagattcatatgataaattctaccaataacactcaactcagcctggaacacatcctcaccctgcttcacatcttgtagcaccttgacggccaccgtcctctcatcatctagaattcctttgtacacaacacctgacccaccacggccgatctcactctgaaaatttctagttccattccgtagctctacgtaactatatgcgcgaaaatggttggtaaccatcctgtacccttcatctagtgctgaaacctgacatcgcctaaaaactcccttgttggaaaagagccagcaaccgaatgctatcacaaacacctcaatgacaaaaaatgcagtcagaaatccgtagaagtagaaccatatcgacttgccctgattacttttgctcgatgacgcattcgagacattgagcaagaactccggtgagctcatgccaccgcatccgacaatgtcttcctgaatggcaatggcgtggcgatcgccgtccttttgccattggtggatgtgaatttctggcatgtcgagatcagccgggaccttgagataggccgtcccaggcaggccggggaacgttctgccattgaacatgaggctttttgggtagcactcacctttgccctgcttgtactggaaaaccacgcacgacggctcgctcatgcaccgtgtcgagcactcgtccagcgacaggttctcgctgctgttgatgtcgaagccccagaagtcggtgtgcggcagcgccaccagcttcatcgcccgcggccggccgccgccgtcaccggagttgaacgttggccggcagcctctgctccagtcgctcgggtcggcgcgcgcgtaccccggcgcgcagacgcacaccggcgccggcgagtagaggcagacggcgttggcgccgcacacgccgtggatgatgcacgggttgctgaacgccatccacgacaccaaccatgtcccggcgacctcgtcaaggctgtacagcctgaggttgccgtccgtgtccagcgtcagcctcctcctaacggcgacattcttgcccagatcggcggcgccgaaggtggcgttgtcgctggacgagaaatggccggaggcgtcgaagaaagcttcccgggtgaagttgtagatcttgcgactgttctgccagtagctgtagtaggggttgggccagtagatgctggacatctcatggttgtcgtacaccagcgacagcatggcgtagtcgctgaagcggaagctgtagaagccggcggcgaggatcttgtctgccgagaccatcgcctcgccggcggcgatgcgctgcgtgggcagtagtgtgtcggtggggtggtcgaagctctgccataggacgttcccgctcccgtcctcgatggcgaggttgccggaatcgtgcagccgcgcgcgcgcagcggtggcgctggcgctgacggtggagttccagaccacctcgccgtcgtagtcggtgaggacgagcgcgccgcggcggccgctgagtttgagacgggagcgcttgctgtggacggggcgggcgcggttggcggaccagacgacggcgcggtcggcggcgcgcgcgaaccagacggagaaggtgaagacggtgggcgagacgccgtagaagccgcaggcgaaggtgccgtccggggagagcaggacgtcggtggcgtggtcctcgacggcgatggaggcgccccggaggagactgtcgcgcgccgtgcacggaaatggacgcgacagcgagacgaagacgacgagtagcagcgctttggtggcggcggcgcgaagggcaccgctactgctacaactagtgctcatggctgtcaagtcgtgccggtaatggtaattggtaggtggcgaggaagtgattagctttgatctaatctactcactgttgatgtgttgagttaattagacaagtatactagtaattaacaaatgttttatccgacaggcaaattgcaggaaccgtgaccaaggcgcctaataagtttgactcgccctgacagacgacgacaacatgtttttcctgagacaatggggaccagatcctgcaaatggtattaggaggcaatcgcgactggtattggaattttgtaattcttccgtttcacaatgtaaaaatttctagcattacctgttggtaatttttctaacaagtcgacaagcacgatcgcaacacctaaacgccttgcggtgatatggagtcgccaaccacctcgatctaaccaaagggccaaatcaatatgggttttgcaaaaagaaaagctaaaccggctagcggagctatgggttttgcaaaaagaaaagctaaaccggctagcggagccgatttagagatcaaaatcagcctttatgccgatttagatcgatatgaggataactacccgtctcgtgggcaaaacggaaggttttcaggacaaacctacaaagaggtgtcgcactctcgcagcggcgacggacggtttacggcgcaaaccgacaaagatggactaaaattagggtaaaataaaaaacatagtaaaagaacgattcaagtagattgtattcgggtgttttacgatgaaccggtcttgtcccttctccacgtccaactcgggatagaaaataaaggaaacacgaaacatgccttcccgagcaaggaaacccgagacctgacgaaaacagactcggacttggaccctaccggtctgaccgcccacatacctgcggtcagactggccctactagccggtcagactgcccatatacctgcggtctaaccggccctatgaaggaaacccggcactttccaaactttaaattttcctctatttcgtctataggtgccaaatttgggtgtaaacacatgcccccctgcattttttatgaacatcgtgaatctaaaagcatagaacatattgtcttagggcgataatccaattaccggccatagtacttcctaagcatcttgccaaatgctcgggaagtatttcttcaagtatttcccattaattgctctatgaaaacaccgtcttgaagtgtcttcatctccttcaaagtcttcaaacgcttgtcgatgacgtcttcaaaattgcttcccatcaaggtcttgtaatcttcaaccgacaagtcatcttgcttgaaataccgaagagagtcaagatttacctcaacttcgtataagtaatattctcaagcggcacggcttcggcccacttagtgaaatccattgcaactagcacgaaccaatgcccttttgataacgaaggataaatctgaccaatgaaatccaaagccctacctcggaacggccatggtttgataataggattcaatatagcgacatgcgccaaatgaacattgccgatccgttgacaagcttcactccctctgtagcacttgaaataatcatcaattactttcggccaatagaattccactcttctaagcaaccaattcatcttatgggccaattgatgaattccacaaatcccttcatgcacatctcccctagcaactttagattgatcattgtctaaacacatcaatagcactccatctatatttcggcgatataatatttgaacatttgccgccgaatcttccgatcaaccccaagactaggatctttcaaatattctatcaaaggaattctccaagctatttctaactcatgggcacaaatgtccgaattcacaattaattcggccttttaatcaactgtaacgtgcccccaagcctcctgtctgggatcggtcagaccggccacgcaatgccggtcagaccgccctgtctgcctgaacagaccggccatgcagagccggtcagaccgccggtaccaccggtcagaccgccggtaccaccggtcagactggccgtgcaatgccagtcagaccgcccctagtctgtgattttgccaatttcatccaaagacttaaaaatcaagcaccggcttttctaatatcaaaaatactcctttcttcatattataaccagatgcttggtgtatcgaactattggaccaaaatccctcctctctagacatatgaaaaattataatatccaactaatatgtctagatgaatactaattcaaatggcttttgaaacaataatcatcatggcatcaaaacacttagccaattgaagtatgatcaataatgaatcaccaaagtcatatgtgtcacatgcatagattctaataaactacaaatgtaagtaatcggcttgagcatgtatgtaaaatattaacaatgccaatgttcctaaagaaaaccactctagagcaaatcatcacattgaccattgacattagtcgaattactagtaagcaaaactttcatggtgcaataaatatgaaatctatatattatctggtgatccataaaaacacatataatttggctttaaataaatatcagagtcatgagccaaatcatatttcaaacaaattatatgccaacctaccaattctactacctagaactggcatttgcaacatgtatgtataatatgaatttgataagtaaaaacacacatgtgctagatagcaagcaatgttctaacatggcataggcatataatatgatgatgaacacaataaacccataccttgccttagcatccaacaaacggcggctaaaagatgtgatgccgtatccatcgctattcatcttctcttggttccctcataagcatattgatgtcttgccccccgagcaaaatcggctttcttgattgcacaatttcaaaggcaagacgaacaccgcaccagcatcgatagcatcatgtgaaggagacttatctctaatgaccgatgattcttctcttatcaaattggattcatctctactacgggaaatcaccagtctcttaacttttacctcattggatctccacatttgcctaggtgcttttcgaggctccaaattattgcatgtcttgttctccacatcttcggcctctttttctttttgacctatggctcgaagacgctgtagcctcctcttttgagagtgagataagccagaaggtatccacttcggctgtggttgttttccaggagctaagcaatgattcttcatatttttggtcgaagtggaagctcctatgttgctctcaattttcacactcttctccaatacccccccccccggtcagaccggcctctgggcccggtccgaccggtcacaagccgtcggtcagaccggccagtaaggtcggtcagaccggccgtagactggcggttagaccggccagctggctcggtcagaccgctgatgtcgacaacaacggtattggctttagtcttttccgtttgtatagttttcgctgcatctccagtaggtacatgaacatcttgagattcctcattgatagcaacgacctccggagctttggcttctttcctcacccacaccttcttcacctttttcacctttgatccaccggaccgattcttttggggaaacggtcttgtcttgagttggatgaatgatttggcactaacctaggtgattccttccactcttggtaatacggcataggtggttgatgcatccaaggcatgtaatacataaaaggataaccatatagtgacattggatatggataccatggcatcacaaccggaggtttatatggagttggtatggttgatggctccgattgctttgatgtttgaccaaatctcttcctacgagatgatcttggtcttttcgaatcactagtttggttatcaaatcgttgaccggctaatcctttcttgtatttagccataagcatctcaaaagtgagcttcggctttttggtcctttggatactagataactcatcctttgcaactttatgatctccggcctttgcattattgatcctattcttgggccaaggatccccaataataacacttttccctttctttttgtcaacatcaataggactaataaggagagaattactaacaattccggtcttaggcataggtgtaaccgaaatagtttcacacgtgaccgatgaagtatcaatcggtctttgctccatcaagcttgcatctttaaaataatcatgaaactcatgctccatttgtgaccatgtagaaattgaattgggagcaagtaaactatatcatgtacatgcaaagtttgacaaagaaagaggaaacaactttaacttaagcaaatcatcactaccggccttaccacattgttcaataaattgaccgatatgctccattgttgttctagcatcctcacctgtgaatttcgtgaagttgggcacttcaaatccttgcaggtacgggaccgaatctacatgttcaggatacggcctttgatatgtatgcatagctactttggattctatttcactactatcccgcaaaacattatcattatcttttccaacatccacatgaccgatttgtgattcggtcttaggtgataatgctatttcactttcacttgtgatataacctgaaccgtcacttagttcggctatattttcaatgatgctattctctaagctagcaacacaatccgaaccattacttgttcggctattccatcgttgtctaaactagtaacacaatccgaaccaacacttggttcggctataatcgctatggcatcattgcacaaattattaacacaatccgaaccatcgcttggttcggctatacatgatattgcattttcatctaaactagtttgtaagctattgtcatccactcggctttcctgagccagagcttcatgcaacacatgatcaatatcaagaaatatatggccattcaatttctatttaatagaatcaagcaatccatcatatgcgatgtcagccaaatctttgtcagttattttcaaattgaaacatcggtttttaacatctctaaacctttcaatataatcagcaacagattcattgtatttgtgcctaaccgatgttaaatcagacaacctaagctcagtctcactagtgtggaaataatcatgaaatttttgttctaattgagcccaggaagaaatagaatttgccggtaaagaagtaaaccatgcaaaagcaataccggacaaagataaagaaaacaagcgcaatttacatgtatcccaattagcttcaccacattgcgctaaaaaattgatctacatgctcccatgtggtcctactttcctcaccactaaacttagtaaattcaggaattttataaccacgaggatatgggataatatcataaaaatcaagatacggcttttggtactccctagcatgattccttagctttgcgaaattctccctaatagtatttctaaaccaatcctccacagtttcaggctttggtggatctggtggtggacttggtggcctaaaaggtggttgttgcggcacaatattgttatattggccatacctagtatcgggaggatatcccctattaatatcattgtaggcattagagatatgtggaaaagcatgactaacagtattaacaggtgatgaataataattaaaatcagtactgctagtcgtggtatgaaaacctggagaaactcccagggaaccggtccgaccggcccatggcccggtctgaccggtggtcagtggtgcggtcagaccggccacaggaggcgcgatctggccaggatagggtatggtctgaccggctatagtaggcacggtctgaccggcgtagtacacggtctaaccggccatggtgggcacggtctgaccggcaaaggatgcggttagaccggtgtcacgactggtcataccgtcagctcggttttgcatatagccgattcctatgtaatcggctgtataatcacccattgaccccccctccccctagcattataagcatattgtataggagcaaaactaaaagtagcatatgcatctacacaatgattattaacgttttgaatagcaaaggacgggttgggcgaatcgaaggttacctttggtgaaattacaacttgaggtagcgggacgtcttctctcatgacgccttgatcggtcctaatgtattgtgtagcaatattgttgaacccgttctcactcgttatagttgatgaagaaattccttgattaatttcagccatatagctcgtagccgaaatattgatatttttcatgtgtgtgcagtgagcaaaaatctggaaatttcgatgtctcgcagaacaaccgatacagtatgaatcggttttgtattttttttttatgtacgtacacagtaatagatcggctttgatcaatagcctgatctcgttttgttttgcttttttttactcggttaatatgcacaataagaaagcgagactgatactgctcctattgtcttcctggttcccgcatttgcgtcggcagctgctgctcctcttctccggtctgaccgaattgataatgtcggttagaccggcaagataggcagccagatcgacagcacaagaacaatgccgccgatctgaatcaatcaacacaatgatcgatagatatgtgcagtgatagtacatagatagattgatttcggctgtttagccgaaactctagatttgacgaaacagaaattactagattaaacgaaattcggccatgatatggctgattagatcgttccccagtggagtcgccaaaaatcgtgttggcaacttttttaacaagtcgacaagcacgatcgcaacacctaaacgtcttgcggtgatatggagtcaccaaccacctcgatctagccaaagggccaaatcaagatgggttttgcaaaaagaaaagctaaaccggctagcggagccgatttagagatcaaaatcagcctttaggccgatttagatcgatatgaaaataactacccgtctcgtgggtaaaacggaaggttttcaggacaaacctacaaagaggtgtcgcactctcgcagcggcggcggacggtttacggcgcaaaccgacaaagatggactaaaactaaaacatagtaaaagaacgattcaagtagattgtattcgggtgttttacaataaaccggccttgtcccttaaataggggttggtcttgccctctacaggcccttctccacgtccaactcgggatagaaactaaaggaaacacgaaacatgccttcccgagcaaggaaacccgagacccgacgaaaacagactcggactcggaccctgccggtctgaccgcccacatacctgcggtctgaccggccctgtgaaggaaactcggcactttccaaactttggcaattttcctctatttcgtctataggtgccaaatttgggtgtaaacattacccatattcatttagatgttaaagaatctagacatatgtatgtgtttaggttcattaacatttatatgtatgtggacaatgttagaaagtcttacattgtgaaacggagggagtagtttactacccctccattctacgttataagctttttgggcgaagcaagaagccttcgtctgaatagaaggggccttcgaccaagggtttgggagaccttgcggcccatgggggcctttcgtcattaatgggccggcccaaggagatcgcttgagggcccatgaatacaaaagagactgtgtacccacactaatgtccatatcataaaggtatccatgtaaattctcatatactaactaaaccctagaaggtatgagcatgtactaagactataatattgctcttactattccatcaacttactgagtgaaccacgtctttcgatatgacgcaattgtcttttgacaacaatatctttatccaaaattacaaattattttatggaaactaaagttgccatagaatacaaatagctaatatcaacccctgatattccttgcaagagatctaaggttaaaactacatatcacataacaattaatcaacaaatacatgactgacatagctttaaccttcaaatgaaatgagtgcttgcacaactgagttcatgtttggccgcttgctcctatcttcctccaagcatgaaagagcaatctcaagcatcagcttcacttgtacatggttgaaatcaccgttcaatcgatagtccacaagatcctcgatagatttttcttcattggactccatcttctcacgtgtcaccctaacaactatcctaatatccatctcacataccttgatcccatggatcacccattccgaaatccaaatccccttcactagctcaaggagtattactccataactatacacatcaaccttctctataaccggtaggttagtaacccactctggagccatgtaccctcttgtccctctgatccgtgtcaaaattgcatctgaaccatctctgtttaacaacttagacaaaccaaaatccgtaatcttgggctccaaatccttatccaacaaaatgttctcaggcttcatgtcacaaggaacaatccattctgaacactcactgtgaaggtaagccagccctttagccacacacagagcaatcctgaaccgttgattccaatcaagcacatcatcatcaaatccatccctaccaaacaacttatgtgcaagtgatccattctctatgtattcagagacaagaatcctgtgcttgccttgagagcagcaaccccacattctgacaaggttcatgtgatagatccttccaatcacactcagctccgcttggaactcctcactctaccggctcacgttcttgagcaccttcacggccaccgccctctcatcgtcgagcacgcccttgtacaccacgccagagccgccgtggccgatcacgccggtgaagctcgccgtggctttcttgatgtcaccgaggggtcacatcaagaaaaggttagaatgttaccgagcagtggcggatctacgaatttttctaagcccgggcaagcctagcgatgggtagaaggtgtacttaaatctatataagtacataaaccatttaatatatattatatagtcttgtattatcttaaaattgaaaaaacagatgatcaactagtaaattaattaagaaagtaattagctactactactcaactgcatgtacgactgaaccctgtaactaagtactagtcactgcagtatggtgcactgaatgaggcgaagtgatggtaacaagtaacaagtgctctttcactgttgattcatgcggcggagctcgggcagctgcccatgctagccgggcggcggctccgccgctgttaccgagggtcttctctctggcatatagaagcttgctgcagaactttctcacatgtatgattgtgaaaatgaggacatggtggtgggttttggaacccacttgcaattccagccataccttcctctatggtatggtatgtgtgacgtgataaatattcatctagctcagctaaacccttagccatgtcctcttcctggacaacctcctcctcctcctcctcctccagtagtacatgaagggcaagaacaactggatgtattcctttatttaatttcttcatgataggatgattcttcaaaatagaatgaatacccctctccagatctgcttcttcctcttcatgagtcatattcccaatagaacaaatgtcctcatccaccacatcctcatccacctccaaatccaatttctcaaacctaaacaacacattacaatccaattagtaatcatattaaaaaaaattgtccctattaatttagagatgattgtaatgacaacaaaatcttgcggttatatgacattttattaacaacatgcactattttcttagactaaacatggcatgcattaaattaatgccaattatcttcatatgaagattaatgcatggtgcacgagtcaaaatatgaagaaatacatgaacgcaaaaacaaatactcacaattgtgacatccaatgcggtaattcgtcttgttcatgcaagccagcagcatccacgttgaccctaaataaatatagcattgcattaacgttagcatgttgctaattaatcttgctttgagaaactacaatgcatggatctaaataaatcaaaaggaacgcatagttttaatatggcatggttagaagataacccttataaggttttcagcaggtgatcatattttcacacacataaagaatagaaaccatttttcatctcatgtcaagcatgcaatttttgccaaaagcaaaaaacagtgccctgatataaatagaccaattgatagaagtgaaatgcgttaagcatatagtaacaaaacagcaatataatatcaaggataagcttatgaattggcaatacccaaagcataaagaatcatgatttgcagattaacaaacaggataagtaaaccataaacagcatgggaacatctacttagcagaagaaaactgaaggaagagataagatgaacatacatggtggaatcctgctggattactgcagttgattcggaggtcactgtttcagcatcagccgtaggcatttgctccgctagcctgaagaacacaagatgaacatatatatataagtcatcaagaatgcatcctattgcacgagagcaactgagcaagcaagcaaacaacggcaagcacagacgtaagtgcctggtttcttccccaattgcctcccgcagccgtgggtcgtctggcagagaagagctgctccggctcgtcggcgtctcctcgtcatcgtcggcgggatccatggcggagtggatctgtggatggatgggtggaggcgaagccgcaggccgcagctagagctaggtaggaggaggaaggagcgagccctagctaggtgaagtaggtcccttttcgttcgaggaagacgaaggggaagggaaggcacattgcgaaatttgatattttaccatcgttaggcagctggattcgccgaaaatatcattatcaattgagaggcttcactcatatgccattttcttctaattctctctttcgtcttattattattgactaaaatactcctagttgaatcaatttaagtatatcaaaaaatacgtagattataaagtaaatataccaaaatagttttacatgttattttttttctctacaccatattacatagtatgcggcgtattatctccacaacataaaaaaaaacactctcaactgaaactctcataaaaaatacgtaattattttttatttatgctgtgaagatagtgtcttatactctgtaatttggtgtaaagaaaaaaaaacatatatattgcatgtcaatatatttgtgcgatatgtactctgtaatctacatatttgctttacttgaattaattcaactaggggtattttggtcagcaaatataagagaaaaaagagaattggaagaaaatggtgtttcggcaaaacccctcaattgagaatggtatttcggcgaatcccaactataagtggtatttgggtgaaaccctattttaacgatggtattatgccaattttctcctagctatgtagtgttatcatggcgcatgggcctttgggattcggcccagtttccactgttttgggccaataagttcatctgaggtccttaagttgtcagcgaatctgattttcgtcctttatctagaaaacgatacaacgggttcctcaactgttaaaaccgatgcaatataggtctcatggcggtttgaacggcgattttagctaacgtggcattgacgtgacaatttaatttggaaaatattaaaaactgtgaccccacatattagttacaccaaaataatgaattaaaaaatggtgggctcatgtggaccccataggttctcaaccccccccctctctctctcttcctcccggttttgctactgggaaagagtagcatgtaggggttgggtgggggggtgatcgcccgagcggtcacccacccattagcaccccctcttcctcctccctctcggcctctccacattaatgccacatgtaaactcataattacaaaagccacaatagatcgacaaattttctaatggagcaagcatgcatacacacggctaggttaaatctataactaatataaatattcgtatttttccggtcgtcacatctaattttcatccgtttatcttccatacacaatccgattcggttagcaatagccatggaaaaaaattgcaaaaaaaagggcagccgccgacgcccgcctccacgctgtccgggccgccgcacctcccctcccccgatctagcggagggaagggcatcgccggccctcccgccgccgccacacagagagaaagggggagaagtggagagagtgggggtggggcgtcgcgctgtggggagggtggcgctgctcgctggggggagtgcgcgccgccgccgctgctcgctgtgggggaaggcggcgctgccgccacaccccgccgcaccccgccgtcgccgcaccgtgccggcgagaagggagggacggcgccggtggcgggggagtcagccggctggggggagggggagaggcgccggtggggagagggagagggggaggaggaggcggcgttgggggcggggaaggaggaggcggccggctcggctcgactggggcgggagggtgagggggagggttagggttagggttaggttttcatcaattttaaactgatctgaggcgtccatcaaaacgaacggctgagatcgatcgagggtttgggccacaccacttgggctgcacgtgggccggcggtccactaagtgagagaggaggagtatgggggtatcgggtatcaagtagattttgctctcttgtgggctgaaaaaggcccatacagaaaaaatgatttttatttcaataaatgctgaaatgatatttgtattatcaaaattagcaattaagctatgtaaattccaagaaaatttcaatgagtgtaattaatatagaaaatttaataaaagttaaatccaaccataacattttatttcttacccttactttacttataaattaatttaattatatacctacctacttaaaaaatacccaaatattagaatttaatatgttttaattcaattttatttgttttttttcttttcttgcaacgcaagaccacttttgctataatttaaaagagtgtaattaatattgcagaaaattttatatttcatcaaattataattcattttcttcatattaatagttcaaatcaaatttcagtcaccatatcattagccggtacaacgcacgggcattttgctactccctccgtttcacaatgtaagtcattctagcattttttatattcatattgatggtaatgaatctagatatacatatctatctagattcattaacaacaatatgaatgtgggaaatgctagaatgacttagatcgtgaaacggaagaagtagttaaattaaatgaatgaagaagtaaaattttgaaagatcatcatcgttaccttttatctcctgatgattgatgatgattcattgaacataaatagatcggccgatcgatcgatgtcctgcagctgacgaacttttatctcctgcaccctgcacgtatatatgcgcgcgcggggcaagttgtagttgagtatatattctgatcacgagcgcgcaccggccggcttggaaacggactaggcattaattatacgaatcggagtagctaggcactgctattcacgttcgcgctcgatcggatgcgtctccgcggccgatcgatccaacacgcgtacgtatgcttttcagattatttgcttcacattttaaaaaatatattttcttgtattgctcagatcaatttgtttttaagttctttctaaaaaaagcttatttatcaatatatttaatattttcctacaatcaagtagataatccgtagtacaatactctcgataatttgtttcaaactaagccttaatgttaggccactaaaaacataatactccctccataatataaggcgcacacatattccaagattcaacctttaaaatatacatttgaccaacatttaatataatatgaaacgaattttatttgttaaaaattatatcattggattggcatttaaatatactttcatatggttataattttgttgctagaaactttatagtatatgagaaattataaattaaagattagttttgaacaccgtgtcaattttgaccgcgccttatattatgggatagaggaaataaagaaaatatagtaataataaataattgctagtggatctatacactcaaatgtttggctacgtggattggatcacactcatgtctgaattaaataatagatgcatcccagacaaagagattgttggatttcatgaatcatttagaaaagaaaaggttatgtgattacataaatatatttcattagtccgaatcctcaaaactctacaccctcccgttcggaactatcattgaccattatcactctttatctctctacaccactcatcactgtttttcttatttagcagctattgtctaatcgatctcatctagtctccgcgccacatccgttctctccctttgtcaagctcttctccccccccccccctttctctctgatctttcatctcattctctaatcacactactgtcgaatttgacactgcccaaacatcgagtttatcgccctaccacttgccttgcccatatctttggtggcgtcatgccatcccttcctcactatgttgtgtagctaggtaatagacatctcttaagcccaaagaaaatcccaccacaacacacccccatctccacccttaccctaccctaccacatgctcctcgacaagctaggataaatagtaaggtgaaaatgatttttttgcaatttttttaatcaaatacttagcaaatcccttaaattaaataaatcaaagttaatgaaatatcttcatctaaaaatacgaattagtttacggaaactaaacttgtcatagaatacaaatagccaatatcaatctctaatacgtactcttgcaaggatctaaggttaaaactacttatcacataacaattaatcaacaaatacatattaacaaagcactagatgacacatactgacatagctttaaccttcaaccgagatgagtgattgcacaactgagttcatgtttggccgcttgctcctatcttcctccaagcatgaaatggcaatctcaagcatcagcttcacttgtacatggttgaaatcaccattcaatcgatagtccacaagatcctcaatagatctcttttcattggactccatcttctgacatgtcgccctaacaaccatcctaatatccatctcacataccttgatcccatggatcacccattccgaaatcctaatccccttcactagctcaaggagtatcactccgtaactatacacatcaaccttctctgtaaatggtaagttagtaacccactctggagccatgtaccctcttgtccctctaatccttgtcaaaattgcatctgaaccatctctgtttaacaacttagacaacccaaaatccgtaatcttgggctccaaatccttatccaacaaaatgttctcaggcttcatgtcacaatgaacaatccattctgagcactcactgtgaaggtaagccaaccctttagccacacccaaagcaatcctgaacctttgattccaatcaagcacatcatcatcaaatccatgatcaaacaatctttgtgcaagtgatccattctctatgtattcagagacaagaatcctgtgcttggcttgagagcagcaaccccacattctgacaaggttcatgtgatagatccttccaatcacactcagctctgcttggaactcctcctcactctgccggctcaagttcttgagcaccttcacggccaccaccctctcgtcgtcaagcacgcccttgtacaccacgccggagccgccgcggccgatcacgccggtgaagttcgccgtggctttcttgatgtcagcgtaggtgtacctctggaaatggctcgtgatcagcttgtagccttcttgatcaatggcgtacacccgtgaatgccggaacaatcctttgcttgagaagagccagcagccgaacccgatgacgatggcctcgacgacgagcaacgctgacaagaatccgtacaggtatggccacaccgtcttaccggcgtcgtgagatgacagtgaagaggagacgttgaggagaacctttctgttgctgtcgccggtggcggcggcggcgcagccggcgatgtcttcttggatggcgaggccaccgccgccgccgtcgccgccgcgctgccattggtggacatgaaactccggcacgtcgaagtcggcggggaccttgatgtacaccgttcccggcaagccggggaacgtcttgccgttgaagaggacgctcttgaggtagcactccatgtgctccttgtactggaacaccacgcacgcgcagttgtcgaggcacttgttggcgcagtcgccgagcggcatgacctcgccgtcgttgaggtcgtagccccagaagtcgctgtgcggcagcgccaccagcttcgccggccggccgcactcgagccggaacgtcggcctgcaccccctgctccagtcgctcgcgtcgacgcgctcgtgccccggcgcgcagacgcacaccggcgccggcgagtagaggcacacggcgttggcgccgcacacgccgtggatgttgcacgggttgccgaacgccatccacgacaccgaccacgttcccgtcgcgtcgtccaggctgtacgccctgaggttgccgtccgtgtccagcgtcagccgcctcctgacgccggcggcgccgaggtcggcggcctcgaaggtggtgccgtcgctggagaggaactgcccgagcgcgtccatggcggcctcgcgggagaagttgtagatcttgcggttgttctgccagtagctgaagtaagggttgggccagtagatgctggagaagttgccgttgtcgtagaagagggagagcatggcgtagtcgctgaacccgaggctgtagtagccggcggagagcagccggtcgcgcgacaccagccgcgtcgccgccgtcagccgctgcgccgggagcagcgtgtcggtggggaagtcgaagctctgccacagcgtcttgccgcaggcgtcctcgaccaccaggttgccggtgtcgtggagccggacgcgggcgccgccgctgccaccggcggcgggggtggaggagttccagaccacctcgccgccgtagtcggtgaggacgagcgcgccgcggcgcgcgtcgagcgtgacgcgcgcgcccttgctgtgcacggggcgcgcccgagccgcggtccagacgacggcgcggtcggcggcgcgcgcgaaccagacggagaaggtgaagacggtgggagacgcgtcgtagaagccggcggcgaacgtgccgtccggcgagcgcaggacgtcggtggcgtggtcctcgacggcgatcgaggcgccccgggcgagccactcacgcgccgcgtcgacgcgccgtggacatggacgcggcgacgagcttagcgtgatgatcacaagcaacgcgaaggttgcaaggcgagagttcatcatggcacatcaatcaggatgttgattctgacaggactgagattaggatgttgatttggactgtatagtgattacggttaatttttttgtcacacaagtcaagaattttgtgcgttccatcgcctgggcaccagtgactaccactaattaagatagtaatatggtaatagactagtgttagtgaaagcgatttgacttagatctgagtattgtatatgcataacgaggtgtacatgcacgttgcgtccaatggagtttgtgtgcatctgaactctgaaattctaaacttctgcttaaagaaagctgggtgagaagatagtagttctgttcacagcagtaattgggactacgattgattaatagaattatggggcaatttcatttttcccccactttcatctctaatattgattttgcccctactttttagggtttttgtttttgcccccactttttgaaccgaaaaatacttttgcccctgctttggatggaggagttaacggtgttaaatatgacatttataccctctcccatatctattcattaattgtgtttttgcccctattatgcatggctttggaaaattatttttgtgaatatgtttaaaattaaatgattgatttggacagattttgacattacaattgggacataatttgaatttgatggaattttgacaaaatttcggcagcattttgacagaaattgagcaaaaattttgacaaaatttcaacaacattttacacaatcatatgaagtcatatcagccttgcatcgttgacaataccacacttggcatacagattaatcagggcattgctcacatgcgaattgtccaccaacacaaccttttccgcatacacatgaaccctcctcccaagagcaagcgccccaatctctgcacaagcggttagaacactgactatggtgactccatctggcgcaaagttgacgcccagcatctcccggaagacagtgagaacctcgttagggcgcccgttggccgcaaagctgttgagcatcgaattccacgagacgaggttctgcccatgcaccggcatttcatcgaacaccttgtgcacgctctcgaacaggccacacgcgccgtagagatgaacgggcgagttttggacgaacccgttcttggcggcctcggtatggaggcactccccttcgcggagcgcgaggaggcgcgagcaagcctggagcagcgacgggtaggtgtgcgtgtcgggcggcgcgaggcggcggcggtggagctcgagcgcgacgcacgggcggaacgagcccgcagcgatgcggtgcacggtgttgagggggaacgggtctagtggcccgtgcgggaggaggcgggagagtaccgccacggcgtagcggagcggcggcgcgcggaggacggcgaggtggaagaggaggtgcttggcgaggagcgggtgggaggtgggcacaccggctccggagcgcccgcacatggatctgcttggc

SEQ ID NO: 80336 - DNA, 1328 bp, Oryza sativa
tttataccccttaattggtggacttgacccccctaaactttttttgcaaggaaactgcccatggcttcaccgcctccttcatctaatccttatgagcataccttgcaccctcaattacctcattctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatacaattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctctcctctctctctctttcgttttttttggatttttagtgaatataatgaaatttcagagaggggagactgggctttatagggggaggcaaaaatcgccctcccccagggcggcaagggggcccgctgcaaaattccatgccccctcgccgcccatttgcaggcggccccccgcacagtacaaaattcgccctatc

SEQ ID NO: 80337 - DNA, 89740 bp, Oryza sativa
gactctagaggatccccctcgccgccgttgaagtacgcctccgggttcctcggctcgacgccgtgcttccggcagaagggcacccacagtgccgcgaaccgggccgcctccacgaccgccccgcgtgtcacctccgcgccggcgtcgtcggagacgtagcacgtcaccttgccggcggggtagcccgcggcgaggatggacagcacggtgttcgccgtggcgagcggcggctccttgtcggggtcggcggtggtgacgaacacgtccatcgccgggagcagcgtgtcgtcgttcagcgccgtgacgtcgacggcgcgccggacgggcatcgtcttgggcagctggtcgagcacccacatgaacgcgaaccagagctcgccggcgatggacgccgtccaaaatgtcgccgccttgctcatgccgatgccgccggcgtcggtggagctgatggcgcgagcagcgtaggtgattctccacttgaagaagagcacgaagatggcgatgcgaacaaagatggtgagcctacaagtgcattgtcaatagatgtgattacggtgagttcgtactccaagttcggaactgatcatttcttctgcatgaaaacgatgtacttcctccgtttcacaatgtaaaactttttatcattgtccatattcatttaaatgttaatgaatctagacatatgtatgtgtgtagatttattaacatctatatatgtgtgggcaatgctagaaagacttacattgtaaaacggagggagtagctaattagactatgattaattaaatattagtttatttttttaaaaataatagattaaaattatttgttaaatagacaatcgtattgaaaacttttataaaagaagcacaatttaacaattcaaaaattcgaaaagagtttgctcaagaaaaagagagtaggagttgggaaatagaagtatgaaacatagccttagggcatcctcaatgctttatatttaatagagcaacaagatgaaacccacgtttctatattctttagtttataatgcatattacaatgtatatggtctcttcataactataagatgggcccactaagaaaaaaaaaccttcatccactcagaattgaagtgtacatgcatgctacaaagccttatttttttttaattcttatggtctagctttaagcttaaggttacccttagcactattctcttcttagctcatctcccaatgtataaaagtataacaaaaattactactttatttgataagattagttttcatgtacactgtggttgcccttagtccgtcagtgacccgctcattgatctgaaatgcaaggatccaacatttgtcaaaactcccagaattggagttgccatcaatttttaatagcagtgcactttgcctccctgagacattttaacttgcatgacattataattagaaaaaaaaagcaaagaatacagtgggtcccacatgttagtaacataggggatccattcttctttttttttctctgtcaagcatgtctagaaacactttgcgtgcaacaagaacacatcatcgaggtgagggaatcaacagcaacaagttgtttaggcttaactctgtcattcggtcggtgagcggcgggggaaaggagggcacctgcactgtggtagagagagaggggtggccggtggcagcgaattagatgatggtgtcgggcaggcgtatagcgcgatggtgactcgattgaatccagtgagggcaaaatgtcgtggaagtagattgtggccgcatgaatccaacagggaagacagtgattgtggaggtgctcttgttggtgcaaaacgcgacggtaagaagcaaacagttgtacatgagaggaagctcaagttcatggtgaaccactacattgatcaccgccattatggagggtaacggacacaagctaggaggaacaagttgtgacacagtaggttttacgagaaaactcactacagagagatcgacgagggtggagcatgggatggcatcaatggcggcaacaatagttttcaacgtttgtggccgcgggaggacgaggatggttgcagaagaagaagaagaagcctgcgtattgactaatattcgtctttagaatgaaagtagctatgaagcccaatctactctcgattcaagagagggcatagtcgtatgggtagggtgtttgtggggagctgccttggatatgaggaattcctcaaatctaaaaaaaaaatagaacaaaggcaatgtccgtgacgaagatctttcttttctatcaatagatagaaatgagtattcgttataggggataggatctatctgctctctctctctctctattttctttgatgcaatttagagagaaagagcagtacgaactagaaaaaaaaagataatcgggagatgattaaaaaatagatacatagacatctaaatctaaagtaaagggatgtatatagtattcctatatatatcatctatctatgaaaaaagtaaacagagttcgtttttgggttccccgaagccccaaatggattggatcgtttctgcttctgccaacgaaatgaaggcctcgccccttccgaatgcttcttcgatcctgaagttctcgcgaagagaataagatgcagctccctctccctctgtctttttccgctttgctaatattcccctctaacgtgggccgagccaggcttaggcgggcgcgggaggaagaaataaagtcgaagagtgtcttctcctttgtcctttttcagtgcaacataggaaagcaccctctttttgtaatccctgcagcttcccaaaggcttttttttattgaacgcatggtgtagctaggacctctccaatcatgtttgagcctatgttcacccggggcccaaaaaggagaattccggaatgcctgccaacgttcagataaagtgcatatcccttaccactaaaggaaaggctcgacgaagggggtgggggtgggtgggagattttccggctcgatgaaggggacttttagagatattgagatgttgatttgtttttcatcgaaaaggaagaaggccaaggggatagctgccttccttcagactttgcctgccgacgttctaataaagaattccggctcggcccaggaaagcattggcaacaacataaataaaggggtccatgtagttgctgcgcccgcccactgagtagcaggttcggcatctactgcaaaagagagattgagtctgaggaagaggggggttttcttggggctcgagagattgaatagatagggcctcacaaattgttaattcgccgctggggaattcacataaaagggaatgatttattctcaactaaaaaagtgctctctgaaccgaacatgaaagctgtaagtaagtgaggaggaggcgacggctgcaatgtctttgaggatgaggtcctcctagtacacccgctctctctggccccttcctcctctcgtcctctagtgcctcatccacccactccctctccagaagcacacctctagtattggcgcgtcccaagagttccatcactactaccactaacgttttggcctcgccgaccaccctcatcaaatcctcagcatgcgtgaacgagagacaaagagaggggggagaaagaggtggtgacaagtgggccttaataacggtgaggctggtccatggatgactcaggatagtcaacatgccaacaagcagctaaataatgcattaaaaaactttccatataaaagttcttagaaaataaaaaatcatttaaaaaatatttaattaattatatgctaatgacttttttccatttcattgatcagctcaaccaaaaagcttgagcaaacgggcctatgaatttttattaatgaaacacaatcgtgatgaagacactcatataaactagatgattcccccacgctgctgcgggaattggtataaaacttttgtttgcaaatttcatgataagaaatttagaaggcattgggtatatataaaaatgctagctataacttaagtcaaaatagaaatacacaagattataatttataaaaaaaacttgacatatagaaaaacaaagatgatattatgatagtatatatgttgatagcgtgaataatcgattattgaactgtcttgtcttgtgatcgaaacagacatgccctatataggcatagttcatttttctttaatataatttagagacaaccataaatgtatatgctagtctatatatgatatatgttcattaattaagaatatatgtacacaaaattaaaaagaatatgatttggtaccataccgtttagcttcatgcatggcatttggtagtctattgtttgcttggttaattgagggttgcatggttgtgcataatggggagaaataaatgtacgggatgagtcatgtatcactaagagaaatttgagccaaccaaaataaatccaatggtcaatagtagagtgactttgggatgatttgttatacgttaagtttggatctaatggacatagatatataattaaggtgatgtggaagcaccacatgagaggaaaattgtaataataacactaagagatcaattctataggttatatagatacatatataataacccttataaacatatacatacacacgacacatatctaactctacgagcaccttcaaagattggatcaatatatatgttaatagtgtcgaaatcaccacaaacgccacatcacacaaaatcatactcaaaacagccaacgacgaacataatttctctagttttttaaaggacttctttttagacgaggccaaagttcatgaaccgaaaacaaccactttaattatttgttggttttcgtagcactttgctaagatataattaagttgtataaatatgtataagtttttggttcaccataaacatgatgatctgaaacacaacattcgtgtgtcgtaggtgcactactacaaatttaaggcacctacaacttgatggtacactcatatatgtatatataccctcacctgtataacttgatggtagttgtcgagatgcgagtcgtccggacgagcggcgccctctcgtcgccggcggccagcttcgtctcggactccggcgacgccgccgcggcataggcatccttcttggccgggcatgtcgccgccggcaagctctcagtggccaagcctgctgacggcggcatgtgctctctctagcttcaaatatattcctaatgcattcgaaagtcccagtatagggctagctagcgatttatattcgtgcaaaaataatgcgttatcacgtacgcattcatgcacacttatcccctgtacatgttgtttttttaattattcataaacatatcctaccttttgctttggctaattaagtggcggcaacttttaggttcttgtgtcatgcaaaatgttaaacaagcatagcctagtgttgatatatttcccaaatttaaccgaaagaagtcaggtgtctcctttggaacatctagaaatataggcgtatatatagtatatgattgtctaattttgagctttgactccattaaaaacattttgatctttgactaacgattaatccaataaatctagatttttccataaaagaatgataatataattcttcttagttattactatgatttcataaccatataagcgaaattatataagagaaatttatgatgaaatattcctttttaggacagtcaagagctataaatgaaatgtgacgtatatatctgatattccccaaaacagtctgtataggtggcacaattgtgttttgtcgccttgtcaaataatttcacccctagagataattaaaaggtctcgcatgcttaaatattgtttcttctacaaaatatgaaaaaataaatataaagacggttttggccgtctctattgatcaccactatctcatagacatggttagtaacctgtctagggcaatggtaataccttagagatgggtcttagaactgtctgtgattacatattataaaacatctctgatttgtcctaatataagtcaaacttctttatatatatttaactaaatttatagactaatttagcaacatctggagagatggaaataaaacataagtcatgtttgtcctaactcgtataatgtgtatgtacacatctccataagacatataagacatgtgatccactattgaaataaacataacaataaataaaggtgctcatgaaagtaaatatacttcaggagagagagatatatgaaagggaaatagagtgtgggacttagatggtatgctgggcccacatggttgtattttttgggttggtgttggtactcacccagaatcatcacctagcatggaagatgttgcaaatattattctgaatagagaatgtctcgagctttactacgacctatatagatgaataaatatgaaaaaaaatataaaaataaagtagtgattataataaattataaatgatatgagatgtttgtatgagttttaagatatattttttattgaataatgatgaggcttgtttgcatgttaagttttaatgggttgtagctatatgtgtgtagtgttgtatcaagttctcttcacttggtaatggtaagcaagcacactatataatcatgcatgctgttagttgtagatccgcgtaattagtttaatgcatttcttgctgacgatcgatgcatggaaacagatggaactctcaaagtgtactaatgcagaatccactttgcatctcaaagtgtactaatgcagaatccactttgcatccaccaaacatgcaactggacttggcaaacacatattccattcaagaaacggaagagccttcctacgcaccgtccactgatcatcactactcttgctgacagaaacaaacgagatgcccgcactacaagaggaaccccctttagtaatacatatatgtattgctaaaagtctctataagtattgctagggtctgcaccaacgtatttaatatgcgttgcctatgctgccgttgctaggatcaattacaacacatagacaaccgttgataacaagtggaaataagcgttgctacttagcaacaattttaataggtttcagcaatacttatatatgttgttcccttgagagatgaacagttttatataatcttagcaatggatataatcaagttgctgcaacatgtacaaatattgtaatttgagctatccactgtaggtggcctttgaccaattattttgtcaggcaagagacccatgaactcaaagcatgcacaagtgacaatagtccaatcaatcatgataatcgattatatattaaatatagtattttgcattacatagacaatcatcagtataattcatggcattaaacctttgttcagaacattaatgcagaaaatagaatctaaagtatataaaaaaaacacatcttgttgcccccattctccaccttgcagccatcatcattccgtgatatgtacaggtgacctagttgcgtactggcagtcacgaaatttcccccacatcttcacccatttatcttgtcaacctataatagaaaaaatatataagcattaatataccattatgaagacgaaaagcacatctccgaagaaagaagtaagagataggaacatacaaaaattgcaggctacgcaatttcaagtcctacaacatgaccaacaattttgtagcctttgtatggcctaatcaaatcttcggattttgccaatgcaagatcgacatgaaccattaaaaattcatttcctagctcaacacctccaactctgtgtgttggatcacagcttacaatagtggcaagagccacgtttgtattccgatttttccaactttttaagaatactttagttccaacctgaagtgcataaatacatccatcaatattatcaatgtactttaagaaattcaagtatcataaataatttcacagtaaaatacctccattgaattgtcagtgataaagtccattttgttgcactgttgtttctataaaaaaaatttggatcatggtttgcaatttaaccacaagatagaaagaaagaaagaccaaacagagccaattattgttctccaattgaatcataatactagtgaatcatgcatgttatagtttgaatggactgatatttgtaaacatggtgaataaaaaaacaaccttgtatgcaccaccaactttatgtgcatgtaccatatggctttcctgattgtcaggtttcttgttctataggggagggcaacaaatcagtgctaaaattatatatattaagaaattttactttcaaacttttctatcaaataatttttgaactaaataagaagtgaaaactaaccttggcacaaataatctccatctgtttcccatggtcatttaggccaaaggttcgtttgttctagaataaaagaatacatcacattgtcatgaactatagtaaacattcatagttagttacaaacagtaccaaataatataatgctatgtatccatgataaccatataataggatgcaaccatggtgagttcagaataaaaatataaattgaaagacaaggaccttgtgtgcagtagcatgcttggttggtggtgtcttatcctcatcttgaacatggctttgtgaattctgttgtcaaagagagcatatattcccagttacaaaatagtgcaactattcccatgtataaaacaatgaaatttatgtatattaccatcacaatgttttcctgctcaacatgacaaatttcttgcaagggaccgtcaccatacactttctatcacagtggaaaataaaaggacattaagaccagattttattaaactatttagactaaaatgttagcaaggtttaccactgttgaattgtcagttaaaaagtccattgtgttgcattgtcgtttctgaaaaaatagagagaatttacagtaaaaaccaacatgctgtgtgtgctattttagttgttgtgtagtgttcaataaatagaaatagcattttgaacttgaaacaattagactaaccttagaagcagtactatacttgtttaggcttggtctaacaagcttgcgggtaaggttctctttgttctgcaatacacatgtgtgttatagtttcaaagagcttatatctgtagacatggtgacttaaagtgatgaaaaaataaccttgtgtgtacttgtaactttgtgtgcattcaccatatagttgtcctggttgttaggtttattgttctacagtggaaggtaacaaataaattttacaaatctatatatacatttatatatcgaaattaagctactttcaaacacttattgactatggcattgagtttgaaaggataaagagagaacttaatcaacttaccttgtatgcactagaaatactcttccctggttgcataagctcattctggtccaaatttcctttgcgctgcaatggaatagctcataaaattggcacaaactataatgttccaattatttgtttactctgacatcatgcactccaattaataaaaaagtgaaattaaccttgtttgcacaggaagtaatcttcctttgcttcccactgtgattctggcccaaagactgtgtattctagagtaaaagaaggcatatgattataatgaatgctatgtaaataatagtgaatatatatatatataataatattttaaatgcaaaggcaaggaccttgtaaacagtagaatgcttggttggtggttgcaaattctcatcgtgcacatggctttgtgtattctattgtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacataccctcctttttgaattaggtacgtcatcacaaatagcttttttgtttgttgacgctccatctaaacctccctgttacttcaattaggtaagttagatgcattcattgggtcacacacaagctcatataatttttttaggactcaactcccttaaattcacctgattcttttgtgccttttccaacttggttgccttctcttttaattgtaaaagttcagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctagttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtggtttcttctttgcaggatctttttgtctctatggaacacatgaccaaatcagtaaagtcttaacagtagctatacatgcttgaaatggaaatagatgaatactattcaagacatgttttaccatctcttctcttgtgtgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtacatgtaccttcgatttctcgttcatccaatgattgacaagagcaatccactggtcagaaagcacaccttctaggacattgttgcaattagcttccttagtctcattcacatcaaaatacaaatcttttagttttgctttatattgccaccatctttctacaattttttttaatatgaactcttccatccgaggagcataaaggaatctcatctacatatagcaacacagaaactcatatggccatatggggatatgcataacataatacaagaagttagcaaaaatgttgatctgaaaaggaattaccttacttgcttaagtatgtcctttttaacttttagttcatttgtatttttctctctctttcctattacatatctccagtctgtgtagcctaagctacacagactaccattcctagctaccattccaagaaatttacccaaaattccagcttcttcccctaccgcctgattgagatcattgcattgaaccacaattctaagccctttcggaaggttccaaacatctttcagttttgtcgaaaggttccaaacatctttcagttttgtcttgccacgtgtttcaggtgctccattttcaactgttcggtgttaaattgcaaagacaaaagtgatccttagtaatcagggatacgagtaataatgtcattatttcttaccattaggactgttaaacttagcagttacctcgaacattaatatcaacatcagtatcttcattgctttcatcatcaatatcaacatcgtcattagtgtcttcattgctttctccatcattgatatcaaaatcgtcatcagtgtcttcattgccttctccaaaatcatcacatacagtttcttgttcagatggtgtggcaagctatggaagggtattttcttcttcagtctgttcctctgacaaatattcctcattgctctgaacaatacgccttcttctactccttgccatatctcttgcacccaaaaaaacctatctgtcatttatggcgtcgaaagtatatcattctcatttcagaagtaggactgtgctgtacatagtttcagacagaataatttcagaattgattataccctgagccattttggatttgtttttgaagaacaacagagtactgctgtcccaaaagtaatgctataatatggatctgtttgtcatactcactaattcatttgtccattttataggccaacaatttgaaacaagtaatgggtagaaataacaaaatttaattggctgcaaggtaaaactagatcacatattgtattgcttacagttgtgtgaagcctagccgtacgtagaccaggctccttcagctatggacggtcagtgcatctgactccaaacctgaaaatagaacacatcaaattggtaagtattgtagtactggaagggaattagcctccattgcaatttggcgactcagagaggtagtaagatgtgcagagggaggcagagattccggggcttggaaacattgccgccaaccgcgcggggtggagcagagcgaagtggacagccggtgtcgggaggtataacccgcatcaattgcagtgccccggtcacccagcacatcggctgggggcgtctccggcccgccgcatgccctacgtcatccatgccctacgactggatgaaattcggacgtaacatattttggttagttgtttaatttatctaagcatgaccgaaaagacacgtgtttttccatggccaatccggtccggacagaccgcatgaaaaagacatgtaatatatttttggtcctaaaatatagttatttaaaaaatgttagcacgataaaaaaacacgtgtttttcgttgtcgacccggtccggacagaccgcatgaaaaaatatatataactaaataacagtgatttaatattttaggacaacaaaaaaccacatgttttttcgttgttgacccggccggacagaccgtatgaaatctggacgtaaaatttgtgttaaaatagtagttagttaatttatcatagaacgaccaaaaaaacacgtgttttttcgttgttgacccagtccgaacagacgggatgaaattcggacgtaacatatttttgtcttaaaatagtagttatttaatttatattagaacgactgaaaagacacttgtttttccattgtcgatctggtctggatagactgcatgaaaaagtggcataatatattttaggtgttaaaatatagttaattaaaaatgttagcacgacaaaaaaaatcatatgttatttcattgtcgacccggtccggacagaccgcatggaaaagagatgcaatatatttttggtcttaaactatagttatttaaaaaatgttagcacaaccaaaaaatcacgtgttatttcattgttgacccgttccggacagaccacatgaaaaatatatataattaaataacagtgatttaattttttaggacaacaaaaaaccacgtgttttttcattgtcgacacaatccggacagatcgtatgaaatctgtacataaaatatttttttgtcttaaaatagtagttagttaatttatcatagcacgacaaaaacacgtgttttttcattgtcgacccggtccggacagactggatgaaatccggatattctgaaaataagttttcaaatggtttatttttaaaattttaaaataaaaaagttcaaaaaattaaaaaatttctggggcaacagaattttttttcccgttcaaggagaggaaaaagtttttaggaattgccactagagaaatgaaaaaaattatgcatttgctagttctcgaactagagttgtcaatacagtagaagaagctaagtaccactaggctatgtccccctttatttattttttcacgttagctgcaattgagaatataaatagacagaatataaatagacttctccaggtatttatataagatggaaatttaaattctgttagcacgaccgaaaaggcacatgctatttcgttgtcgacccagtctgtacagaacgcatgaaattaagacgtaaaatatttttggtcataaaataatagttatttaaattatatttgcaagaccgataaaccacttgttttttcgttgtcgacccggtctggacaagccgtataaaatcaagatgtaaaataatttttctttaaataattgttatttaatttatgttagcacgaccgaaaaaccacatgttttttcgttgtcgtctcggtccatactgatcgcatgataaaatccagacgtaacatattttgtcctaaaataatagttggtgtggccaaaaatatttatattgaaaaaataagttttcgatcagtttaattttaaaattaaaaataaaaagttcaaaaattctcgttatctagccagctaagaaggatagggaaaaaaaattaggaatcgcccctagaaaaaaaataaaaaaaatctaggctggcatatttgttttcctcgttatctagccagctaaggagagggaaaaaaatttaggaatcgccactggagaagaaatggaaaaaaatgcatttgttaggatttgaactacagtcttcgatacggctgaagaagccatgtaccaccaggctatgtccacttcatgttggagttgtccgttcgacttacttattcacgttaggtgccattgacaacgtaaatagttttcttatataggtggaaatggaataacagaacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctcaatccaaaattactgccataaaaataaagtgctccccaagtgaagatataaataatataaggaaatcattgataatggacagatagatagtgaaaaaccttcataacctcacctttaattagttaccatgttatcgacagttgttccttctatatctcttcgaatccatgtctgaccatcatgtgcactgtcaaatagctccccaagattattgacatggtatggttcgcattccacatcattccattcttcgcccagttcaaatacatctctgggtttcatattccttacaatagaccaccctggatttaaatggtcttcaatgtaaaacacttggttgacttgatttgcaaatacaaagggctcatgctcaatcttttcaccggtatgaattttatttgagaaattcacaagtttgcagccaaacttatctattttcactcattttcctttagttacatcgacccattcatatttaaacaacacaactgagaaatttccatagtagtctaacttaattatatcaagtacccttccataatacatgatatcaccaaggatagggttagtatcactggcggacgtgtagctcgatgtttttacagtcacaacaactccactgttttgagtcaccctggcataacgctttgatctgaacctatacccatgggtattgaatgctctatgtcgttttgctacctcaattggtccacgtgctagccatctaatatcctcatcaatactatcgatacctctttgattctccaactgcaagatctacaccaaaccaaaagatgtattagtatttgaaaaagagaaacataaattttgagacttacataatctctgaaccaatcagggaattgttcattttgcatgttctcaatgttttttggagttagccttttgcgtttcttcctttgcaaatcagcagcatgttctctgcaaaacaaataaacataaatttgaagcaaaacacttacaacacataaaaaaaggctatgttaggacaatacgtacttcagatatggcactatagcatcacagttgtatagcacatatctatatgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagagaaaccttccaagtatcgcgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgacttcatcgggaagaatacccctcaaagcaattggcatcaattgttgcattagaacatggcaatcatgtgttttgagcccatgaatttttccttcagcagagttcacacatctagatatgtttgaagaatagccacaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgaacttggagattatcctttgactttccttctaaatttagaagtataccataaatattgtcgcacacatttttttctatgtgcatcacatcaagattatgccgaagaagattgccatcccagtaaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttcttcccatgtgccaaacgtttggaccatacatttggaccacaaggcgggcatgcaaattctccatgcaccatatgtgaagcaagcattcctaaagttggcaagtcatttatagtccacagtacagctgccctcaaattaaaagtttcatttctaaatgcatcatatatggaaatgccattgacaaatatgtctcttaaatcttctagaagcggctggaggaaaacatgaatgttatctccaggacttttgagcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgttgtttctctacacatgaacaatcttttcagcctctcctttattggaaaatatcataagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcacttcatttgttcatggatttcatattgaacaaaagcactagcagagataagtgtgatagttcacatccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatctttgtatcctctaacttatctttatatgcaaattcaagaaatccatctactccagctaagtactcaacagaacctctagggtagcgcaaaagaatcttgatggtttctaaatccatttcgacctatataaaaaatttgatatttcaggttcttgtagataataacaatgacaaggaattgtctcttatgatcatgacgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgcgtttaaaacctatgttccaaatatccgttcggatgaacaagaaaaatctgcaggtgttattaaactcaatcagatagactcatgatgcaacaaacctgaataattaaaaaaaattgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgtgcgctgccgccgccgccgtcggtgtgcgccgtggcagtgatgtgcgagagcgtgagaagaaaatgagatgcggtgtgggaacaggatggggcggcgctctcgtgcgtgttgggtgaggtgagagacacgagaggagaggagagaaggtgggagactaaggttgcctgctaaactgctaatttcacagatcgtattttagttgttatgatataaacaactaaataaatcatttgataagaaatgtgattagctcagttggttgggttgcgcatattctatcctagagacccaggttcgaatcctctgtttgcatctttgccccactaatttattcctatcaggtatcagcagccacttcgcttgtggaatttttttaaaaaataaactcgcttgataaattttttagaaaacaaaaacaacacttttcccaataaactcgcttgataaattttttagaaaacaaaaacaacacgcccaatacacaatgtaaaaaaacagctcgctcaattattattattttttaaaaagcatgcttagtccaaaagttttaacaggaaaaaaaaagcaactcacttgataatttcttttaaaaaacaattcgctagaggtccgaaatgtaaaaataaatatctcactcgattattttaaaaaatacaataagttcgcttattccaaaagtttttacagggcatcaagaccattgcaaattcagctctgcaacccatgttctgcaacacatattatctattacaaattaggctcacccactactaagcgttgctagggtcgcattttggcaatgcatccttaatgcgttgccaagcatgtattgctagagggggttcttgttgtagtaacgcatcagttatcaaactaacaaagtataagtaaaatattactacgaaagaacatattgacaaatctattaacttaataaattaacagaaaatttagccaccatgtcctctcacgacttagaaattcccacaattaatcaagattaaattacactagtggaacaataacttggtaggtgggtatgatttagtggaacaacttgtaaaatgtaaaaaaaagtataaatttggtaatcacgtgcattttgataaaaacactgttacatatctatgattcatcctattaattttgttgtttgtattataagaatatgtttcgtagtgctcatcatcggaaacaatgaatatttgattagtcaaatcgcttgaaaattatattagtttgcacttagttttgacggtcattatattttttcagtttcaattcgataggttgtttcattattataaccatgcaaatgcaatacatttagacgcttgtcgagaactcgagatagcctaagtggctgctttttctacatcaacgtaaggttttcggtaggatttttcgtccgtccctttttttcgcatttttttctttttttcgccgctttttcttaggttgatcgagaaatattcaatcagattttatgggatgattggtttagcatcgtacggatattcaatcagatttgatgggatgattggtttagcatagtacggatacgagactgtttccagatattgaagacgacaatcggttatgcgagctaggcctaccgctttacatgtgggctaggtcaaatagagacaatgcaactgctttacttgtgggctaggtcaaatagagacaggccaaacagaggaaggtaacgggctggactaggagggaggtaacgggcaggactaggactgaaaagaggaagaaagacccaaaataaagagtataatgtatgctatacacaattgtttttagccgttgcaacgcacaggtattttttctagtaataaatagatagatatcaaaaatggcaaagtgcacaaactatttttaattctaatagtaccaacattgcaccaacatcctaatcctaaatgaaaattgcagaaagggctaaatagttaaatataaattcatagctaaaatagctactttggtccaaaacaacccaagaactgcttgcgaaacgcctccttgaggttctgccgggtgccgctcttgcatggctcatcgtcattgtcgacgctgcatttgcagatcatcatcaggccatgcaggtcatccggcccgagctccgtggacatcgtcgccgccgccgcggcctcctcgacgacggcgacgtcgcagtggatggcgaactcatcatcggtgctggaccactggctcgccaggacgtcgtggcggatgaacgtgaagcagcagtactccgccttcccggtgccgtggaacgacgtcgcgtagctcctcacctcgttcgtcggaggcacgcacggctgcagactgaccatgcggaaccggacgttggttcggatgccgccgccggcggcggtggcggtgccggggtcggcggcgtggagcttgaggcacacggtggagtagccgttgcccgaatatttatttgctcgagttggggtggaagaagaagctccaggtgtgacctgcggcctggaacttggacgactcgatgtcgtatttgctgccttggtgagatttcttgatcgcgttgcgtattttgatcttgagaaagttgcaaccggaggtggccgccgaagtagaggtggccgtcgacgcggtgacgacgtcctttgtcggtgacgacgacatggcaagctaactagcagctacctggtggtgtgatggaaataacatgcttggagacattgatcatttcatcaatttaaatgcctaatgcttagccgcacgatcagcatgtgttggatgaaaagatgcttgcatacaacaacatctgctgatcgagtcaatcacctgaagacttagttctcacgtgaagagagaacgtgtgcttgtggccgtttggcggctgcgtttctcacggagccgatccggctttgacgcggaggagcaacggattgagcgtgggctgctgttcagtgttagctctatataggagtcaaggagacgtccttgaaggatacagaacacaatagccatctactctgaaattcctctactgccgccgtgttgcgtcgccgtcggtccaagccggccgttgtgctcgtcgtgcaatgagcatcccggtgagcggtgtctccgagccttcgccgcattcgcacctgcacgggggcggtgtaaaggtttctgggcaacgtatttctacgcggccgctcgacatcatcgattgactgcactgcttcgactcgctgatctccgtcgatccattcagtgagtgaattctttcgtttacaaaggaaaggaatctagttttgatcgtacctgagttttatatatgcatggtactgttcatctagattaaaatattgtggctagattaccattgtgattagcttaatgacctacttagcttggttatttatgccttgtttgatatctagcatgatagaatttatgagtttttcttgtcctatcatgtcgcaagtaggttatgcttgctgtatgtgctttcaaataataatgcttggaataaaattaatggctaagtatgtattatttccaacagtggtggtggtggtggtcgacggcgagatcaatcggggacgaagaactcgatgcagggttaacgttggttaaatagattataggagaggtaattaaccacacgtttgacgtacgtacgcccggctatatgccctatccgtattgtagtttggttcggatcatgtatagaagaaaattaagcctggtaattatattagtagtatatctttatcaacttcgataaagcagttgttactgggatatacgtacgaagcagttaatatgcaacacaagttactacagctattaggtcagttaattttagttgggttccgatcggatgcaaaccgttacaaacagttacgtttagagacgggacaatatcaggttgttacggtagataggaatagttttaatgtttccatggtacataatccataatccatgtttgagtcggttataaaaattgaagatgttttttggttcgttatacgtgtttgagtcagttttaattttatgttttggttttaatctatatgtcctctctatctctctcttattataaaaattgaaaatatttttgcctattttagtacgtcgtctgtgtaagtttttaagtttgtttgcttttggaaatacaaattgaagatgtttccgtgattcgtcatccgtgtttgagtcgattttaattttataatctatatctcttctctatcgctatctctatcttttctccactattataaaaattaaagatatttttgccggtattttggtatgtcatctgtgtacgagtcggtttttaagttcatttgcttttggaaatacatatccatatttgagtcggagtcggtttttaatatcgtttacttttggtaataaagaaggaaacataaaaaaaatctgcttaaaaaactcgtatgctaatttaagacgatcggactccgaactgcagcttatgattttgtaaaagaaatataaatccaagcgaacttcgacagtgaatttcatcttaactaaaccatataacaattataagattaaaatagacttcacccgttgcaatgcatgggcatttttactcgtggattaaaaagtatggtaccgaagagatatcttttaaccagaaagtacgtactggataagttattacactatatatatatatctatatctatatatgtactcatctaccaagtttatatagtgtagacgcaaactactcactaataaaaaaagaaaacaaataaagtccaactatatatgcaatttaaaatatctcacattttgaataacaattaaaataagagtccatgtagaaattctatttagcaaaaactgaaattgtgattaaaaattaagaaacaatgaatattgagataaaaatccatgtagagatataatttagggaaaaatctgaaatgcagattaaaattcaaaaaataagtaatattgagacaagagtccatctctaagtctctctgttcctaagtcctggttcccaactccctccgcctagttttccacgcgcacgcttcccaaaattgctaaacgatgtgtcttttttaaaaaaatttctatacgaaagttacttaaaaaatcatattgatctatttttaaaaaaatagctaatacttaattaatcaatggactgctccatttttcgtgcgcaggagatgggttaccacccattccagtgaacacagccaaaatacaatttaggaacatctaaaattaagattaaaaataaataatattaacagatatagtccatctcaaaaatacaatttacaaataagtaaaactcccattaaaaaaatattatggcgaaaagaattcatgtgcaagtacaatttcgaaatatcttaaatccaggttaaaataaataatattaagagaaagaatccacatgtaaatataactttaaaatatcttaaatataggttaaaaataaatattatagagagtccacgtagaagtaaaattttaaaatatatataattcaaataaaaaataaacgtaatagagaaaagagttctggcagaggtacaatttagagatatttcaaattcagtttgaaaataaataaaattaatagaaatggtccatatagaaatataatttagaaacaatttgagctggagttaatattattgggaaaagatttcatgtaggagtataatttaataatattttaaatctacattaaaagtaaataatattgacagaaagagtttatatttttttgaacgactcacacgagacagtgcgaagttctattgatagagcaggaaaaaaattacaagactacaaccctggagggtcataaccaggaaaaaagaaaaaatataccaccacccacacatcgacatcgccaacacaccagcccaggagaagactaccaccggaccggacgccgctaagcgtgaccgaccgccactagaccaacaaggggacacagacggtatcacccctaggggatgccaaaacgacgtcttcaagaagagaagcgacggagaaaccgccgccgcagtctatcgggactcaaaggagacaagactgggctttcacccggcaaccaccctttgaggggtgagacagaacgacaacgccctcaggagggggaatgaaccatcgttgtcggtctggcagaggccggactgggttttcacctgccgctcaccacctgcgaatccacggctaacgcaccgatgctccaccaccatacaagctctaccgacatgtggggcccctgcaccggcgtcccccgccggccagccttcgagcaccgaagaccgcgccacacccaccgacagctcctccttacacctaggtcgcctcctccaccgccagccgcacctcccgcgccaagccggcctcctccactggacgcgcctctcgcgccaatccggcctccctccatcggccatgcctctcgtgccaagccggcctccatctccaccgcccgcgcctctcgcgcggagtcggcctccgctgccattgactgcgcctctctgcgccaagccggaatccaacccctccaccaaacgatgtcgcgccggccagatgcagccgtctgccatgccctcggctagccgtccgagtccgccatgcctccggtgaccgcagacgcggtcatcaccaccgcagccactgttgccgaacgcccagccacctcgccgtcaccatccttacctcgctccctactcctttcccgcctccattgctatcgtcagcgatccgcatccgccaacgtcaccaccgcctccacggccacggccgctgtcgccgctgccaccgacgccagccatcggctctgcaaaccgctgcgccgccaccctccgccaccaagcagccagctcgacgtcgccgccatgccctccgccgccgtcgccagccgacgctgccgccgtcctcaccgcgagcagcaaatgccgcgagcacggccgccgccgctgtcgccaactgccgctgcaagcaccaaatgccgcgagcaccactgccgctagcaccaccttgagcacgtgttggtattttttaacgacatcactagaaatataattttggtatattatggttacagagttcatccgcaagcgcacgaatataccattgtagcatttcacccgagagtattccaagggtatcgtatttattttatcccgtggaaagatcatgtagagagaactcaactaataatttatatattacttgtgataatcatattctaaacaggggttaagataatccaagggtagagtgacacacaagcattactactcatcctcataataatttatctaagctaagtggaaagaaaagagaaaagaaatctactcctatacttctagtatacatgctatacatacattctagttaactgatttactagctaataccctctatccgatgccctcctggtactttgagaagccacccctgattgccgagttccttacgacagcccgtcatgactatccaaccagggctaaatacggaggaataccctccccaggaaattaacttaggattacatataggcgtggaggaatacccgtactgagctgtcaccatcagcagcccacctctcatccgcaatatataaccccaaataatgatatcccgtaatctagacaccacgtctaaactaccagatactactctaatatcatcgtcatgacatagagtaattgcataagcaaacactatacccgcaccaaagcatctcccagataagctaatcgtacattcagtataacatgaacataatgtaaataggtactcatatactcggaaagtatttcaataccataaatgtatatataagagtattctaataaaagtacaaagcttacaaaagaggaaaggaaagctgctagagctatacacgaactcttctgaaggcttccagactcctgactcctattctatttctattccaccagttagatactactaaactaaacttgagaggaaagagagagctcttgcttgaggtgtgtgttgaggtgaagagagtgagctccttatataaaggtggttatgacggttgtggaaggggaattgtccgaagtaccccgcaaccgccatcaggagaagatctggagcgtccctgccaaaccccacagccaacggtggagaaatgggttcggacgaaccaccaggtgcggccgaaccatcaggttcggccgaacctggggctggctcaacgagcccacaatttggctggtggcctcctggacttctcttctccacagacttgtgaattttggcccagtttgtcgtgtcaattctgagttcttggcccattcatacacaagtctgattctcgacatcgtccgattgatttatcatttgatttgatgttgattctcctccattttattgttattctctgcaaaaggttagtatacctaatactagtggaatattattgctctcatatttttgcattgcaagcatcactagttctctcctattttagtaatattgacggtagaaactgatcgataccgaccgtcagcagcacaaccgccgccgccgtctccaaatgccgccgcgagcaccactgctgcgaggaccaccacgagcacgatcgccgtcgccgtcgccaactgccgcgagccccaccgcgagtaggaccgccgtcgccagccggccaccctccagaccgaccgagaggcgcggatctgggggacatcgccgccatcgccgccatcgccaccaccgccgccatcgccatccccgccgccgccttcacgtccttagccaccgccgccgcctgcgcgccctcagctaacgccatccccgtcgccatcgccatctccaccgccttccaccaccgccgcccagcaccacgtgcccctgccttcgccgtcgccctccccgctgccagttgccaccccgccagatccggctggagcggcctggatctagcggccaccatcgcccgccgaggacggctcccccgcccgcccgaagcgttgtcggtgagaggcctcgccgctaccgtccggccgcttgggcggcggcgaggcggagggggaggagggggaggaaaggggcggctgggtttccgcctcccgtgccgcccgaggggaggacgacgcaagaggccttgtgtcttgtttgctcatattaattgggaagcagccaagcaggagcatatgcacgaaatgctaccactggtgacctatggcggcaggagaggaacacacaactggctaaggccaactagcatggtgaaggtcgctgccagtgggattggaattgggatcctctgatgtgaagtcagaggaacgtggtgactgacatgtgggccttagtttatgggcccaccggtcgaaacatgaattcggcaataataaaagcgggtagcgcacgagacctaaaagtggatggatgcggagacaaggatttagacaggttcaggccctctcaatgagaggtaatacgctactcctgtttggggatttgaatccaccgggtgtagtatagatctgatgatcaggtgtgtcatgccccctagagggcctcctgcccaccttatataggatggggggtaagattacaagatagaaaccttaaccaatacggtatcggtttcctaaatctattttacaatattatcaaatcaagactttaggccgctccataatataaaaggaaacgtaatacccaagtcatgatctgttacatattccatagatataagttatcccctatgactagtcggataaccatgccgtgtgggtatagggtacccataatctccacagtagcccctgagaccttcacagtcgaaaagataatattctctcaaactaattactccaaagccgagtgcttcaatcatctttgccatggtctcccgagtacttttaccaaatctaaagactgtggagggttgaaaactaaagtcaggtgcatcgactagatgcacctaataggtgtagcccccgactatgtggttaattaaacaaaccaagcatatagtcaaggaataaataatccaaccaaccgagtggtttcgataattgtagtcaaccaagcgacttgatattaatatgtagcatatgcggtgtgaatccccaaataatataatccaagtgatataccgacttctttgtaaaaattgatacgagcaacctaaagttgactacatcattgaaaattcacatagcaaaatagctataaaaaagcttgaatgctatgaataaagaaatttccaaagtatcaggcatacgccatgcgcacactgctttaacagatatgcttaagtccctaaaagacacatggtttcaccacactcggaaatatacggcatatatggtgtaaaatccgagtaaataaactcataaaggatttaccaaccgcctggaaaatgaccaagatatataatcagcctaagccataatattggtcaataaaaatgcacacttacgtggcaaaaagcaatgatattgtatccaatcaattgcttaaaaacccaaacagcaccttgacttatataaaaaagtcagcggggcagctgtataaagctttactgtttgacaccttttaagatgcataataacaactcctaaaaatttgagtaactgcggtataaaaggattttaaagcattgggcacttgatcacgcgcactttggcctaagcaaaaagtgcctaagtccctaaaagaacgtgacaggccacacctgaaaatatgggctgcagacatattaagcctaggacaaaaaatatgccttcgaaaccctttaaaggatgacgcatgtaacatgctcccgagtaataaatcttccgggttatatagaccaagtgtagctcgtatgaatagcttctgatctgagtgattatcccttataggatactccaaaatagatataacaattgaatcccgactggcgcaagtattcggttgataacccttacgggaaataataaatagtccagtctttgagcatagaaaatagacccatgatcatgaattcatgttgcatgtatccggaacaagtccaaattgaaggtatgatacttgtgtttgagctaataagcccctgagtatatagcttgtccttttgtcgtaatcataattgtccattgatggtagctgacacagttggcatagagacaagacgaccaatatagagataatattgcccaccagaggtggcaaaaatattggtggtagtgaagatagtgataccaatcaaaagtgatgaagttgcacagccgtggagatgaagaaaccagtcggcaacaatcaggtcagccaataatgaagatgaaggcgcccagagataaagttgtgtagccatggcagcgaaataatcagtcggtgacagacgaggcagatcaaagacgatgacgaaatccaccaatcatgaagatgaagaaaatagtcggtgacgacaaacgcaaccgacaataatgatgataagcagcaacagagatgatcgactatgatgacgaagttgcccatcaaacagcagtagcataggctatgttgaagaagcttgacaggatattgatgaagatgacgatgtcggtgatccagtcaatagcaatgtagcaaccaatggtaatgatgaagacgctcatcagcgtttgcatagtagatcaaccgtgaaggcgaaataacaagccgacaatgacggaagtaaccggaggcgaggacgtagtcatccattagcaacggcagagatgtcacggccgatgaagtagaggtgctggtgatgaagtcactgacaataatccatcaaactgttgagaagatatcgaagcttaagtaattttcttgatgtgtgtataatgaagattgatgcaacaccccttgatttgtaaagatggcagtagaacttggagttgtagctgttgcagatgcttcacttaaaggaaagtaaatgctgttgtccaactcatcgaaactgagctgattggttgataactctaaactcccagacatgtagatagaatctcaaacttgatacttgaaaattttggagtagattgtggcagcgtggagaagccaaaattgccggtgaaatcattggagctgctgaagtagaacacttgctctgaagcgaagacaaaacttataactcccgaagtagattccatagaactcgttggctgatttcagagtcttgtatttgtgtagcccccgactctttggttagttggaaaacaactgaacatagagtcgagaactgtagcttcttgtcgtcgagtagtcattgcaatcaaaagtgaagatgcatgttgaagatgtccgagtaaaaatattgaagatttgaacaccacttgttataataacatgacatcatatttagtgacgcatgccaaaatgtcgaggctcatgtagacgtcgtggttggtgaagtagcaaaactcgcgaagtagcagcaatagagtttgccggtgccgaagataataaagatgaagtcactccaccatgatgacaaagttgcatagtcgtgatgaagtgaacatgagtcggcggcaacataaccagtcggcgatggaataagtagaatgatgacgaaaacgaagacgtccttgaacggcagcaaaataggccagccatgaaagtgaagacaccatgggcggcggcaaaggcaatccgatgatgatgatgatgccagtcaatgttgacgaaaacacgtagccatagaggcgaacaagccagtcggcgtcagacaaggcggccagcaatgaagacgatgacgtccatcaatagtggtagcggtatataccagccgtagaggcgagggcactagtcagcagcagacgaaacgaccggcggcgaagatgataaggccaatcaacagtattagaatcctgcagccatgaaagtgaagaaaccagtcgtagacatagacaacttgagttgaaggtgatgacgcatatttgtggtggcggcgacgtggccagccatgaagacgatagcatcaattagcgtcatacgaagcggccggtcggtgaagatgtaggcgtcaacgacggcagcataataggccagccgtgtaggcggagacaccagtcggcggcggcgaaggcggctggtttgtgaaggtgtagacgcccaacaacggcggcataataggccagccgtgcaggcggaaacaccagtcggcggcggacgaggcgaccgatcggtgaagacgtagacgcccaacaacggcggcataataggccagccgtgcaggcggaaacaccagtcggcggcggacgaggcggccggtcggtgaagacgtagacgcccaacaacagcggcataataggccagccgtgcaggcggtgatagcagtcggcggcggcgaaagcacgctggccagacgctcaacaacggtggtgtgaccaaccaaccgtataggcgaaaacaccagtcggcggcgacgaaggtaagccggttggtgaagacgtagacgcccaacaacggcggcataataggccagccgtgcaggcgaagacagtcagcggcggcgaagacaagccagtggtgatattctgactgatccattcctgaatcgtaggagataagtttaaagctatgaatcccttttatgcatatctggatctggatcttacagaacaaacatataagatgagtagtatctgatgtaaatataatactcgaggaaaattcaagtattttaaaatgtttataatatgtatttctcttcttgtcaattttgatttccccgagcagatgactccgtacgtttaaacactctgcctaactagtcatagcccccaagcatcgagagtcggccaaggcactttccagagatgcaaatgagtgacatgagttcgtcattaatgaaacaaagtttcacggatcagaatttactcactactggagagggaaacactccgtagtgccaaaaacacaccgcaacacacaaaaaacactccgtaatcaggttactcagtgccacactccgcaattttcaccagggagtgatgttgtcttcccgtgcatcgtagcggtgtgtttttatgcatacactccgtaaccatccgaaagttacgtagtgccgtagaaactcggtaaccttttcagcacaccgtccaccggaactgaacagcaacaaggaacgggagacggagcgtttgcacatgatagcacacgttaactttacagggtgtgcgcaaacacaccgtaagttttccctggttacgggtgcagattagtggcactctgtaacattttaggttgttaccgggtgcctcagcattttgatatttgaggggcaaattaataggaatatacagcttcatttctattaattatctatagcagaattccagcatccatacacatcacatgcagttacacataaaacacaataatggatttaaatgcatttgacatgcatgttcattcaattaatcaatatgacaacaatctgatatgaaataataacaatacaaatctcagaaacagctacaactgagatgaaattgagcactatcttcaaccagtataagcatgggcaaccaaaaggccgtgcaaccagaaaaaaagcttagacgaacagcattgccggcagtctggaaaaagaaaaggacttaataaccatcaatcattgtctgtttttcatcctgggatagcttcatcactctaaaatggatgccactatcgccatcagccatgatgtaaccccagcttttaccattagctatagtgtgcttcctagttttccatgaaattgccaattgcttagctcaactaatgaagtccatatgactgcagcatcaggaggtgaaggatctgatgattcacaaaacaaattcaacatcaaaatcccatacatcaatactatgttctgatattaagaaagaagtatacattgttacttagttctggtatgtctttctagtgcttacctttgccaggagcctagaactaaagcagtgtaggtcacattaattgttccaaaggtacaaattagttcttacaaagacacccaatagtattcatgctaaagagagcaattagacatagcctagatagatgaatttactaagacaaccagagagtaacttcaaaaaatttcagaaaacctcggcttgaaccagtgaaatgctaatgatctagtgctaactagctatatgtaaacaaataacataaacactacctttacaaaaatcttaggtattgttcaatgaagaattgtactatgcaaactactatttgtaatggtattgacgaactgtaatatcggaaacattagtgtaagcacatcaccaattatgatttctaacctggaaaaaaatgtaaagggacgaagagattacacttaaatcgttcctgcaacatcattgtcagaagtaattgtgatatgacctccattacatcctatcagaatttccttacctgcatatattttaaacaaaaggttagtacacttgtgaacttataattctgatcagcaactgcagataatttatggattggttgcaccatgtatgctacctatcatattgcagtcctctgagactcggatgtcttcacgaccaatggttgatgtctacacaaagaagaaaaatataatataccaaatcgactttagaattggatcgatgttgttccaggttgtctaaaatatctgtaaggatccttgcatatcttgatgtagctgctcagtcagtagtaaagcttagaagcataactttaatactgatatacatacacccagccctacaggccaaagatgcaagacttcaattactgagatacatacacaaaggcctagggcaaaaatatggtatttgattacagaaagacatgagctgaagcataagcaagcatcctctaggaaaaaaagattcttgtggaaccaatgcagacaaaatctgtcattagaatcaccactgaagaagcgaattttaaaatactaaatcccgctacaaacatcactaagcaaaaatcatgtgcatctacattctacaattttattattctctattttcagaatatgcactgcatcacgaactaatcagccactaaatctcacatcacatccattcactgtcatcagatctgaacaaacacaagatttggcctctacctccaccccacaagactacatcccctttgccccatcagcaaagaacagccaggagcccatcccaacccctctccccatccccttagcccctatcagcaagatgcaaaagaagaagaggaaacattaggagaggggaagaggaaggaggggaggggcaagacgacctcgtactgttgcttccttgaggctgtaccgcttgtgactgccgttgcagctgccgcagagcacgtagcgctcgccaccgcaccggctgcaggcggcgagggcggttgcgccggcgccggctacaacgcgtcggagctcgccggactcgtggaggcggcggacctcctcggcgccgccgaggtggcggccgccgacgaacacctgagggagggtgacaccgcgcgcgcgggggaggagcgcgccgagctcctggaggtagcgggggtccatggcgaggaggggtcgacggctgtcaacggagaggagaggagaggatagaaggggaagattaggttggtcaaagtgaaagtgaaaatatcaggaggggagagagaagaggagatgagatgaaaacatttgaagccaggaggaaggaaaaaaatattaattttaaaatattaaaatttcgaatcgaattttattatactaaatgaactcatgtgtaaaagttgtcaaaaataaagttgtagaactcgttgaaatctaccatttttcttttggtcatttttccatccgactttgattaaactatataaaatttaaattttaaaatataagaaattcaaataatttttcgagtagtaaatgattttaaatgaaaaaaattgtcaacatcaaaattgtaaaacacatcaatatctacaacttttgttttggttatttttctatatgactttgtttcaatagtttgaatttgaatttcaaattatgacaacttcaaacaacgttttcaaatagtaaatgatttcaactgaaaaggtcatcaacaataaagtggtataactcatcaagatctgtgacttttattttgatcatttcttcatccgataaagcgatttgtaacattgttcataaaatgtacatatctcttatatagttttataaactatcagagagatatgtaaattttttgaaaaatgttactatcactttgtcggatgaagaaataacaaaaataaaagttatagatcttaatgagttatataattttgttgttgatgactttttcagctgaaatcatttactgcttcaaaatattatttgaagtttagaaattcaaatttttaattaataaaacaaagtcacaagaaaaaaaaagccaaaaaaataatagcagtaagaatataataacatgatagaacatgattttagaaacatttagaaaaaagaatcatccaatttggagtttatatgagtgagataaattgagaaaatatgtagtgcaaaccacatatacagtggaaacttggaaactaccgttggatcgagaaatggacgtccgagattcgtccacatcaccatgagttaaaattcaactcccggtaaaattttaactcatgagtgaatctgcgagttaaattttaacttatggtgacatggacgaatttggacgtctatttctcgatccaacgatagtttccaagtttccactacatatatggtttgtactatatatttttctagataaactagttttaaatttttggcctgaaagttgggagttgggaatttatattggcggtgtaaccgccaagaaaaatacatattttcttatcggctagggaatagccgctaataaaatatgtttattctttgcggctagtttgaaccgccaaattaaagtgtaatcttggcggctgatttcaaacctccaagaaaattacatggccgtcaaagacattatgttttcttgtagtgtaatattttctacacaaaaaaatataataaaaatattttcaacacgggatctaataaaactattttggtatcctagatgttacgtttttctatgtcattagcaggattaactaagttttcgtttcgtttttctatgccatcatcttgaaaaatcaatttatttgatctttcaaaaagcactatatatagatttttttttaaaaaaatatataccgtttaatagtatagaaaacatcacgatgaaaaacgatgtagtaagtagcccacacaagacggttgttttgtttcttctcttaaaaaaaaaagagaagtcacgttttatctgggttaaaaaaatgatctgcgaataagattttttttttagtttttataaggcaaaattgattatatagcatcgaaagttcacgtttttggttttatagcaccgaaagttaccggttcactttaatagcacccaaagttcaccatgttcccatttttaacacttctgtcaattctctatcgttttccgtccgtcttgatcagccacacacacgatatgacgtttctacccctcacaagtgcaagtataatgcatgtcaatgaggggtagaaatatcatatcatgtgtgtggctggatcaataacgataaagacgggcggaaaaattgacggaagtgctaaaaatggaaatagggtgaactttggatgctattaaagtgaaccggtaactttcggtgctataaaacgaaaaagtgaactttcgatgctatataaccaattttgcctttttataaccctccagctaaacatgtggcccccaccactatctgctccgttatactacgttacggttaccgtgtgtgttatgcaatagttcaccgtaagtatcaggtgccgtcatattttctgctattgttctgttcccgcccaaggttttcgttcccgcgccattcccgcaacagaaaatgcatgtgcgccaaaaggaacagccgtgcgcgccaacgaaatatgtcggtgctgaaggatgcggggcccacgttccctggtgtaataatattatagcactctgtattttccctgtgttccccagtgtttggactgaacgctacgtgatagaacttgttgcgtagtgtttctctaatccacccggtaatttacagagtgctaaatgaaacactacgtaactttttgctcacactcgggagtgtctcccgtcctggtagtgactactcgggtacttttgcaattcttaagagcagaaaataaattatcttatctctatgtttttgacttttcccaagtaatacttagcaccttgcgttactcggtctatccaacgagcctccaggtgctaggaatcggcctaaaggcaattatccatcgacaaaccaaacggaaagcataggaagatagaactccataactcgataggcacttttgtactcaaattatatcacaagcaatcaagataaatattatgaaaattgttgaaaatataatataacatctgtagcccccaactcactagtcaacggcgaaccaattgatgtagtgaggcaaaggaaaaggaaaatatcatctaaagaaaattaacgatgacttagctttataatattccccttggtgatggcagaggtggccaatgtaggaacaaagtcatccatcaatggcaatgaaaacaccagccatagaagcagcttgaggcgactgatgatgaaaacgaagacgcccatcaacagcggcaaagtccgccaactgtataggcagaaacaccagtcggcggcaatgaaggcgagccggcggtgaagatgtagacgcccaacaatggtggtgtgaccaaataaccgtataagcaaggacaccagtcggcggcgacggaggcaggccggcggtgaagacgtggatgcccatggacggtggtgtgaccaaccaaccgtataggcgaggacaccagtcggcggcgacggaggcaggccggcggtgaagtagtagacgcccaacaacggcggcataataggccagccgtgtaggcggagacaccagtcgacggcggtgaaggcaagccggttggtgaagacgtggatgcccataaacggtggtgtgaccaaccaaccgtataggcgaggacaccagtcggcggcgacggaggcaggccggcagtgaagtagtagatgcccaacaacggcaggcataataggccagccgtgtaggcggagacaccagttggcggcggcgaaggcaagccggtcggtgaagacgttgttgtcatcagcaacggcggtggcgaagacaagccggcggagtagactcgtggccgattgaccgcatagcgagacgcctcgagtccatgaccggcatcaatcgccccagtagtgccgcgcaattatatgcaagtaacaaaaacaaaaaatatcaaaagattaatatgatatttagagatcaatctaatgaacaacaataagttggaagggaaaaatcctggtgatgtcggagtttaatgcccacaagcaaccaggaactccgtagaacttgggcgaccatgtgcatgacgatcaaaacttgggtgaaatcgcgcgacatcgactcgccgccacaagttcatgcatttaaaagaagaccaacagattagacgagagcatatacatatatataaatatatataacagctgtatgtgcatatatgaagaagattgatctctgcttttgccatgagtgtatataaagcttctccctgttggttgatgtgcttcaagtcagcatgtgtttccttctggtaggctcggcagtgtccatcaataggcaccacatgccatcggctcggttggcatttagggtcacacaagcacgagaaaagtttcgtcgcttgaggacacggcagaaaacttcgcctccctctcagccgaccaacccatgaacacaagaaaataccagaaagttattctggaattaaaaatcaatctaaaaataataatagattgaaacaacaaacctggtgatatcgaaaattggttccatcgcacttgttgacgggaaactcgacgcacccctacctggcgtgccaactgtcgaaacatgaattcggcaataataaaagcgggtagcgcacgagacctaaaagtggatggatgcggagacaaggatttagacaggttcaggccctctcaatgggaggtaatatcctactcctgtttggggatttgaatccaccgggtgtagtatagatctgatgatcaggtgtgtcatgccccctagagggcctcctgcccaccttatataggatggggagcaggattataagatagaaaccttaaccaatacggtatcggtttcctaaatctattttacaatattatcaaatcaggactttaggccgctccataatataaaaggaaacgtaatacccaagtcatgatctgttacatattccatagatataagttatcccctatgactagtcggataaccatgccgtgtgggtatggggtacccataatctccacaccacctgttagtgaccacgtcgggggaagttcatgtcagaggatctgcttccgtgggattgctaggagggttggcgagtagatgatctgcggttctggttgatctcctgttaatcttctcgtataaatggcaagatggacaataaactgaacggccgaacttttgagccgccaccgcaggagtgcaggacgactgatggtttggcaaaagtgatggaattgccaccacatctgtgcgctgtgttttgcattttgctgggatgtgctccctccctggggcagtttggactccttatctgcttttagtttctttattagccttctgaactatgtagtgaacctgtggtagtttgcatttcgttaatgaaatgggggagcaatgctctctttctcaaaaaaaaaaaagaaaatctaccaactcactttgctatgtcaatcgatccactgtgttctgataatttaagagatacttcgatggatttccattgatatgctgatacttaatatctagttaggtcaagctgtcaactgttgaatgctgggtacggctagaacgaccaatgtacgctgatgttttctagtggcacatgcagcctacatgtggtatacacaggttgtgtttagtttctgaaatcggagagaagtttggggaaagttggtagtttggaaaaaaagttgagagtttatgtgagtagaaaagttttagatgtgatgtgatgtgatggaaagttgggagtttggggaaagtttggtgtgaactaaacagggccacagtgaatttaatcattgacaccctccgctgtcgcgcctgtcgatcctccgctgctcggccacactccggtgcccatcaatccttcggtatggtactgcacccattggggctacacagcagcgcccatcgatcctccgccgcgtgtcctctcgcttgttggcgcccgatgaccccccccatcgccacctgtcaagcttcacctctttgccgattcatcaccgtgcgcctgttagattgtagttgatggctgccaccaagctttaatttgcatctgtttcatatccaaaaaagaggagctcgccggtgctatgggccgccgtctgctacacaaagacaccactggaaaaagcattttcgctgatgttgggtatttttttcgcagacgggtatgacaatcagagtaaaatccccaccagcgaaaatgagtaccggggaggagttggccgttcgccaacgaagatagattattgcaagcggaccacataagggagccgcatgcaaaaatcatctttgcaggcggcacacatatggacccgccggcaatattcacatgcaggcgggctccttaggcggcgccttatgtggtccgcctgcaaaaatagccctataaagtcttcttcttccttgagccttgttcatttcattcgaggtttctttctcctctaacaccaaaaatatatgggagaaggttttgaagttcaaatcttcgggggatttttctatggtagttagatctacacctttccactcttgttatgcattttcttttaataatttcagacctctctttgtgatggatctatgcatgcaaaattgtgaagaaaagctcaacgcttttttcttttcattttttgttactttcctttgatatgtttgtgcttgatgtgtgtacactacttgatgtctcatcctctagtgatttaatgtgctaatataaagtcccaaaattttttattttgccctcacatccatcttctagatttagataggagagagaacaaaaatgtccatctcttaatatggtccatgttaaaaatggattttgctcccatctattccctcttctttcatgtacattttcccacttttgttggactttcctattatattaatttggtatgtctctatataccaaaaataaatataatttgtccatgaaaaatatataataattattaatagttctctatcatttttagtgaaatgaaatttggtatggctatgtaaaaaattaaatgtactatgttttcaaatatttgttgttcattttttgtaatatagttgtacatgaaatttttgtagatatatggataggaaccaatggatatatcattcgttgaggtttttggctccatatatggattaagtgtctaaatttattggtattgccaaggaacacgctgaacagaacaatatgacggggattctttgtccatgtgttgattgtatgaatgaaaaagcgtgggaagatgttgcaaaagtaacggagcacttagtaacttgtggatttatagaaaagtacgaaatatggacacatcatggcgaacatcaagtggatcggcccgaaaaaagaagttccgccagaagttgaagacatggagtacgccgatggttgtggtgaagacaaaatcgatttggaggaaatgttacgtcatgcagatcctgaggtgctcattgggtcggctagaggtttagataattttgatgctttatagaaggcagcgaaggatgttttgtacgatgagataaagggctgtgacagtgagttctcaacattacggtcagttcttgaacttatgaggttaaaggtgagatatggatggtctgatagtagtttcgacggtctgcttgaactattgaagaaaatgattccgaggtctaactcattaccatccaacacatatcaagcgaagaaacacatatgtcccctttcacttggtgtggaaaagattcatgcatgcgtaaatcactacatactctacaggaaagagtatgcttcattggataaatgcccaacatgtggtgctagccggtacacatcaaataccaatacttgtctagaagagtctgacacatttgagggaactaagagaaaaatcctgcagcttgtgatgtggtatcttcttgtcaaaggctgcattaaacggttgttctcaaatccgcaagatgcggaactaatgcgctggcatcaagaagggcacaagaaagatgggatgctctgacacccggtgaatgctcgtcagtggatgcatctagaaaagaatgtgtttgacaacgtaattggaacattgttggacatagcaaagaagactaaggatggtctgcaagcgtagcttgacctagtcgagatgggaattagggaagagttacaccctcaagaaggagagaagaatggcaaagtatatcttccaccaacttgtttcacactaacacccgaggagaaaaaggcattttgcaaatcactccacgatgtgaaagtgcccataggtttctcatcaaacatcagtcgactagtctccatgaaagatttgttggtatctggttataattcgcatgtttgtcatgtcttgctcaccgtgtttcttgccattgcaatacaggacataaaaccagaacatttaaaggttgctatcgcaaggttgtgctactttttcaatgcagtctcatagaaggtcatcagttaggaagagttatcacttcttcgtacattcgcacatgagacacagtgccaacttgagatatgtttccctctagcattttttgatacgatggagcacctcatcgttcacatagtgccccagataattgcgcttggcccgttgtacctccatcaaatgtggtcatatgagcgttacatggctattttgaagggctacgtccggaattgcacccatccaaagggatcaatggttgagagttacaatacagaagaggttgtcgagtgctttatcgattacctcaacaatggaaagacaattggaatacatgtacctcgacacgagggtgaattgactggtagggggaccaaaggaaagaagagattcgtcgcccatgattacaaaacacttcgagaagctcacttcagcgttcttcatcagcttgctattgttgagccttacatcgatcaaaacatcaaactactaagatctaacaatacgggacgcacaaccaagtggatcatgaaagaacacaagcgtctcttcatagaatggagaaccaccgaggaaataactatgaaaaggttggcatgtggtccatcaagtatagtcaattattgggagggatatgacattaatggatacacgtttagtacaagagctcgagatagtaagaccgtcactcaaaacagcggtgtacgtgtggaggaaattgattccctaggagaaaaactatcatacttgggtttattgaagaaatctgggaaattgactatggactcatagtgcaattccccatatttaagtgccagtgggtaaaatacccaaacggtgtcattagtgacaagtttggtcttactgttgttgaccttgagaatgtgggtcacaaggatgacccttgggtactcgccaatcgcatggcccaggtgttctatgtgacagaccctacaaatttgaagaaagaaatagttccatcaggaaaacaaaagatcttgggagtggacggagtcgttgatgtcgaagattacaaccagtacgatagtatggcactgtatactcaatttgtacaaaagattaagcttttggcggcatctactgagaagaccgtgaagccttacatacgcaaggatggtgtggggaaaaatgtgaaagagtaacgtttgtacatgtttgcaatgattactatgcctttaagtaattgtttggtatgtaatgatgatatgttttaattgacaaacaatttattatgtagtccaatttacattttttgaattcatttacattttatatatgttttttaaaatcaattacattttttaaaaataatttacatttatttaaaatcatttacattttttaaatgttttttaaaaccatttacattttatatatgttttataaaattaatcacattttttgaaatgattttatattttttaaaatcatttacatttatttaaaatcatttactttttttactgatttttaaaatcatttacttttttaaatcaattacattttttatatgctttttttagatgtttttaaacatcatttacatttttttttacaaatttttagtacttttccaacttcttattttccttctgaaatcatttttgccggcggggtgtccgcttgcaacaatgacaaaactgattatgttttatcatcttcatcggcgggctgcccgcctgcgaagatcgcgtgcctatataaggggtttatacaggttcaggccgctgagaagcgtaataccctactcctgtgcttagctgatcttgcaagagattataagatctccttgttggaatagaaggtgttgatgatgaggggcagaaggtgctctaggaaaaaaaaagggcttgtcccccctcgcagtaggcctggacctccttttatacctcaaggggttaccacatgggcccaaaaacctaacttaggggagatggattacaaactatgcattaaaatgcaagtcttgtttcttcacttggaaagccatacgcacgtcgtcttggtcatggggcccatcaaaccacgccgcctgacacggggggcgcccctgccagtcgccatctaatgggtgatgacttctgggatcccgttggcaccgggaaacaggagcctcgcattgactagagcggatgaaccgactccggccatgacacgatttgacgggatagggcaggctgcacgccgcctgacacacgtggtagtgtgcaggcacattaccctggtcccatcagtcattcgacctgtcactgatcggtcacagaccggtcaggcgcactgcatgccacattaaatgcggcgtggtgcgccgcttaggtcgccttaaatgcggttaggtaggcgttggggcgcacacctaaccccacacacgtggcgtcctgcggagggggtcggggcaccccgacccctagccatggaaggggcagccgccaccctaccccggctcgatcccttttggggagtgccacgtgggtaccgggggcagccccctccctcaagtcttaataccctcgggcgaggagggggctgccgccactccaccccgggcccaaccctcctcgggggagtgccacgtgggtatgagggcggcctcctccctctaaacatgatacccccgagtctatatcaccaacaatatggatgtggatgtggcgatcactccgtgtaagtgatcgtcggaagacgggtggagacatgagcgccacccgtaacacaaaacctttgtgaaaaccaaaaacctaataaaacaaaatgattttgactggggcggcatgaatagaatatgggtggttctggaaacggcaagtcaccgaccctggttaattaaggaccgagtcaagaagctatgtaggaaacgaaccgagtacaaccacatttcttaaatgggtatagactcggcggactaagaaatccttgtggggcggcacctcagtcatggtaggttctggatgcttgatgattgtgatgaggaagtgttgtgatcagttaatgacatcaaaaacctaaaacgcaccctataagtatatatattatatatctccctgaacccgggaatgccaggactcccctcactgccggctcgaggtggtatgttttgttaggagtgcaatggggacccatagtccttggggcaggtgccacaatacgagggtgactgaaacaccgggtcgtgacgagtttcatgtgttgggattaggctcatatgttgggcaagtcacggagtgcgggattaaaagcgtacatccactgtagtgtgaggaaaactaatctattcgaatagtcgttgtcgtgattaaagagcatcgggacttacactactcttgactagcctcatagattgttaatcttgcttagattaggaaaagatgtgtgaccttgcccgatgagtgggaaggatgtagtgaaggagaatgtgggaaaaactggttgcgagggtaaaccggaccaagcgaggattggggaaggtggatgaaccctcatggattaacgacaacttcaacaataatgttgttttcagttaaaactgctaagtcataggtttgtgaaatgatttgtgaaatctagctttatgcaaacgaaccaaggcatccttgaaatatccctgtgagcactatatgcattatgtagtggtggcttgctgagtacggttggtattcacccttgcttaattaaatattttagaaggagaagttggagccgatttgtacgtgtgccatgctgatgaagagatgtcgaatacggtggagtagggacctaggttcaccagtcgctgcctgtggaataagatggaccgtcgctgcttcgcttccgctaccgtatctacttcattggatatttggtcttatagatgacaatgcttggtctatttgggtgccactccagcaacccttgtattattaatgtattataaagcctgtataacgatatcggctttgtgatatacaacgttgccatgtgtataccatctactgatccagggaatggtattgtaatcacatgaggtttccagtgtacaaaaccgggggccgacacctcaccacagggtggataacttgttcatcatccagaatttctacaatggtgtaagcatggccatggtaaggctgtccatgtcggtgtggcccgtggccccccgtagtgcagcggagggtggtcttggtggtgcccgagccgacgtcgaatgtgtgcgtgcagcagtcggcctcgatgaggtggacggtggcaagatcctcctcggtggtgtgcaggtagcgcaacacctctagggtgggcatgtagcagaagtagcagatcaagaaccccacaagggctttcagcaaccgccgacgccatcacgttagccgcaggcgggaggcggctgacgacgttggtgacaatgttggatacgggatccaggggcccaaagtagaggttgctgtcgaggatggcgggtagcagcgctggcatctcatcgatggggaggcgcacgatagccgcagcgtagaacccatggatgagtcgtttcagcatcgatttgtcaccgcggtgtgcatacggagttgggccttgcctggtcctcctctcactcttccatgttgctgcacacatggcgcctatctttagctagctatggttgtctatctttcacctcctccgtcttcttacgtacatcgctggttgcgaaaattaatgatcgtccatgcaaaatcacctcctctggttgcttcatgcatttccctgcacaattattgtcccttcaccaccccccaccctccccggcaagcaaatatgtcggcagcaattttcctttttgttcttttttttatgaattcggtcaaagttttttcatatttagttacattttgttaaaaaaatcaaataactttgtgcaaaaagtgacaccaaaattccaaaatttcagtccaacaggaaatagaaaaccctggaaatgtattcactgattaagatccattcagtggatgtccctttgtatatattttctttatcaaattcagtcaaatgactgaatttttgattgatggtatagagtatagtgacatctctgactttacaattcagttatagttgtcgattaatagggaagtgatttcgaaatttttgagatgaacctcaattaagctattttgaggcaggaaattttttcgcgagcgagagagctaatagttctgttttatgctagataaccgcttgcaacacgctgacccttattaaagaaccacgttgaatacatcttcattggagaatactacaccaacatttctcgaattcttcatcgagttggaagacttgaactgaagaccctttcttttgccatgatagcctgaaaattggacaacgaaacacagttaactgaagttccactgaatacataatactaaccgaagtgtttgtagggtgaaggttttcgcacttcttttccccaatctgtacgcagtgtgatgaagaggagcatccctactttactgatactgccacacacaaggccaagccaaagaccctgttttatggaaacagctagcagtttcagtcatcatcatacaaaggtacaccaaaacatttctatgaatcaacaaaaaaacaatctgcactgcatatttttttcaaaagagattgagagagtagtgctacctctccattgagatggaggacaaatgcaagcagcacagccgtcggaataccaaccaagtaaaacgcagcaagattcacatgagcgccaatgttctgcttaccacatcctgtcaaaactcctgaaacatttggaggtccaagtaattttattactactgatcgacttaattgtatgaatcaatcagttcacccgaaaagctcgccgacaatgagaaaaaaaatgtacagctgaaatattttgatgattgatcacaagtagaaatatggtatggatttgtacctgaaagagcaccattgatgccatctatgaagaaggagaccgcaaggacggggagcatacttgcaatatatgccaccacttcctcctcgctgctataggcatttccccagacattgcgcagaaaaatcatggctatcactagcacgaggcatacaagcacggtcatggctatggcgactcgcgctgccatccttgctgctcgaggatgcccgccacctagttcgttcgagacgcgcgtgctgcgcaagtgcaaaattggtggaactaatcagttctaaatatctaatccaatgacatgtaaactgaaggaagaaagcatgcttgccatgtaaataaaataagggtaaactgaatttggtcaaaacttatttaaatttcatatattgtcgttcagaaattttcgggaatttccccccaaaaaaaaagaagaagcagaatagaaaatgttccaaacgaatttgcaaaccctgtaagagaacaacacagtagggcactgttctaaaagatgacacttgtatgaagaaatggattttagactttagagtcgaaacaaaccttaaagatgagccaatgccacgtggcaccatgaacaggagagaagaagtgctcaagctgcaaatcaaattggagttaacaaaatacccatgggaaggaggagagctgatttgtatctgtgttgcttgtgatcaaattaccagattgacagaacagaagtttcaagctgaggattcggcagaatgcccgagagcagcacaagtatctcaaacgaccaccactccaagctgcacacaaccaaatcaaccagttaatcaatcctcacataaaaaatttcccaaaatttgttcaagcaagctcgatttgctctctcgatcacaaaacatgttccaagatttgctcaagcaagcaagaaaccagcaatggtgtcaggactaagacgtgtcactgaccagaccatcatggcggacggcacggcgagctcggtgaaccggcggagctcgcggaaggcgtctatggagaacccggtccacgtcgtctcgcaggcgccggacagccgcacgtagagagcgaggacggcgaggttggtccagtacgtgacggcgccgctcagcgcggcgcccttgctccccatgccggccttgtgcaccagcgcccagcacacggcgacgtggccgaccgccgccacgccggagctcgccatcaccggcacgacgatgccctgcgcctgcaggaaccggagggcgcaggcgagcggcacgtaggccgcgagcgacgggatcatccaccgcgcgtacgcgccggcctcggcggcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccgaactgatcagatcatcccaccgagaaatcagtcacaaatttgaccaagaaatcggagagatgaagcagttcttgcatgcgagcaaggtgttcgacgacaggtgcgtacgagaaagctgaagccggtgacgttggcgagcgacgcggcgagggaggagccggcgagctggagctcgccgaggtggccgacgaacatgacggacaccatctggaccgagttccgcagcacgaagctggccatcagaggcccggcgagacgcagcaacctcttcacctccgccgcggccgccgccgccgtcgacgccatggcttcgtcctcgccatctccgccgcgtcggatggcgagcagtggctcctccacggttggctcgtccatgtcgatcgaatcaccaactgtgagacgtttcttgggctgatgctaggctgaaaatggtggattcgttgtccaacttatacggagcataataagttggtgtgttgacgagtttgtgacggtcaaatcggagaggtgtgattcattttaccctccacatgctgggcttccattatttaagagtaaattctatcacacttattatatggtccaagttatataaattataggaattttagcacgtgaaacataacctcgaatattatggttataaagtttcacaaaaccacgccgttaactattttagacatactccattactcctatatgaaaattttgaaaaacggaagtaacatttgcttgatcaaaatcaaaatggctaactgtttggttttctaaaactctagtgaacataatacttgagattacgtgccacaatatataatagacagggttttataaaatagtaaattttgtaacatcctaatacattattgttgactaagatggtacatataccgtagtcacgagtatcaacataatcaaaatggcaacaaatatagtgtcaaatcatcaaattttatgggcaataatggaacagtagctgcgaaggtttgtgtggggaaaatgtattccagtgtgtgtgcactggaaatcacgaaagaatattcaaaagagaaacaagctttagttggaaagaaataaaaaaagtaggattactttgtgaaggcacttctgaaaagtgaaaatgatggttttgaatgtaacttaatcattgtgtaataatactgaaaaccaaaaacttaatttagcaatgagcgggaaaatactggggacgtttcttgggctgatgtttgcaatctagggctgaagaaagtggattagttgttcaacttatagggagttaatttaatgttaatttaattaaagtggaatttggaatgtgtttggacggattcgattcgatcagtggaaggggcctctagcaactcactactgaaaattctttcgtttagttactcagttgacgtgttgacttgttttgtttgtaccgcccaattcttggatgccaaggcacaaatacctaatgtgatttgcatcctaattcattatttgtaggcgtcagtttaaaaagtaagacgtggtgttgtccggtccgagatcagtcagcaattttgactcggaagaaagatgactttctaaaacttgggatgcaagtctaaatctccaacaaaattgtaaggtttggaatgaaacaggacaaagctgaaagcaacccttttttacgacccacacggtataggaggaaaaagaatagaagattaccgtcctcgaaggctataatcaggaaaaagaaaaaaaaatcaccacgtgctagcgactccttagtccttacacaccccaagagaagcactagcaccaaattgaccgccggcgccgctatgcgagaccgatcaccgctaatcctacacagggttgcaaacgcccctccgagtagggctccaaaccaggagatcatcgatgggctcccgatcatcatcaggtagaaggcctgaggagggagagggcgagagagaagatctactcgtccctcacacaaacctgatgataatgactcgagagaacgccgattacccaaaggatcgaagctcatcaggcaaggaaacaaaacctcgtgaacgatgcctccaaggaggtcgttcgcttcctgttgatgaaaaaaacatgggggtctgggagttatgcttagctccagtgcagatccaaatctcgctttcgagttcaggacgtgccaattggtttgaccctacaacaaacaagaataaacaagaaaatcaagttaaattacgatagccggtcggcttatgagctgataacgtatcatgtaaacctagccgatgcaatttgtccgaattggttgtaaggtgtaggatgaataaaataagacaaatctaaaatatgttccatcggctgtagatacaatcagacatgttccatgattcaacctttctatgagatgtaagcaaatagtatagattgaatgagatagtgtagattgctcgtaaatcagatcaaacaaattaaagattaaatgtagtttatatcatagccgatgatatgatacttttggttaagataggtaccgtatcggctaatactccaatatagccttatgcaagaatatcaatctaaataaatatttcaagagcaagcttgatatatttaaatagtgtgatacacttgtatgagggacagatacaacatgaaaaacatgattaaaggatttaaacaaagctaaaaaattatatcatgtaagatcggttgaaaccccgattctatccctattagcaatcaagaagcaggttagtttctataattctaagcatgactaaggctgatgcagcacaaagtatgaaaagaagcataaagtctaaacaatcatgccttgactgattttcagggtggtggatatgttagctaatccaaaccgacaaaacaaattagccgatgccggcaaaaccgtaaataagacatggccgatatagctaatcgagtcatcaggttagattaactaagacatataataaccagcgatcgaataggatagattagaacatctaaaacaacgccctaatccaccaacgcaagccactgtgacaagccattgctctcgtcagaagatcgaagccgatgccctaactcgaagcaagaactcgtcgaaaaagtagaaaagtaaaagggtggcgatgcgccgagagtatatgaatggttgttgtttttttagaagaccctaggcatatatttatgcacgtagtacaaaacctatccatatcgggcacgacacaaactttgaaaaaaaaaaacacaccagcccattacggactctaacatagactcctaaaacacctaaaggaaaactgacttttatcctaattaatagatgcaattatctccttggcggactcgatctttgcttggcaatattaccaaccccttcctccgaatccgataggaacacaacttgctactatcggcaacactcagccgatatggtcctgtcgatacttgttaggcgatccaatccctgtttggccaaacaaaattacgccgttaatttttcccatcccttattcctttttcaatggaatataccaaattttaccattaacacattcccctaattctggagtatggatagacatgcttcggaattcatccgtcacaggacatttaacaccagcccattagggtttataatggcccaaatagcccatctcagcctttaacaccgtaatttataaatagcaacggtcacctctgccatcatcgtgctgccactttatttcttcgtttcctacaccaacaagctctaatttcctctcttctcaactccggcaaccaaaacgaaactatcaaaccccctctggcgaactccaccattcattcaaatggcgacgactagcgacatcctagaggtaatatccgtaaaactctcctttttcctctttatttaccgcactaaatccataaatccctcattctctggttttcgcctcgtgttctttgttgtcatctcttttttactactcatttcactgtagcaaatgagagatcaaatagtgattcctctagtcgatcaaccattatattattttctcggactgatggggcaatgaggatcccattgaatttattaacgcggagaccaatcgaattcctttcaagctatctagcccctgcatttccgattggaatttaagattcagatcttggccctccaaggttcccagctagagaaactagtatcggagtatgctggaagccaagcacaaagtctggtccaatataggcataactcagtgcatcgctctatctttggccgagccggaaaaggttgagtctctgattgcatcggctacacatttttggtccgatactctgaacacaccttcttgttcaaccatgggccgatcagtcccaccttgctcgatatcgtcatgctaactggtttgaacatcacttcatcggctaatctttgtagtctgagaataaaatgtgttaacaagctagagaccaaatgtgtcagcggctggtcagcttgtatcaccaagcatgccagaactggagcagtaaccgacagagagcatgtggcctttcttaatttctgcttggagagatttgtcttctgcagtgcgactattggagggtcagcccatcggccacttgggcagtccatggtggcttgtacaactctggcttaagttctacaccgtcaaaatcactggagtgcacgtcactgaatcaagatttctggcttatttcgcagaaggtgatgaaaaatctcttcccagatgcacgtcacttggcgaagcagcaatcatctatcttagcagcaaccttacgcttgaaaatgtcatgctctggttcaataggttctacactggtttccctagggctgcaccagaaactggttcccttatgaagaattcgaaggctatgaacttccatcggacttcaatctgaacaacattaactctgatgaagcaagccgagagatatttataacggctatcaccccttgcattcttcagaccggcatttctatgggacaccactctcatatctcgtatgaattctatcacccattagtggtggcccatcaacttggtttcggccaagtccctatcaaagtttacttcatcaaaaagatacaaactcggggaacgatcacaagtgcacttaagtgcgattgtctcccaaacctcaatggtccaaatcttggtcccttcattgactgggacagccgtactatcggcagtagaccatggatcaaatggtggggtgaatggaagcgtcaccttttcaacctccagtctacaacttcctcgctttacttgatcctaaattcgttcctgatgatgctgaggtaaaatctttgtgcactcaattcttcctctatttcaagcactgatcatctgtccatttatatgcaggaagacgatgacactcccatgaccagctttagtgctctgccgataaattatgttcccttatcggtatcgtcaagacttggtgcaggtgcccctcccacatcttgcttacttcaagaggctatgagggagccgataccaagtctgaagactaagcgcaagaagccggccatgtggcacaaaagcaagacgcgtgttggtatttcttaatgacattactagcaacataattctcagcaatggcgcagaaataattctggtatattatggttacacatttcatccgcaagcgcacggatataccattgtagcatttcaaccgagagtattccaagggtatcgtatttattttatcccgtgggaagatcatgtagagagaactcaactaataatttatatattacttgtgataatcatattctaagcaggggttaagataatccaagggtagagtgacacacaagcattactactcatcctcataataatttatctaagctaggtggaaataagagaaaagaaatctattcctatacttctagtataattctagctaaccgatatactagctaataccctctatccgatgctctcctggtacttcgagaagccaactctgactgccgagctctttacgacagcccgtcatgaccatccaaccggggctaaatatggaggaataccctccccaggaaattaacttaggattatatataggcgtggaggaatacctgtactgagctgtcatcttcagcggccctactctcatccgcaatatataaccccaaataatgatatcttgtaatctagacaccacgtctaaactaccagatactactctaatatcatcgtcatgacatatagtaattgtataagcaaacactatacccgcatcaaagcatctcctagataagctagccgtatatttagtataacaaggacataatgtaaagttggtactcatatactcggaaagtatttcaataccataaatgtatatagaagagtattctaataaaagtacaaagcttacaaaagaggaaaggaaagctgctagagccatacccgaactcttccgaaggcttccgaactcctgattcctcttctaattctattccaccagctagatactactaaactaaacttgagaggaatgagagagctcttgcttgaggtgtgtgagtgaagtgagaatggcaactccttttatagcctcccaatgacggttgtggcggttggaatggtcggaaatgccctccaactgccatttggggctaatccacaccgtccaggcgaagccctggatcggatggcgctaaggagggttcggcttgatccagcccaatttcggctggcggcctcgtctgttgcttctcttcacagacttgtcaattttggcccagtttgtcgtgtcaattctgagttcttggcccattcatgcataagtctggttctcaacatcgtctaattgatttatcgttggtgttgatgtcgattctcctcctttttatgatcattctctgcaaaaggttagtaaacctaacactagtggaatattattattctaaaaaatatatgtattgcaagcatcactagttctctcctgttttagtaatattgatggtcgaaactgatcgataacgaccgtcaataacgcgcaaaactggcttgtcctcaccatgggatggataaatggctcatcatccagaacctctacaacgagctgacgcagttggcctaagatcatattgatgctgctgctggaggagccttcttgtcactcattgttgctcgcacatcagaactaattgagtagatggtctctaaccaagggtggagcaaagaacgactccaacctcattagtggggcatgcatacagtcaaggagatggacatgctcgccgctaagatggacctcctcatgaaacgcttggacgaatgtgctcgtgacaaggcagaaatgaatggtactacccaaaccttggacatcccaatgacgtgccagacttgtggcagcactgggtattcagggaatgactacccgtttctgtggacagaagaccggcgatcttgcgtaacctcaaggagagcgtaagcatggccgtggtgaggctgtccatgttagcatggcccggtccccccgtggcacagctgggggaggtcttcgtggtgccagagccaacgccaaatgttcgcgtgcaacaatcaacctcgatgaggtggacaatggtgaggatatccgcctcggtggagcataggtagcacagcgcctccaggctaggcatgtagtagaagtagcatatcaagaacccgacaagggctttcagtgaccactgcaccatcacgttggccggtggcgggaggtggccaacggcattggtgatgatgttggatacgggatctaggggcccaaagtagaggccgccattgagcatggcgggcagcagcgctggcgtatcatctatagggatgcatatgatatccgtagcatagaacccatggacgagtcatttcagcaccgatttgtcgccgctgtgcatgcggagttgggccttgcctgctcctcctctcactcttccatgctgccgcaaacatggtgccatctttagctagctatggttgtctgtctctcacctcctccatcttctcatgtacatcgtttgggaaaataatgattgtccacacgaaattacctcctttggttgctccatgcatttctctggcacaatgattgtccatcactaacgcatcctccaaccccccctccccccctgcgcacaagcatatctcggtggaaaatttccccccttttttttcctttttttgttgaatttggttaaagtttattcagattcagttacattttgttaaaatttaaaataattttgtgcaaaaaagtatgaaaattccagaaacttcaatccaacaggaaattgaaaaccctggaaacggattccctgattaagatccattgagtggatgtccttttgtatacattttctcttttttcaaattcaattcaaatgactgaaattatgtttgatagtatagagtatagtgacatctgtgactttacaattcaactataatagtcgattaatagagaattgatttcgaaattttgaagatgaagaacctcaattcagctattttgaggcaggaaatttgttcgcgagcgagagagctaataattcttttttatgctagataaccgcttgcaacacacttactcttattaaagaactacgttgagtacatcttcattggagaaatctacacctacatttctcgaattcttcatcgagttggaatacttgaaccgaagaccctttctttcgccatgataacctgaaaattggacaaatgaaacaaaattaaaccgaagttccactgaatacatgatacaaaccgaagtgggattccctaattaagatccattgagtggatgtccttttgtatacattttctttttttcaaattcaattcaaatgactgaaattatgtttgatagtatagagtatagtgacatctatgactttacaattcaactataatagtcgattaatagagaattgatttcgaaatttttaagatgaagaacctcaattcagctattttgaggcaggaaatttgttcgcgagcgagagagctaataattcttttttatgctagataaccgcttgcaacacactgactcttattaaagaaccgcgttgagtacatcttcattgcagaatactacacctacatttctcgaattcttcatcgagttggaatacttgaactgaagaccctttctttcggcatgataacctgaaaattggacaaacgaaacaaaattaaaccgaagttccactgaatacatgatacaaaccgaagtgtttgcagggtgaagctttttgcacttcttttccccaatctgtatgcagtgtgatgaagaggagcatccctactttactgatactgccacacacaatgccaagccaaagaccctgttttatggaaacagctagcaggttcaatcatctggtttcacaatgcatcatcatcatacaaagctacaccggaacttttctatgaatcagcaaaaaaacaatctgcactgcatattttgcataagggattgagggagtagtgctacctctccatttagatggaggacaaatgcaagaagcacagccgtcggaataccaaccaagtaaaacgcgccaagattcacatgagcgccaatcttctgcttaccacatcctgtcaaaactcctgaaatgttccgaggtccacgcaattttattactactgatcgacttaacgatatgaactatccgaaaaactcatcgatcgataatgagaaaaaaaagtacagctaaaatgttttgataattgatcgcaagtagaaatatggtatggatttgcacctgaaagagcaccattgatgccatctacgaagaaggagaccgcgaggatggggagcatacttgcaatgtatgccaccacttcctcctcgttgctgtaggcgtatccccagacattgcgcagcagaatcatggctatcactagcacgaggcatacaagcactgtcatggctgtggccactcgcactgccatccttgctgctcgaggatgcccgccacctagttcgttcgagacgcgtgtgctgcgaaagtgcaaaattggtggaactaatcagttcattgtctaatccaatgacatgaaagctgaaggaagaaaagcatgtttgccatgtaaataaaacttaagtagtacaagggtaaactgaatttggtcaaaacttatttaaactaagaaggcagcccgggcatatgtgcgggctttccattttaatgttctgtaaaacaaatattagagtaaagttaatattcaatttcgaatgggttttagttgagatgatattttattttattttattttaaacttcagagatctctcaaaaaggtatttgggattgctttcaacattggttatgactgcattgcaattactgtaggaacacgtggattgtaaactaaaattacttgaaactgtgaaatctttattttatggaatttttaccactactacatgctacgaacttatgggtacgcatagcacatatcctgtcaccattaccacaaccacttctaggacacttgggtgagcaagtccctcattctccatcgccacgctttataaactgctaaacaatgcatttcgtgcaaaaatctttctatatagaagtttctttaaacagataaaacaaatatacaatggttagtagttacgtaatcactcgctaatgacctttgtagattttgtgccatggaaaatctcacctgagttgttgaaatgaaagtgtccttaaacaatgcaccatactatatgctacaaacggtggtaaggtgttacacataagctatttctatgataccaaaggcaagacatgctttgtacgaccccgatatgatgctcggatcatcatctatcctttattcattatttgactaaagactatagtgaatttaaaaggatggatgagggaacatggtcggattcataaaaataatggcacaaccaattcgtgcataaggcatctcaatattgaagtcaactgactatgtgtaatttcatggtaaaagagagaactttgttaagtttttttaaaagacattagatatataaccatgtataataattgttctataccgatttatgtaaaaaaaaggaagccagatgtttttcttctcttatactaagaatttataggatttccaattttgttggaagtatcaagagaagttctagatgtcttaggagggattagagtgtgtttaatggacattgaggagattttctcgaaattctagggagttggccgcttacttggatgaccatccttttgaatgttattgcaaaattattttaaaaattggacatgtaaattaaggataaattgaaggtcggatgatttctcttttaaataaatgcctgtaattctctttctcaacaaacaccaaaaaactttcatcgtctattagataaaagatagattatataagtacaaacatacatcatatatattagtcatgctagaaacatttgtgtggatggatgttttcatttataccagcctactctttaatcctttttcctatatagttggtacccactacaagttattcatgctataaagctcaaattctgtgaggccacatcatcaagattatattgattattatatcatctcgcgtctatgcaaatcaaccgttaaatcaagttcttctcagccaatggcatgtgagaggaccaatgctttttgtcttcctcttaattacctcatgcatatcattatatctccctttattactaaccactaaacaatacatctcccacaggaagcctacaccactacatttgtgtctacctctttcttattccctttaatttttctattgcatctactagccatatctaggctgatgcaatggattttcttggaatatttatgcttgaacatgcttcctcagtcatctaaggaggaaatgtcaatggtccaatgaaattttggtttgccactgtcatagatgacatcgaaaatttattgggacatattacaacactcgatgatctttacaaattgcaaggatatctatatatgtctatctcctatggtgattggtttttggtattctatcatgatcttgcttcttttcatatctgatttcttcgtttatcaccaagcttcatatgtcaatgtatcacaactatggtaacttaaagtattgagggattggtccactctttgtgttaaaaggctgattaaaaggctgtgccaaatctttgtgtttttcagacttgcgatcactgaatttgtttctccacaattcctcccatttactcataggtgaacatgctgtttcttgaaattactagattcatgcacccaatatgtttttttaagatcatataccaacatatgtatgcaacattatccatattttctctttgttttctcaaaaaagaaatatttcattagttgtttaatatatctgagtgagatcttaagccaatttagtacataataaaaatagtgtcatgtttgcttactatttatggttcttcaaaataggagtatcttaattggaatcatgtcatttctattcatatagcaatacaatgtacagatagaacgttcaagcatgttgatcatgcaattatgataaatttacaactatatgttcccttctatgtaatgatactataccaataatcaaaagttctagaattacatcttacaaattcacgatatagctatcccgcagcaacgtgcagggtatcaactaattggtacttatgcttactcctactttcttagtatctatacacatgacatgcaagatgcataagatgttaaatttgtgcaaagtaagaaatatcggtgttcttttgcgattaattagaacatcgttatttaggcacatgacgtagtgatgaccaaattaaagatgaaattatgggagggtttttttttccctttatcagaattccaacattaattttcatatttttacctcagtttttttttaaaaaaatctatgggttttggatttataagcaaacccattgaaaaaatctagatggatagatttgtggagctacgaatatccagttaaaaaaaatcatgaatccaaaacaatattaaacatgcctttttttcagccttaacctattagcatctaatgggcagttgtgactcagttgctccatacatatggatatatacatggcactaatatttgggggtatagtagactgagccctacatattaatggttttatcggaagaatataactaattataaagagtagaggatattcgataaatatttatggtatagtagaatattctattttttataatccttaaaaaatggattttgataggaaaaaaatacttcccataaatttaaactgttattttttttccaaattttctatatttttctccttttttagactctctactaaagggtctctcatagacttttagggatcagtagcacaaggtttttttatccgtgttagaatatatttttattaccattggaacatggccaaattgcattctgtaggacgcttgttcctttcaaaagggagcgaacagaaatacactaatcggacagaacaaaaggttaggagtagaaagataccgatgagttctgatttctctgatgaacgagaaaaggtaaagtgaacagctgtgacgctacggagataataaaacccagttaatcgtgaactatatatatacgtacattcatctagaggactgcaattttgctcccatcgtgaactatataactgcagattgtttggaaacttggagaagctgtggtgccagcactgaattaacgtgagtactagctgatagcctgatatacctcgtgtacagatgggagcaccatgccggtcaaccggtgcaggcccacatcattatacacgatggtttcgattttacttaaagcggagaaataagaggagaggatgcagggtggccgtgcccatagtaagggggtgtttagggcaatagcagtataagctatggggcccttacccctagcccaaagtcacagctcaaagacacacatcccacagtgcaagtacccatatatgtgtggctaaatgggatgaaggtactatatatggaaagaaacccagcccacagtgggcgttacccgaggcgagtggtcatgaggagcggaacgaattaattcctaacctacccttccagcgactcctctcccagcccttcccctccccccaatccgccgcacccgccgctcctcgtcctcccaatccgccacacccaccgctcctcctcctcgtctactgtggcgctccgctccggccgcctcttctcccgtcgacggcgccgcctcgtcccggtcagccgcgccgcctcgtctcccgtcgaccacgccgcctcgcctcccggttgaccgcgccgcctcgccgaccggcaagggcaagggggaggaggaggatgaggaggtgggggagtagatccagcgagcggcgaggaagagggccgacggttcttgttcagccgcgcgagcggccgccggttcttggcggcgggaggcgtcccggctgccgcgggcccgtggcggcgtcggccaccacagcccgcgccgccgctcctcctcccggtccgccgcgcctcctcgcctcccacgccgcggggaggagggagcaagaaggcgtcgccacccactgcacgcggcggcggcgagaaggaggaggagtaggaggtggggcagtagatctggcggtcggccaccaccaccggcctcgccgctgcccaccgccgatcctgaccctgccggcgccgccgctgtcagctccgtcaagaaatcaagaagcgaatcactgttcttaatatttttgcatgttctgttctccagttcttgatgagaaaaatcaagaactgctctcctgttcttatctttgcttgtcatgtgtatcttcagttcttgtgatgtttgttcctgtgatcctactcctatctatacttgcttgtcatgttcttatcttcggttcttcgtttttcttgctttttcttgattcggtggcgggaggaagaatggttgtggcgggaggggaaatcgctggggcgggatggggtttttcgtgggcgaatcaggaatttcttcactggatgcggcatgaggtcacgacgcggcaaagaaccgaagcccacagcgcaggctcctctcgtttttttggccgcgcgtggactcgagcaaacaagttctgcgtcgctcagtatggacgcgaagagcctaacttggtcgcgggcactcgtttcacatcggacaaaatcctccgtggcaccccatagcaccggtcctaggtggagcactgtgaaaggcccttagatccaggggatataaagtattggtgtgtcacatcagatattatatagggtgtcatatggggtgttcggaccctaataaaaaaataattgcagtatccgtcattaaaccacgagacgaatttattaagcctaattaatccgtcggtaccacatgtttactgtagcaccacatttttaaatcatggagcaataaagcttaatagattcgtctcgcaaagtagtcgcaatatgtgtaattagttatttttttagcctatatttgatacttcatacaggtgttcaaacattcgatgtgacagggtgtaaaattttgggtaagaatctaaacaagctctaagatagaggggatcggaatttgttttcatattttagggataacatcaagtggttaaaaataacaggtccaccaatataagtgacaattaatggtaagatttttttcttcttcttagaatttttaattagtatttttttttgtaatttattaaaatgacatgtggtggtttaggaacgtttgtaggaatcccacgtgacggcatgagagcgtttgtaggaaatttaatgaacctttagtatataatagataatagataggtagattgatagatttcaaatatcgtcgttcagaaattttggggaatttagaagatttcaaaaatctcagtcccacaaccccacaaaaaaaatacaaaaagtgcaagacaaaattgcgaaccctgtatgagaacaactcagtagggcactgttctaaaagatgataatgaagtaatggagtttagaggcgatacagaccttaaagatgagccaatgccacgtggcaccatgatcaggagagaagcagtgctcaagctgcaaattaaattggagttaacaaattacccatgggaaggaggagagctgatttgtatgtgtgttgcttatgatcaaattacctgattgacagaacagcagtttcaagctgaggattcggcagaatgccagagagcagcacaagtatctcaaacgacgaccactccaagctgcacacaaccaaatcaaccagctaatcctcacaaaaatattcccaaaatttgttcaagcaagattaatttgctctctcgatcacaaaacatgttccaagatttgctcaagcaagcaagaaaccagcgatggtgttgaaagattccaaacaatctgcaagcaagcaaacaagatttcctcggcttgtttggtaattcgagggaaggggattgggagtttatacgagagaattgatgattagattaagatggaaatttgatttttaatcccaatatcttgtttggtagaggtgatgaaaattggtagggagtttagttagagattaggtcattaataaaaacggatagctgagatttgcttagagaaagtaaaggaggaattctctcacaattacctgcccctacgcgggtattgaaaaggagagagttccttcctcaattctccatccccatcccactaaaattcccatgtctctcaactaaacaaaacacttaatagcctcatccctctaaactcacaatctcttctaaaaactccatccaagaaagcagagagacacttgatgggtacatagggctccttgaccaggtcaaagccaccacggagagtgctggacgtggtgctgccgtattgctactgttgctaatgttgtgcatcatttttgtttcttcccgttcaaagaacgagtttgcatcgcccaccgccttatcgacatctgcacgtctccgacatcggcatcgactccaactttctcttcatcatctagccccacgcaactttggcttgatcatccgttcaaacgcctggctacgacgagatcttgctgccgatcatctacgagcaagtctactacgctatcaaactccgggttgccactgcgttgccccctcgggctacagtgccaccgccccgtgatctacctgtactggttgttacagtgctaagagacgccctttttagcatggctttatcaccagtggacttctcgccgttgcatcgatatggagctgcagctatatgttgtcctcttggacaacagcttcaccgctttcgtcgtcttcattgccgttcgagcatcaacaatttcgtgttcgcactggtcatcgccagctactcgggttcttttttgtctacttcgagcatagccaccgtgtctctaagttgccaccgtcgccgctctaagccggtggtccaactacttctaaatggctggcatgcaattaaataaaaattacaacctacttctattccacaccagaggcttgagggggcccttacgtgagggggagtgttggaatataaagtgaattgcccatcattcttcatcagcttaagcttttaggttgaactagtcagtgcatacaactcaataaatggtgtcaggcgtgccactgaccagaccatcatggcggacggcacggcgagctcggtgaaccggcggagctccctgaaggcgttcatggagaacccggtccacgtcgtcttgcaggcgccggacagccgcgcgtagaaggcgaggacggcgaagttggtccagtacgtcacggcaccgctcagcgcagcgcccttgctccccatgccggccttgtgcaccagcgcccagcacacggcaacgtgggcgaccgccgccacgccggagctcgccatcaccggcacgacgatgccctgcgcctgcaggaaccggagggcgcaggcgagcggcacgtaggccgcgagcgacgggatcatccaccgcgcgtacgcgccagcctcggccgcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccggactgatcagatcatcccaccgagaaatcagttacaaattcgaccaagaaatcggagagacaatgcagttattgcgtgcaagcaaggtgttcaacgggtgcgtacgaggaggctgaagccggtgacgctggcgagcgacgcggcgagggaggaaccggcgagctggagctcgccgaggtggccgacgaacatgacggacaccatctggaccgagttccgcagcacgaagccggccatcagaggcccagcgagacgcagcagcctcttcacctccgccgccgtcgacgccatggctccgtcctcgccatctccgccgcgtcggacggcgagcagtggctcctccacggttgactcgtccatgtcgatcgaatcaccaactgtgagacgtttattgggctgaaaatggtggattcgttgaatcgttgtccaacttatagggatgagcatataagttagtgtgttcatgggtttgatatgtttcgtttgtggcggtcaaatcggagaggagtgattctttttaccctccacatgcaggcattccatcattgtttaagagtaaatcttatcacacttattttatggtgcaagttacataaattaattataggatttttttagtccaagttacataaattatacgaattttggtacgtgactataaaattttagtaaaccacaccgttaactattttagacatattcctatatgaaaattttaaaaatagatgtagcatttgtttgatcaaaataaaaatgactaactgtgtatttatgtgaaactttagaaacataatacgtattatcatgtgctacatatcaaaatcattgtggttttatacagcttggatcataatagattcggttttatgaaatttactctcgaagagaaaattttatttaacatcataatacattatcgttgactaagatggtctcatataccatggtcacgagtgttaatgtaatcaaaatggcaagaaatatagtgtgaaatcatcaaattttacgggcaataatggaacagtggctgccagggtttgtgtgtggaaaaggtagtccagtatttgtggaccagaaatcaggaaagaatattcaaaggggaaaagttttagtttgagagaaatagaatagtgggattactttgtgagagcgcttttcaaaagtgacaaagatggttttgtatgtgacttaattatcaaaatgactaactgtgtggttttgtgaaactttagaaacataatacttgacattgtgtcacatatcaaaattattatggttttatgcagcttggaccatgatagattcggttttttgaaatttatactcttgaagagtaaattttatttaacatcataatgcattatcattgactaatatggtttcttataccatggtcaggagtgctaatataatcaaaatggcagcaaatatatagtgtgaaatcatcaaattttatgggcaatgatggaacagtggtgccagggtttgggtgtggaaaattaaggtagtcgcgatccagtgtatggaaaattactgaaaatcaggaaagaatattcaaaggggaaaaattttattttgagagaaacagagcagtgggattactttgtgagaacacttcagaagtgaccaagatggttttgaatgtaacttaatcattgtgtgatatctaaaaaccgaaaaactggtcagagtgttaattagtaatgagcgggaaaatactggggatgttccttgggctgatgtttgcaagctgaggctgaagactgaagagagtggatatttgtccaacctatagggagttaattaattaattaattaattaaagtggaactcggaatgtgtttggacggattcgattcgatccgtggaagggacctagaaacgcactactgaagattcttgcgtttagtcactcagttgacgtgttgacttgttttgtttgtaccgctcaaatcgtggttgccaaggcacaataccgctctgatgtcgtttgcatgctaattaatcatttgtaggtctcattataataaatacgacatgtgtgttgtttggtcttagatcagtccgcaattttgactcaaaagaaagtttgactttctatcttggggtgcaagtctgaatctccagcaaaattgtagtaggacttgggaatgaaacaggacaaaacagaaagcacctgcataacatattttgcgtatgaccgattattccgatagtgttgttgtgagtagacatgtgaagctcatagcccccagggaactggctcatagcctcgtagcctcacggaactgtctatatatcactccaaagatttttttttaaaaaaaaagaaatcacgagtataattacaatgtaataacaatgtaattttactataattgaaccagttgtatgcaaattaaaacaagatcactcgctggtttgcagatgcgcaatgacctcaactgagaggcacacatctcaacgcaaattatacggtccagaaatcaagtggtagctaaaaaatatattgtttcgaataatatatagcaaaatcaaaacctcaaaggtgaaatgaataaaactagactgcgattttttatcacctccatcacatcctaaatatataagtgatcatgcccctctctgatgtgaccatggctactatagatataaccgtcgttcacatcaaaatcaagccgtccaagttctgcaatccagttcggccacctgctacagtgtctacttcaaacggccgccaaaaatgcatgcgagctccgttttgggtccatgagtacttgctggaaagctctcggagtcatctttccaatggatccagcttcatcgccaaattccatcctagtcggccgaaatcacaaaaagaaggtgctgcgtcacctataatgggcctatgggcttgtaacttcgtctgggaccccggcccaagtggggtgcgccccaaccaggtggagcatgaccctagggttcccttaggtcgtcctcccacctccttaaatagttaggtacccctttagagtttcttgggttttgtttagatgaaagtttagccattgctacttcgcttgcagcgcgtgtgtcggctagaccgtccgtctgcttgtattcgaaaccccaacttatcgtgtgtattcattcctatttgcaattcagattgtttttatcttgttcttgcttgtttctttgatttgcttgcaggaataaggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcaggccaacaacagccttgagtgtcgagaggaactcagggttcatcactctccattcgttttcaaatacaagcggctttgatatcccgttagtacgcctgtgataatcttgtttacacccaaatttggcacctaggagtaagataggaaaaattgccaaattttagaaatctgccggtttcctccgagtaggccagtctgaccgccgtgtgttggccggtcagaccgccggttgagggccggtcagaccagcggcatgtggatggtctgaccggcaggtccgagtccgagtgtgtgtttcgccgggtctcgaagttttcttgcttgaaaaggcatgtttcaggtttcctttggattctatcccgagatggacggggaggagagcctatagagggcaagaccaacccctatataagggacatggccggttcaattataacagatcaatctacaatcaatcaatcgaatcgtttttcatattgcttttagtttttgctttagttcatccatctttgtcgatttgcgctgtaaatcgttcgccggcgctgcgagagtgcgacatctctttgtaggtttgtcctgaaaatcttcaattttgcccacgagacgggtagttatctaaaaatcggctccgctagccggtttagttatcaaaacccatcttggtctagtttttgctagattaaggtggttggcgactctaggattaccgcaaggcgttaagtgctgcgatcgtggttgtcaacttgtcacaaaaaattaccaactatttctacagatatctaaagataggctagttgctcagccatttacaaaacaggttttggccgactgcaaggacagttcctgtagtagtggatctaactgacaaatatggtttacaacatatttttccacgaagtttgattcgtttagtttattttgctcttcatgtttgtcggtctatcatcgctggctatttcgtcctcaatgatgatctaagaagacttgtttgggttaaaaagaataaaaaggaaggtagtttgtgtatatcttattgatcagtgtgttgccgtatttaattatagtccgagtcaccgatttgtttggtgatgccgctttgatgatttctcaaaaatggaacgaagatgggtggctgatccttcttttcatttacttttgcgcgagccaaaattggctaggttcgtggctatgctcgtctgctggcataacggagtatttatgaaaaatcctgaaattttcaataaaatcaaccatatctctctaagaaaaacattaccatcacatcacatcagatattatagttggcctataattctatacttggcaagcaagttccaccacgtgcaaaacagtaaattgattttttttaaagagaataaaatatctttagaactcgcgaccggctgcctgcttgcgtggaactttccaaaacatttcactgcagctgaaccctataaacagacttccggacgtcctgtcatcttctcaacttcactgtttcatcacaatctttagacttgagaattagggcctatttagttccgaaacaaaattttcacagtgtcatattgaatgttttgacacatgcatgaattattaaatgtagacaaaaaaaacaaattatatagttcgtcaggaaattgtgagaaatcttttaagcctaattacgtcataatttgataatatggtgctacagtaaacatttgctaatgacggattaattaggcttaaaaaattcgtttcgcagtttcatggtggaatttataatttgttttgttattagactacgttcaatacttgaaatgtgtgtccgtatatccgatgtaacatgtgtgagcaaatttttttccaactgaacaagcccttagcggaatacttaggctgtgtttgtttccttcttttcccaacccacgtctctcattttccacacccactcttttttagaccgctaaacggtgtattttataaaaattttgtacacgaaagttgcttaaaaaattatattaatatatttgttttaaaaaaatagctaatatttaattagttatacgttgagtcactccgttttacgtattagagggatcagttcccatgtctagcctctaggaaacttagttgatatatagcctgatacagataggctgatacgcatggacaagccactaagccagccgccgaggcggaggcgccgctgctcggcgcgctcgccaatcacaagcaacgcgagagcaccgcggcagcggaggccaagagactggtgagcctggcggcgccgctggtggcgagctgcatgctgtagaacatcatccagatggtgcccccgtcatgttcgtcggccggcccgcctcctcgcctcgtcgctcaccaacttcaccggcttccgccttctcgtaagtattggtcgaacaccttgctcgcgtacaagaagtgtctaatctctgcaattttcttggtcgattttgatcatcagttcggcgtatggcgagcgcgctggacacgcgccgaacgcgctggacacgcgctgtgcgggcaggcgttcggcgccgggcggcattgccttctcggtgtccacactccacaattcaggcccatatgtgttctgaatgactgtttaaattcatcagtaagtgtgtttgtaatagacttactgagatagctggagatgtcattttcccaacccatactgcttttatacctggaaggctgtgtgattatacatgaggtgctccatgagatgaaaagaaagaatctggaaggaattattttgaaaattgatttcgaaaaagcatacgacaaggtgagttgggacttcttgatagaggtgatggttagaaaaggcttccctagcaagtgggttaactggattaaaacctgtgtcatgggtggtagaatgtgtattaacattaatggagagaggactgatttctttaggacctttagagggacttagacaaggtgaccccctctccccgcttctctttaacttggttagtgatgccctagctgcaatgttggatagtgccaaaagggaaggggtcctcagtggcttagtttctgatatttttcctaggggtatcacccacctccaatataccgatgatactgttctctttgttgctaatgatgataagcaaatagtggctacaaaattcattctctactgctttgaagagatggctggcctaaaggttaattaccacaagagtgagatttttaccttgggtctgtctgacaatgatactaacagagttgccatgatgtttaattgtccggtgggtcagttcccaataaagtaccttggtttacctattggccctgacaaaatcctaaaccttggttttgatttcctgggccaaaaacttgagaagagattgaattcttgggggaataatctgtcccatgctggaagagctgttcaaattaatgcctgtctctcttcaatcccttcctatgccatgggtttctaccaacttcctgagggagtccaccaaaaatttgatagcattagagggagatattattgggctggaaacaaactgaaggggaaataccatatggtaaagtgggaggatctggctttcccctaagattatggtggcctgggtttcactgagactaggagaatgaacattgccctcttggccaagtggatcatgaaaattgaatttgaagatgatagcctctgtatagagttattgagaaggaaatacctgcatgatggggggttcttccaatgtaaagagagatatgcttcccaattctggaaaggtttgctaaatattagaagatggctgagcctggggtctgtgtggcaagtgggagacggctcacacatcagcttctggagagatgtctggtggggcaataccctctgaggatcctgtttcctgcaatttttgctgtttgcaatcaacaggagattttagtgtctcaggtcaaagaggggggtctggattgcttgtcttgtaggaggtccttttgtcctgaggagatttcagagattgaaaggacctatgaaagaagtcataggaaatattgaaacttctgattccagagattgtttaggttggggcctgtcagctaataaaacctacaccaccaaatccctcaatagagccctgacttttagaggtattagagaggtaaacactgagatttggagatgcccttgccctatgaagattaaacatttcctctggttagctctcaaagatagaattcaggctgctgagcaactgaaaaagagaggttgggatggatcagagttctgccagctctgtgatgttttggaaacaactaatcacattctttttaactgtgatatggctagatttgtttagtgtttttgccgagatgtcctcaattggaataccattcctagaaactttgatgatttcttttctctttgcaatggggtttcagaccatactcaacttagaatcatttttagtctgttagctgctatttgttggaatctctggattacaagaaataacatggtgtttagagagaaactggtctattctccactaactattccttttcaaattatttctaatcttttgcagtggagaaaactctttcgttctgaggaagaatgcaagctggacgcgctggtggaaaggatccgccagcgcgtctgggccaacgacggcgagatccgccagcgcgtcgaccaggacgcggacatcgccgccgaggccggcgccaacgcgcgctggaccatcctatcgctcgtacgtcccctaccacatccggttcctgcaggtgcagagcgtcgtcgtgccggtgatggccagctccgccgccacggcgatctgccacgtcgccgtgtgctgggcactggtgttcaaggccgggatggggagcaggggcgccgcgggcgctgagcattgccatcttgtactgcatgtctgcatcaacctcgctatgcttgctctctatgtcaggctcccagctgcagggagacatggacggggttctccatggatgcgttcagggagctccggcgattcaccgagcttgccataccatcggccatgatggtttggagtggtttggattattccaggtgttgtttcgatgggcctcaatctcgatccattcacatgtgtgggccgggaatgtgaactaagttccaaacccatatatgtcgatggcaatgggcttgaatagaaaatgatatagagaccgagcgcttgctcgggtggcaagcgtcgccggtgggcacgctgcccgcgagcgttcgaacttcgaacaccaggttcgacactcgtgctcgcccgggggaatttttcccctctttccccgggtctaacttcggttggacccggctaggtaatagggtacacacacgtgtgcgcgtttagtgggactgcacgtttcccatgcactgaggcccagtgcctccaatctcatttctagcgtgtgttagggacacgcacgcgtgtgtatgagtgtggtgtgtgtaagtgtgtattcccttctaaaaaaaagaatagaaaataatataagttgagttttcacaatgcaatctttggttacttgatttatgaacaagtctttttttttgtgtgtgcagcatggagtggtggtcatttgaattagttgtgctgctctctgggcttcttcccaatcctaagcttgaaacctcagcgttgtcaatatggtatgcgatgaaccctaagattattaattgcatataccataaaggaactaattatcgaaatacatcttcctcttttctactttctcacttgttaattatgtagtctcaacaccggttctctgatgtttatggtgccatttggtctctgcacagccataaggtatgaaattctcactcagttctgaatattcatttaaatatatgttccatgtttcactcaatcaattctgaatatccatttacatatgttccaaatttttctgtacatagtctgattgatttcctttttaaattttcattggtagcacgcgtgtgtcgaacgaacttggagcagggaagccttaagctgcaacgctgggaacaagagttgtcatttgtatggccttgtcttaagggtttatcatcacctgcacgatgattttgctacgcaatttgtggggatatatgtacagcaatgaggctgaagttgtcaaatactttgctcgttctcacgatatcctttttcatgatttctactgtgtaagtagagaataccggagcgtaactctaattgagaacaccacttcgtctgagttttatcagcatctctttaagaaagttaaaacgaataatatcttccaatacaaatcaaattagttacggcaagtccttcagatgaaatccaagttactatattaccgacacataaatcaagtccaaatgtccaatggcacaaatatagtcaaatcgagcatctgtgacaaggtttttttttttgtaacggaattgctaaagctctatcaacagaaaatccaacctcaaatcttgcaaattttggatcactggatgtggttcacgattcgtgctcttcttctccaactccggcaaccacctcttcttctccggcaccggcgaacccaaactccggtagagggccgacgaattagggttccggggtggggtggggctgggaaggggaagggggaggaggaaggcgggggagttcgccggctttagaggaatggccgtgggaggcggcagcccggcggtgggcggcgcatcgggcgggcggcgaggcggcggcggcgccgccgaagccgcagggtcaggagcaggcggcgggagcaaagcggaaagagtggtaggaggaggcggccggtggtggcaccccgccgccggcgacggggaagacgacggacagctcgccgctgccggcttgaggcaaaggagaggagaaggagggggaaggggagggggagggggccggccggggtggcctcgccggcactgttgacacctttcggccagccggcgaggccgggcggcagcacgctggggtgacggcggcggtggcggaggtggggggaagcactaaggagcggcggcgtgaagaatcgggaatggagagaggagagaggatttttagggtttggttgcctgcacgaatcttaaagcaatcggatgctccaaaatttgcaagatttgtaagggggttttctgtcaaatgatctatagacaatcccttttcgtaatggattatagtccgaaactctgtgagatgatgtagaagacaatgaagtaattgtatcactggaggagaaaccgtttgtagtcccgggtggtaaccccctttagtcccggttgtccaaccgggactacgaatccgggactaaagataaaaataaccgggactaaagattgatctttagtcccggttcgtattaccaaccgggactaaagatcggtcagccacgtggccggccaaaccatctttagtcccggtttgtgttaccaaccgggactaaagatcggtgcaccatttttttatttgcatggccctgtttgctgcatggttgattttatatatatatatatatatatatatatatatatttatatatatatatatgtgtgtgtgtatgcatatgtgtatatgtataaatcatatattacacacatatgtataatttaaagcacttaacattttatgtgcatatatgttaccaaaatatatattaacactaaagtaaatgtgtacatatataaatatatatatacatgcatatatagtacaattcatttgctcggtagctatagctacgacttcgacgccggcgttatgtcagaagaggaaggaccggcgttatgaattgtcaatccatcgtagtagaattcaccatcaggattaaggacttcttcgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgttgtgcacatttggtttgataggcagtgggcatactcagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaagtttttctttctaagtcccgcagaccaattgacggaaccgatcccaagccctacatatgcagttgtaagctatgattaattaattattacccgagatcaatataatagcaatagattccccgcgactttggaatagatgacattatattacatgtctatcagttggaagaccttgtcaaaaatcgtctcctctttattcattgagtcgtacatagtggctctgcatgcgtccaagttgaagaataacaggacccggtggaatctggaatatgcgtgagatgagatatatatgaaaatatacatgctatatgtatgggaacgaaatttgtttgaacgacaataaaaactcactctatgttgtacggcagtagtatgtacgtcttgaaatgctgctgcgttaggagatggacgagattgtcctctgtgtctttcttgtacttgtcgatcatttcggtgttgattttccaaggatcgatgaacccagtatcgtagaccctccgccgtcgggccctttgaatctccattctacaacgttgaaaggaaattattattgcttacatatatgccaggagctaattattgaacgaaacaaattgaactcaaagatactcacaaaatccatgcgctcagaagagagacgtcgagagcgtccagatggtacagatcgaagagatccttgaaatggatccagagaacatcttctccttgcaagaagtcagggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttgggataggtgcgcctcgaatcagctgatccacagttagaccggtgtctgaaatgaattctgttatgccaaaatcttcgccggtcaccaacggctcgacctcttggtttggttgttctccaagctgagggactggtttggacttcttgtgataggctctctgaagtgttcggtcatagtccgatatctgtaaggcctccttgtttgttgcggacattcacttgaagaagttcttctcgctcgggtcaataggtatcttcttttcaggactccgaggcttgagttgcctcttcacttctcctgccacataagcatcaagctcctcttgactgcaatcgtacggtggctccttgtttttggtggcgtcaactttcgccttcttcgttgcccttgtgcgggcaggcggtggagcttggcgagaccttgtcttgggaggtgcaggcggacacggtggaggcggaggaggcggaggagctggaggagccggaggagatggtgcaagaggaggtggcggaggagccggaggagatggtgcaggaggacgtggcggaggaactggaggagatggtgcaggaggagatggcggagccggaggagatggtgcacgagacgccgcttgtcacccagggaggatgatgtaccgcttgtgccatagtataatggcgtggcttgtgtctcgtagatacgtctcaacgtctcctcctgggtagtccaactcgaggtcctcgtacgcggcttccaccagctcaacttcgaccctcgagtatcctgctggaatcggcctgcagtggtaagtcccagaagggtccgttgggatggccattcccgacgccacctttacgtgatgagaggttatctattagtaatcaacctaagcagtaacttgcggaatgtacaagtcaaaaatcatcaaactacgagcataccttgattgataagttcttgaagggaatatgcagctcacatggtgtccgctgcgtgatctcatcaatggggcaggtggtttcatcctgggtttgcatggcgtctatgctctgtgatcctacttgccccgttgaggcgcagctactacgattgcctgatgggctgaccattgcaggaggaatgtacggttggggatcctgggacagatgtgcggccatacgttcatccaccttcctcttgcatgctgagctcgtagctcaataccctgtactcaagatctgcaatcttcacctcggtatctttcttgctcctcatccgactcctgtacgtgtggatgtcctccttaaatccaatcttccagggaatcacgcctttccctcgtgttcgtcctggatgctcgggagtctgtagggcgagtaacagctcgtccttctctctgtcgggtcggaatgtgccctgagaagaggcttccactgcgtccgttagtcgactggcagcctcgcgtatctgatcgctgaagacaagggagccatcaactgggttaagcgttccaccgtgagcatagtaccagaacttcgatcgatccggccatttagcggtggccggttcgttacccctctcaatcaaacttgcctccatctcctcccacttcggcattgcgacgctatatccgcctgaccccaagtggtgatggtacttcttcttggcggcattttctttgtttctggccatcatcgcttgcccttgttgccctgtcttgtaagcaacgaactcgtcccaatgatcccttagctttgggaatacgtcgaagtttggtgttagtctcttcaggatgtatttcttgtagagatctcccttgaatctctggaactgttctgccatttttctttagagtccactgtttcactatgttctccgtacctgtgggtagcgtgaacgtctcgagcattgtggtccacagcatctctttctctgagtccgggacaaagctgtcattatccccgcgtgcccttgttctgtgccagtacaccgtgctgacaggcacgttgtccctcacaacccaaccgctgtggcgtacaaaattcttggctgcttctgctgggccactaggtcggccatcttcgtccacctcagttatgatgtgccgaccctctatcttcttcgcagcacctcgttgtccgcgtgccctcttctgtccagcggagggatgacttccactggcctcctcatcgttcccctcctcgttcccctccgcatccctctccacgttcccctcctcgttcaagtactggtttggatcctcgttcccctcttcttcgttctagtactggctgcttccctctgcgattatatcatacagtatatgttcctcatcgctatcagccatctgtgcatacaaaaaatatttgttagatctataggtcatatttgctaaccgtaatattaaaactctactaatcttatattaaatctctaataatcttatattaaaattgtaataatcatatatgctaagtctaacaatcttatactaaatcggtactaatctcatattaaaattgtaataatcatatatatatatgctaagtataacaatcttatattaaatcgctactaattttatattaaatctctactaatctcatattaaatcgccactaatcttatattaaaattgtaataatcatatatatatgctaagtctaacaatcttatataaatctctaacaatcttatattaaaattgtaataatcatatatgctaagtctaataatcttatattaaattgctactaatctcatattaaaattgtaataatcatatatatatgctaagtataacaatcttatattaaatcgctactaatcttatattaaatctctactaatctcatattaaatcgctactattcttatattaaaattgtaataatcatatatatatatgctaattctaacaatcttatattaaattgctaataatcttatattgaaaatgtaataatcaaatatgctaagtctaacatacttatattaaatcgctacaaatcttatattaaaattgtaataatcatatatgctaagtctaacaatcttatattaaatctctaataatcacttctttacatcacttgcctgcgcgaattccttcgatggctagctaccacttcggcttgaggaacgacgacgtcgtcttctctgcaacattaccaggaaaatgtattagtctaaacgggccaagttacatatatataatcatatatgtattaccaggaaaatgtattagtctaaacgcgttcgttctcacacttttagtacaagtgcattcacgatcgtaagcatttcgttcacgttcgttcacgctcgttccagttcgttaacgtttcgttcacgttcgtttgcatttcgttcacgttcgttaacgtttcgttcgcgttcgttcgcgttcgttcacgttcgttaagcgttcgttcacggtcgtccacgtatcgttcacgttcgttcgcgttcgttcacgttcgttcgcgttcggtcacgtttcaatcacgttcgttcatgttcagcaatgttgggcacgcgcggcagtggtgtggcggcgcggcggcggcgtcggggagccgtgggccggcccggcggcgtgcgggcgcggcggcggcatgccacggcgatggcgtgggggtccggcggcgtgggggcgcggcggcggcgtggagtcgcggcggcatggcgtagcggcccggcggcgtggcgagctcgaggcgggggcagcggcatggcagtggcgacggcgtcgtcggcggtgacggccgcgtcgaagtcggtcgtcggcggtggcggttgaccgcggtgtggcaatggcgtcaccaacgagctaggcggtttatagagagagagagatcgagaacgagagagagagagaggcagcggcggctctcacccaagagatgtggcggcggtgtctgcggcagaggcggcgaggaccgccaagcgacgacgagagacgacggcggcaagatagagcaagaatgattacaaccacagtactcagcaagtctcatcgggagatgcatgattaatgcaaaggagtacaaggggtaataatataggggttaggttttgcagtaaagagcatttaaaagacacttagttgcccaaagctattttataaacacgattctagagctacacaatattattaatcaaggccgtggaccctcacgaacctgccttaacccaaggcctacgatgattcggaccgaactggcaacccgacctgggtcccagctcgtcccaagccaacccaggccaaccattccacattttagttgttaagcaagttttaagaattaaaccactaacttggatacattgctaagcttgcccataaccgagcgcgaggctattcgaatagatttactctgatcagaggtgtacatctttacccacaagacacatctttacttcgcattccatggccttggaacccgttgtaaacatgtgacataacccttcacccatcctagccgtgaacaaaagtaccgacccaaccctgcctacggccggtatcccggacaagtaggccaggattgagcccctagcaacaggatctagaccgggtgcgccacacacattggggtgagaccacccgcgtactagtccagtgccatggcatctcgactaacgggcaccaacccatgtagccttcatttgcctagacatctcgattaccgagccgcagctcgtgtagccttcatttgcctcagagatatccatcatcgcaacgacttcatccacctctatccgtgtccttttgttcaggactagactgagcaccgagttaagccttacccattagacatgtggttagtatagtagtgctttgcaacagaggcccgaagaccggtccttatgatagccgaggtgctcctagcaaaaccatgcacctcgagcctagcctaaaaccattttggaagttttgaatagaggggggaggtgtgtgtcaattccatcacaagtcaaccatttcacaatgtcaaaatgatatgagaactcccaaagtctaaagttatgaaaccacctagtgttgcctaattaatcagcgaagcatctacataaattcatactagtggaaccatgaatagattacccactagttggggttttattttcctagggtgaacaaggtgataaataacaatagcaataataataaggtcataacaaaggttaataggcatggctaaataaaacaatgataacgcgggaatttaaataaagcgataattcattaatttaaatcaaaataattttataaactgggattcaatatgctcaaggataatgcgacttgccgtgctcagagagaacagccttccgaaccttcggcgatgaccgcgaacctcgctaaccgccggaacgacagaagctacgcggagaacacaagcaaagctacaagcctataaagaagcaataacaatacataaaaagaaagcgcagggttctttaggttataacaaacattaaaagacttgaactggtcgattcggagttcgtatgaccaaggcatggtcatctgaagcttaatgctgttatatggagatttgtggattattataattaggttttgcaactataaaaaatgtgtaagcgctagcctaaaaaagacaggaaggctgcgctgttgacatgcggaccccacatgtcatcctaaggaaccacgatagaccgagtacacagagacggtccatgggtcgacggaagcagaccccgtgtgtcaaccgaggcgagtggccgacaaatggactccactagacaccacgcgggctgcacacgtggaaaccatgcggctaccgagcgggcacactaacacggtcaccacacgcacacacgaacgactaccgacactggtacacgggtaccggggtcgataaccgcacaacgggcaaggggcaacaccgaaaagacgaggacggggcagcgggagaacggacccttaccaccacgtgatgaggcgtgggaacgacgacgacgaatggctcggtagagacggacggaaacgacggagatgaacggacgacactttggcggcgatccttggatgaaggcgagacgcggccgacgcaacgcttgacgacgcggagccgaggacgaagacaacgacggggctgcgacgcactcttgacgaaacgcgggcgacgaatgagcacggcttgacgaagggagggccgacgacgagcgggaacgacgagaagacgacgagggcagccggcagcagctgcacggagacgaggacggcgtggaacgcgccactgcgttgtcgacgatggaggcggcgccacgggacgacgagccgacggagaggaacggccgaccggaggagacgttggcgaggacgaccggcgcggtggcctccgggcaaagacgggcagcggtcggggtagaggacgacgcggcgacattgtggtaggatggcgacgatgacagccgctgcactggtgaggcggcacaggcggctggaggcggtggagtggtggcgacaccactggtcattggcgaggacgcgtctccggtggtttccccgcgaaacggaggcgatgccggggaagaggatgcacctgcgaggccgagggtggcgacggcgcacggtcgtggtgggaggtgcggctggaggttggccggcgccggagagagagaaggagaaggcggggagaggcggggcggccacgggagagcgcgggagggggctaaaactggagaacggaccgagggggttccattttataggatgggggagggagccgggcacgggagaggtgggaacggcagcggaaaagtcggccggtggccatggaaagcggccgggattggcgcgggcgttccgggtgattaaaagcacgaatcaagggggaaatatgggggaaagagagaggaataaatgggtattacttccccctatttaattttggaatctccggtttgaatgaggtggatttggaggagggaacgagctagggttcacgggagagagtgaggaggccgggcggctggaggaaggagacgacgaccggcgcgtgggccccacgcgggcgcgcggtcagcgcgcgtgcaacgcgggaggggagcggcttgggccaagagaaggagggagagaaggaaagggagagaaaaagagggaggaagggaggaagggaggagggggattatttttagtttttctttttagtaaactttgatagttgttgttgttgcttagtaattatttccggtgttctgaaaattcaaataaaatttgagggctccttttagaccaaggagaatttaacgaaaattcttcgggccacattcgaatttttcttgtacgcattttaatgtttgccaatttcttttcaaattttaattaattctattattccttttagagaatgatttttatttcgggatgaatttatcaggacgtgacaatgagggcgcaccaggaatatatatacccccagatctttagtcccagttggt

SEQ ID NO: 80338 - DNA, 3033 bp, Oryza sativa
tgcctcggcagctagatttgattcggccgcaactggattttgccacattacgagctgctgcaagttaaggcaaaaattgttttttctgtgtgtgtgtgggggtgggggcggggggttgggatttgtttgtgtgtttgtgcttccacctttataatttttgtagcgtcgatcttatgtttggaataactaatgattgtccgattgggattttgattgatccttttgtgctttgtaagctgtaacggacagaggctgtcgctacatcggacatggcggatgaaaagttggggtgaccaacggaaaattgcagatttgcgcatttgcgcgtatgggatgggagcgacgcggtcgtgcatacggacgaaaattaggtgaagaaaggaaaattacgaatcttttaattagttaagataaagtaacacagtcggacgtccatggtagagtgaactgtgaaaaccagggtttcccaaaccgtcgggctcggggttaccgcgccccggcggtaagcacggtaaccgcggtaaccgcgaaaaaccgtgcaaaatttatcgaaaatttaaattattttttaaatttatttgaatttaaggaggttaccgcagtttttctatatcgtaccccgcggcaagaccggttaccgtggttactagcggtaatgtaaacccgggtgaaaaccaactaaaacagtggaaaaagaaatagagttgtttcaactttcaagaaaagaaaagaaatggaaaaatacacacaacaagggaaacacgatttaaaaggattggacttttcctcgcaaaaataaaagaagaaatcgattgggacttggggtttagaattatagcggtgatctctacgatcgatctgttgcattgccacctcgctcgcgcttttactttaatctgcggtgatctgtatgattaacacgtacgattctcaaactttcgtttcaagaaagaaaaggactcaaattcacattgggttttatgtatatatatatatatatatatataggtaaattaactggtgctacatggagtatgggtttcaaaattcaaattgagtatctacccaatttgaatgagtatgaattttttttaaatgtttagatatgatcaattaacttctttcaaactgaattttttttgttagattttgattctagttatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttatgtgttttatatcttggagcccgggcactatggagtcccatatggatatatatatagttgtacaatctcggattaattaacttatccctccatcgatcgatcacatcgtgctgttttatctctccatcatccccaccatcgccaattcaattcaattcgacgtggccatgacgcagacgaatcaagccatcgaggtggacggcgatcggctgtcgccaccgccaccggcggcgtcacccgccgtgtccgccgtactcgagaacgatgacctcgtcggcgagatcctgctccgcctcgccttccccaccaccctcgtccgcgccgcgctcgcctgcagacgctggctccgcgtcgcctccgacccctccttcctccggcgattccgcgagctccacccgccccgcctcctgggcttctacgtcacgagcctcaagataccgcgggctcacccgctcttcgtcccgatgccgccgcctgcacggccaccggagctcgaccccgtcgtccttcgcggtggcaacttcagcctcgcttacgagggttacacgaccagtatctaccagtgcaggaacggtagcatcctcctcttcaaggagaggcatgatcggcgcgagctcaaatacgcggtgcacagaccgctgcagcatcctgagagaggcctactcgccatcccgttctcttcaacacatgacgatgacgatgacgtcgagcctgatctcggcttcgacgacgagaatgtgtgggggttccacttcggagaggatggcggcagccagctataccggttatcggtgatgttcaccccaaggggagctacttccgcgtggttctacgcattccgggacggcggatggcatgtccataccaaggcgacggcacagctacctggcttgccaccggaatcagctgggttcgtcgtggtccgagacaaggcctacttggcagccacttcgagcagcgttcttgtgttggacttgaagtcctcgagcttgtacaccatccagcttccagatggggtggagttcccacctgtgatgatgtggtataatgatcgaagccacgacgttttgttcggacgagcgagcgatgattctggggtttatatcgccgatctgaaggagcctcagcttcgtatttggctacttaagcatggcagcactggatggactctggttgataccatttgtttgcggtcgatgtgcgctaatttgcacataaattgtgtgggcggggatagtcgtgttgtttacatggattatgtaggggacgatgctgagtttttgttcttgaaaacagatgaatgtgcactctacttggatgttaagagtaggcaacttcacaaggtttacgaggtgacagaaaaggatgaaatcttgttttcaatcatgccctttatgatgatatggcctcccatattccctgtgaggaaggaaatatcataataatggtgaatcctcttgcaatgttctttcatgttattattatttgttccacaatgacacctgttagtgcttttgtacaatgacccctagtaaatttcagttttgctctatacatggtggtttaaagaggttgcacatatatatatatatatatatatatgcgactttttttatatactttagtggtggttctggagttccatgtataatgtatggttttgctttaggatgcggaaacttggaatacactaaaaacaagggctgcaggaa

SEQ ID NO: 80339 - DNA, 1987 bp, Oryza sativa
tgaactcctcccaccggaacgtctcgccgccgaacaccaccaccggctcctcctcccctctcggccgctccgtcctctgctttatccacttgccgccgccgccgccggtgacggtgcggctcacctgctgctgccgccggccaccatggccgtcacctgcgggcaccggcccgatgaagtaggcctcgtcctcgccgccccggccgtggcggtggagcagcgcccacggcggcgcgctcgccgggtcgtcgaggaagacgacgccgtcgacgaggaggcgtcggtgctgcaagtagggcaggaggaagaagcagagaagctgctcgacggacggattgaacttgaaccccggggagagcccctgcgactccgccgccgtcgccattgacgcagttacaaatcgctcccgcctagctagctaggtttgttttttttttctttttctttagaaaaaaaatcatggagaagaaataaccgttatatcgggagaggttggacttttcatcccgattcgggctcgacccctcgtcgttccgactccgaaaccgtccatggcccgtacttttacatctcggtcgtctctcatctcgtcgcccagtgagagcagcccacgccacgataggtgtggatagcttttttcgtaatcctattttagccttatattgcgttcttattttttaatatacgatgccgttgattttttatatatctttggttatttatcttatttaaaaaattatgtgattattatttattttactgtgatttgatttatcatcgaaagttctttaagcacgatttaaatattttttatttgtacaaatatttttaaaaaggatgaatgggcaaacatttataaaaatacaacggcgtcatatatttaaaccggaggtaatataagtttaggttaaaatgaataaaaaaaaagcccactttatttttgaaataactcaattttgtagcctaaaaatttaggctctttaccacccctagcacacgatcaactgaatatgcacacgtgcgtgtagcctcgcgtgggttgagcataaaaccacaatatattatttggttgctcgtattcacatagttggactcatcttacttacttacatgtacacttcgccatgttcactaaaagattattgttttagctaatcaaagatatattaatcaagggattaaaagataaaaacattattaatcaagagattaaaagattgctatgctttcattaatatgcagagaaaataagttcagggagaaaacgaggaggagagaatatatatatatattgatggttagaacgagaaaaaaaaagttctacaaaaatagtatacgtgggacaattcttggataaaaatataatcttatattgtctacataccgcagaacggataaaccatcggtctcaagtcgaacgaccccctaatttgaccatcagcctcaagatatgtcgctcacagtgaatcggcaaccagacactggtggagaagtggtttttactcccggttcgtaacccccctttagtcccggtttttcaaccgggactacgaatccgggactaaagatcgctatctttagtcccgggtgaaacagccgggagtaaaaatcgatctctagtcccggttggtaacaccaaccgggactaaagatactttatctttagtcccggttggtaacaaccaaccgggactaaagagggaataacagcagtacagatggtcctcttttttcttttttattttctcccgaatcaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagttctacaaaattcatcgcaaatacatcacaagttcacatcacacacaaatcaaatacatcacaggatcatgcaataaatcacaaattcttaaa

SEQ ID NO: 80340 - DNA, 3585 bp, Oryza sativa
tttgaataagacaaacggtcaaacatatttaaaaaagtcaacgacgtcaaatatttagggacgtagggagtaattaataaataatattcgatagatatcatacaattgatacgactctatatgagtaaatcagattttttttaataatgaaaatatatcacacaagcaaataaataaattagatctaaagatattctctccatcccaatttgatcatcacctaacgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttcaacggaacatcgaaaacaaaatgcaacaattttagtttaagttatgaagttagcaagatggatcagcaggtgcctaactaatttaatcgagtaatcgatcggcagcaaaagaaattaaacaacaaattaatttagagaataatcaatatggattttctatattgtatttgtattgcatgatcgaaggaaagaattaagagatcatgatcgaagatgagatcgatcgatcacctcggtgaggtcgtcatcgttgacccatggggacgctacggacatgttggggaggacggacgatgcctccgctgtcagcctgcagtgcggcggccctcctgtggcggtgcacctcgggaggtggacgacgacggacggaagccgcgagggggcgcgcgcagccatggttgccggccgcacgactacggagccgccgctgatgaggaggccggaggggcgcatcatctctcgctgcccgcctggtcgatcggtgtagtttgttgcaggccggggcttagggtgtgtatatatatatatatcgatcgagttggagaaggaaattaaggtaaaaccctaagccctaggagattatatatatatagtatacctattattaattactagcaaaaatacccgaaattgctaattcgccgacgtccgcgcggatgaggagggcggcagaagccgcgccgcgcgtgggatttttttcggttttctttgtatcttttcggtatttcttcggttttttcttccgttttttttttggtttttttacgggatacaaagtttatatacgtgtaaaaaactttttatgtgtatacaaactttgtatacataatatattttctagtttttttattttttaatacatacttatataaaatttatatacgttatatacttatgtatatacgccatatttaacaagaaccccagcacccaaccttggaaacgaactcactacgagagggcgggctctaatccttaagagtattttaatagtatagccaactactgactctaaattatctataaataatctaatagcccatttatacaatagttaactataaaaatatactacaccattaatacccggtcccacatctcatacacacataacatattagagtccgtgttgcagctagctataaatttgtagcccgcttttttctctcttctctttttttctcgatatatgcagtggttatagctggtttatagtctactactattgtacctgctctaagcgaggagatgacacagggtgccaaaggttggggccatcgtcgcggccggtctttccccggcctccgagcgttgtaaccagtgctaggagaagctggatcgggaacaaagatctgattggcacggagcagggggaccggcgctaggagatgtagtaccaattggatcaggaataaagatcgaattagaaatggtaataaaattggtcgctagcatgcacacattctccgatgttgcattaattgtattccgatgaaatccgcgtccataaagttatatgatgatcaatttgagaaattttagatttcattatataatgatcaatttgggaaggagagagtacagtactctttagctagttggagccactttttaaataaatggttcaaagctaataagaacgtgaattacataatactttaaagaaattggaactgctagagaatttatagtccgggttgcaacccctttagtcctaggttgcaaaccaggaatacgaatctgggtttgtgaagggagctatctatttttgatttcctattttttttcagcgtcattatgtcaggtgagatgataaaaacactacaaatattttaaaagactataaaaagtgcccgtgcgttgcaagggaagaaaaaacgagaaaattgaggaacaattgagaaagatttacattttgtagttaattaaattataaatttcctgagatatctaggtatttttaaataggtagatgtataattaaattaatttataagtaaagtaagtgtgggaaataaaatagcatggctgaatttaattttttattaaattcttcatgattatttacactctttgattttttctcggaattttcaaagattaattgctattttctataatacaaatatcatttcagcatttatttaaaacaaaatctaaataaaaatcctcatttgtgtatgggccttttttagccaattttcttcctcaacccgtagctaagccggcccattttcctcctttctccttccctccgccttcccatatctgtccagattctctcagttgcccaacaccggctgaagccacctcttgtgaaatcaggtcatttccttatagataatctaaaattgatcgagggtttcgattcttatcttttcatttttccgttgtcccaaaaatcagagaaaatccattgtgtatcaaactcggaattaagccctattctaaacaagcaaactctaagtttagtccatttcaattgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaatctcccatcaatggtcatgccctgtcctctatcccattccgtttctcctctctctttctctgcgatacgatcgctccttctcaggcttgtgacgtgcacctgcatcccgcagtcctggcaccttttgcatctttgagtctggtgttaatagagatggcaatggttaattcaccgtcggggtcatgcccgtgtccccgtcaccacggtgaaaatatgtcactgtccccgcccccgtcaactacaacggggctataatttctctagccccgatcaccacgcggtgaatttttctccatggtgaacacgtccccgcttaaacaacatattcacaatcacattatatcaaatatatccaaaaactccactcaaca

SEQ ID NO: 80341 - DNA, 1050 bp, Oryza sativa
ggccttttttttaaaaaaaaaagaaaaaaacttgagggtggtatactggggcactggctttgttaatttatctgggcttaggccccgtgttggggagtttctgggcactgtaagttgtcctaaaatccccttaaataaattagattctcattcagatttgattttgagttatagaatttagtaaaaactaaaagaagttataaaacttaactattatcagaagctgattaccaattaattatcctctaacagggcctagtcaccgttcgttcgagcagtgctaaacaaccgcacgtaaaacaagaaaactttttaggacatgattaattaagtattaattattataaactttaaaataaacttatttgatttttcagaatattaatttgtatatagaaagttttgcaaaacacataccatttaacacttcgggaaatattctcacaaaatacaagggagtagctaacccaaagtgctcaaaataactcagccttattcctttcaaattattcaccaaactttaaagcatattatttgctcaatgctttgaaaaatacattttctagaaaaaaatcttctaccacattgcgtagaccttgtgtttatattttaagctattttgttaagtgcatttatgaaaatattaattcatccaagtttaatctgcagtaacacttcacttaataatttatgaagttagtagcttttagttgaattcgctttaactggtagtatatatttgaaagtttggccattttatttataaaagttattatgctgcatagctttcgttcatcattgctttaaccttttaaaatttatcggtggttaaatgtaaactaataatagagagcattgataaatattgaaagcggttttgtaaaaggagagttgaaaaatgaaaggagtaaaaatcagatcgtgaactgcataaatgcaaacttgttcagtaatgaatatggtaatgtactagacagcttcctagtaaagccatgctaccactgtggtggtgctcttttcttttgaagatgaagattaagttttttacgt

SEQ ID NO: 80342 - DNA, 3509 bp, Oryza sativa
aagcttacaaaagaagaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggtgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgattctcgacatcgtctgattgatttatcgtttgatttgatgtcgattctcctctactttatggttattctctgcaaaaggttagtaaacctaatactagtggaatattattattctaacatgtttaagcattgcaagcatcactagttctcctctattttggaaatattgacggtcgaaactgatcgataacgaacatcaacaaaaccccccaagcttgaacctttgctcgtcccgagtgaaggatgaaaggaaacaatgacttggttgttgatcaggagttgctactatgctgcatatctcaatgatataggtgcaaggtatatgtaccctctctcagattaaataatcttttgcacggtggcttactcttacccctgattcccacgagacactgcttctccttgccttgggtggttgaaagaaagaacagcaattagagcaccaatcacccaacattcattcaactcttattccggaagttttgaaatgatttttgtaaaagaaagccaagttcctcaagtgattcgctcagactctctaagtgtatcaatatgacttcctcaccagattttgcctttttgattcctactttaaggttttaatatgtggagctcggtagagatcaaacatggcatacttgcattcacatttattactaagtcaaaaacttaaactaaagtagataattaaaacatactaaagatcaagatcgtgcaatgtgtgtgtggtatatcgtggaaatggcacacgaggaaaaataaagaaaatgcttctcctttgtgcttactttcttctcccaaaaaatccttcttttattgattagaagagggcatggctatttatttattttttttcaacatcatgctcatgcttgatggagcataactttattttttttcttttcataaccatgccttttccttcttctctttttttttcaaatggatttttctttttaggagaagaaagcatatgaaaacatggagaatttattttgttggtaacatggaaatggaatggaatatttgcttacctcccagtgtaggagtttggcatgtgtgtcgacgggggatacccgtagaccggatatagagggtattggtgtccgttggtacaaggatctacgtagtacgacatcaagcaaacaaaagaaggattatactggttcagggcccttggtaggtaatagccctaatccagttgatatgagattatatgatggaaaacacagattacaaagggaataacagaactcgatgataccgatgagaccgtagtcgagttggtccgactagatctcccggcgacttggctcctgcatgctccggctctgtaggctatagtgggtgtgttggcggtgatattcgatgccttaggtcctgcccagggggttccttatataccgcgggtcagttgatctctaagtaggactcggagatatcgaacccctcatgatatggtaaaaacccagtcttgtccgagtagaactccttccatccgtagataccatccctatcccgtgatagatttccttaatgtatacggaaactatctgtatacgcgtgggtatattgtatcagtatacaacgtacatccaaggatagagggtataacttatccgtaaccctgacaatgtgcatatatgtgggtgtatgatcttgatcatagagcatgagaagtatctacacaagtcacaagagtttgacaaagttcaatggaatggcaagtaaccaaaatgtatatggtttaatcatgatagcacattttttgctctggtaggaatttatatcaaatgaggaactttcaattttatcattttgaaaaacagaacattcggaatgtaagtcaaactaggatcatgatcatagtaacacttatttactatctcatatcttgcaacaacttagactcagattagcaagtgcagctcatttacctcaggttcctagataattgttggctacttatatttaacctttgagagagcacttaccatgaacccatatataagagatataaaacagagcaactattcatcatttcaacaaagagaactggcttgtcttatctagcatgactcaaacctgtcgtatccttttggtattttctactttgcaaatttttatattgttttcaagtttataagatgcaattggaaagcaaacatgcaattgaaaagggaaatatgcaatgtgatacaagttaccgcagtggggggagagacatctctccccccaagcttggctttcgctcagggtccttgacaaggattgaaccgttgaaagcggtagtacatttgaaggtcatcgtgctgttgctgcatcatgttgttgaagtttgcgaactgagcatcagcagattgttgccattcttgcgtttgtgctatgtgttccgtgaggttgtactggatctcccccgtctgcatataaagggtgtccattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatcatacatttcacaggagcaattttg

SEQ ID NO: 80343 - DNA, 2866 bp, Oryza sativa
ttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggtgatttccggtcgtgacaaccatcatccaatggatcatcacaataaacaaaatacacaaataggcatcatgcacacgttagcttagaaggcactgtcttcgactcttcatgtctcaaactagtgcaagtctctgcatgcaaaagacaagcaaaatacataggcattagtcaattatttgatagcaaggaaatgaagggagtacaatgcaatagtcaattatttttagtttgaaaagaatacctccatcttatcttggatctcttgaagacagctccaaaaatcttgcaggttcttcattatcagcatctacaaaattagttgtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatggaaaccacagattacaaagggaacagtggaactcgacgataccgacaagatcgtagtcgagttgatccgactagatctcccagcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtagg

SEQ ID NO: 80344 - DNA, 1265 bp, Oryza sativa
acaaaagtacataggcatggctagataaaacagtgataacgcgggaatttaaataaagcgataatgcaataatttaaatcaaaataactttataaactaggattcaatatgttcaaggatgatgtgacttgccttgctcgctttcccaaacgtcggcttcaacttccacgaagagcggatcttccgaagctgcagcatctacacgaccaacggaaaagaaaaggattttactctaattttaaaagggtttattgcgtcagccgaggggagggggcgcgcggaccgggtccaccccacgcggcagcctcacggtccacggtggactgggtgcacccgggctcaccggccgacgccgtgggtcccacgcgtcagccgcacctaagggcgcgggcggctgacggccgggccccacgcggcagcaactcggcgcgcccgagggcggccaagccggcgcagccggcgggaggcagcgcccgcgcccctatggtcgccggcggcggccataggcacggcggagcggcggccgagagaggggaagggaagggggaaaataggcggcggtccacgactcaccctaggtcgacggcgacgacgaaaaaggtggccggagcgaaggaaggcggcggcgcggcttgggtcgacggggtcgacggcgttccggcggtcggtgaccgaaacggaggggtggacgaggtcgtggaggatgcggcgaagccgaaggaggcggcgccgaggtgggaggtggtccggggcgacgacggcgacggaccggagctcgacggcgacggcggagagagagagcgacggcgcgagctcgattccggcgaggaggaagggcggcgagaggcggaaacggacggaggaggtgcggggagggtttaaatagagccgggtcgagagagggtggcccgggaagggaggaaaccggcgcgggaggtccggccgccatcaatggcgccggcgagatttgcgggggcaaatccgcccgtttgaacgcgagagagagagggaaaaaatggggggaaaggaagaggggatcacgtggagtgatttccctctctttattgcacgcggagacggcgggaggcggcgggattcgcggcggcggcggcgctagggcgcggacgaggcggcgggagcggcgggaggaaggggatgacgggtgggccctacccatcagcgagggtggcgggcgggcccgtccgtcagcggcgggcgcgcggggagaggccggatgggccgcggggagaggagagggaggggga

SEQ ID NO: 80345 - DNA, 1537 bp, Oryza sativa
ccacgtggggctcggccgtcagccgcccgcgccctcgggtgcggctgacgcctggggcccacggcgccggtcggcgtgagccgcgtgcacccggtccaccgtgggccgtgaggctgccgcgtgggccccgctcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttg

SEQ ID NO: 80346 - DNA, 2584 bp, Oryza sativa
ctcccacccccacctccgcctccgcctccgcagccatgcagatgcaggcggccaccaccaccaccgccgcgcgccgcctcgcgccgaagccgcagccgcaggccaaccggtgccgcccctcgagcgtctccgtcgtcgcggcggggaggtcccggaggaggagcgcgcgctcctccctcagggcctccgcctccctcgaccaggaggtcaaggagcgcgcctcccccgccggtgagcgctaaacactctcatgactgcaaacctcgcttgcttgatcagcggaggggggtttgtgcgcttcggaggtagggctaggcttagcgctggatttttggtgccgccatggttgggttgctgattagtatcgtgaggtgaggtgaagtgctgtggttcgctttgagtggggttggttggggcactatgcccattgacgcgagttttgctacggcctcgctgatcaagtgcaatgagcacagaatgtgtatgctggtgcttggtagaggttgcccctccttttttttttttggtcctggaatgagttagcaatctgtaagtggtatatataattgggtgcaatctgattctcgctgtttagaattgggtggctgcagctgcataggatgacatagttgacatttcgagtatagcaattgtggcttcacaagctgagtagctccttagttgtaactgctaacaaatagatggagggttcaaggtctcaaacacttcatggaatgtattttgtgatttgctggctactcttgcatatttaatcgttgaagtttgttgaatgtgtttattgtgtgaaagctaccttgcctacattttagtttcacaaatacactatatcttccttccacattatatgtgcactggcttgacctagtgccatcagaacgactggtatttttcatgcatttatctatctatacatatcagcttcctgtcttttctgttatatgatgctaatctatgtaccatcttttcactgaattattcagctgggaagagtggtcaagcaactagaagagatgtgaggaatatagcaattgttgctcatgtcgatcatggaaagacaactctggtggattcaatgttaaggcaagccaaggtacattctagaagcttcttgttccattctgagattaatttcaaaattttaatgctaaggaaagctttactctgtagggaagaatatgtacttcatgaaaacaccttagaacgaacgacaaactatttgtgaaaattatttctgttcaaccacaaggttgtgctgaaaatcaatagtgcatttaccatttctgttgctgtttaaattatgcaggttttccgagacaatcaagttgtacaggaaagaataatggactcaaatgatctggagagggaaaggggaatcactatacttagcaaaaacacttcgataacttataagggtactaaaatcaacatcatcgatactcctggacattcagatttcggtggggaggtggaacgcgttctcaacatggtggaaggagttctcctagtggtactagctactgttgcggttaaatgttatataagaagattggcttacttcttatttgatgcttaaaacatattctattggcttcttttgcgcttcattgttcaataagtgttttgatgccatcacatcttgacatgccttatgtctatcaaaaattgtaacacactgcatatagggtactgattccatgttctgctgcatgctacacaagttcctatggaactgatttttcaaacagtgttctaatgtgaattgagaaaacgagctaaaatcattctattaacataatcctctatgcttcgtaggttgattctgtagagggacctatgccacagacaagatttgttctgaagaaagctctagaattcggacatgctgttgtagtggttgtaaacaagattgacagacctactgctcgtcctgagtttgtggtgaattcaacatttgagctatttatcgaattaaatgcaactgatgaacaggtaaatagttttgtccatacttttgttcattgatttgttctcttcctattccttatgttcttgttttgctgcaatatgtcagtgtgattttcaaacagtctatgcaagtggtattaaagggaaggctgggttatctccagaaaatttgggtgacgatcttggacccctttttgaggcaatccttagatgcataccagagccacgtattgagaaagacggtgcactgcaattgcttgtgagtaataaacttggggattatattgtcatgtacttaacttgtggctatgactttgcataatactttatatgcagccatcgtgattgttttcttggatgcatctgtaatttcggattttctctcaaaatggcaacttacacactgtatcactacatttttttcttctgtttgtttcttactgttattttcaactatggtaaagcttgaactttgggatgcttaactccatacagttgggagtaattactcccaagatgctgaaagccatgccatggatactaggttatgtaattatagttggaaatgactgaaatctgatagctaactagccaagat

SEQ ID NO: 80347 - DNA, 1536 bp, Oryza sativa
ttgcaggcgctgcatgtaccacatagctgagtcagttcttcagtagatcagtgtaccattctagtttcatgcaccagatgttttggtagtattgttaatatagaactgtagatagtccatatagcggccaattgtgcagtctgtatgtaacatggatatagataggtttcttgtgtagtagtagtaaataagctggttattttgctgccatgaaactggaatgacttgtgaacgtcgaaatgctctcgtgtatgtcggatcttcttcacttagccgttctcaaggatgagagcaattaatcttgtgatataatcctatatgtatttccagggcagaaatggaaaagaaaagggaaacctgcctaccacaacttttaagcctttgatctattgattataatctgaagttaattttgattttttttaatttgattcgtaagaataatcttaggtatatttcgcatctcctttacttgcccttttgactttcttggaaaaaagatatagcaaccaaagtgaggaagaaaacccttggtatcagtttgaaatcaaattctaaaattcaaaatcaaaatcagctttcgacgaaactagtttaactcgtttcgtccagcaacagttaaactagtactcctagcagtctagcagattagcatccatggaaaaaaaaaacccatctttgagtcccatcatgcaagccaggtacatagaatggtaagaagccttaaactaatccttccaatccataatcaaattagtggctgttaccaaattgtcatgaaatttctacctctccatgaccacatcaaccagaaactaatcccatgcatcttttatcatataaactaattgccactcaaatactgcaaccatggaaaaaaaaatcctatcttttgtgtcacatcattcaaggcgggtagccaggtacacagaacggtaaaagaagcctttaactaatccttccaatccataatcaaattagtggctgttaaattgtacttccttcgtcccaaaatataaaaactcagattcgtaatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaaga

SEQ ID NO: 80348 - DNA, 13754 bp, Oryza sativa
  unsure (1)..(13754): unsure at all n locations
tatgcagcacatgaccacattcccaaagtccaaaacggggcggccaaatcagatcagaaaattcagaagagggcagagacaaaaaaaaaaaagaacaaaaattccggcacgccgtcgcccatagatcccgtggagccagcggttcaggatctcggcggagatcaccacggcgctgctgttcctccaccagaccaagccggagccgctcgtgcactgcgacctggacctcaagccggccaacatccttctcgaccgcaacatcctgctgcaggtgctgacgagtccgccgccgacggactcgtcagccacactcgtctactccggtgacgagtctgccgcccatccccatcatccccgcctctccgccggcacccacctgtccgcgccgaccggccccacccaccgtcggccgcaccgccatgcgcgccgtccgctgccttccccgcactgccgtgcgccatgccatgctgcgccgcctggggccgctccatggccatgcggcacttggtcttctccatctcggccatcgccagcactgcctcctccgcgagccgcgcttcctccagtcgccgcccatcctcgtcgtccccgctatagatggccaaaaggcccgcccgacacggcccggcccaggcacggcccaccagccatcgggccagcacagcccgatcggcacttcgtgccgggccgtgccggctcatgggctgtgcctcccgcccaggcatggcccaccagccgtcgggccgtgccgggccggccgaaggcacgggtggcccatcgtgccttttttaaataagtctattttctatccctcctctttgggatgtgacatatatatatatatatatatatatatatatatatatagcgaaaacaagtctaatttcggtccctccactttgggctgtgacatatattagtgaaaataagtctattttccatccctcctctttgggctgacatatatgtaggtaaaataagtctatttaacgtccctattctttcgaccgtggcatataatatgtctatttttactccctattgtttatgtgtcgggcctggcctgcggcccatcgtgccatgccgggccggcccaatgtgtcggcggagaggcccaggcacggctcggtggtcgggccgggccggcacgggcccgacccttaacgggccgtgccgttcttgggccgggccaaaacgccgtgccgtgggccaggccatcagacctcggcccttttggccatctatagtccccgcttgtggacgagagagagaagagaagaggaagagggaagatgacatgtggaccccaccatttttttaataagaaaatgctgactggattgtcacgcgtacgccacgtaggacaaaaccactctggattggatcgagggggataatttgtccggtattgaaagttgagggtgaacgacgtctggttttcgggtttagggggtaattcgaacgaccgcgatagttcgagaaggtaatttgtaatttttccggaattgaaaaggctagtggttaccacttggcaaattctccatctttcttctgagttcctcttcttgatattcatcctgcagagtaaatggaagggtattctgtatatgtgtttatcattgcttcaactgaaaaacaagcccgggttgcctccttgttcatgctttatcttttttttcctgttttcaagtttgtttggattggactctaatttttaggaaaatatccactaaacttataaattgcaaatataatttctgtataaagtttatatatataaagtctagaaagattttaaaaagtttatatatactttttatattaaaaagtctagggtacacaaaagtctatatgtagaaaatttggatggaaatagttcatataaaaaagttttcgttaaaaaagagtaataaaaaaaggaaacaaaaaatttgagtggaagaaaaagaaaaaacgattcttatgaccatgatgaattactccctccggtttgataatacttgtcgttttacataagggtacggtcttttaaaaaacaacttttaccattattttttattatattatgtataaaagtgttaacaaatatatgattttattaaagtactttttaagactaatctattcatatagtcaccattttaaaagacaaatattttagaaatgatttataatcaaagattttaaagtttgacctcacatttatgtaaaacgacaagttataagtccggagagagtacgagagaataaggtacgtaaaagaggaaaaagaaatgaagacatacataagaatggagaaagaaaattgaaaacagcccatgcggtctccaaccttgaccagttcgcgataggctagcaaggcacagttgctgcgaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacgtccgttcactctcgggcgacgaccgtcaatgaaatttgcaggcggcccccttgccgccctccgctagggcgattttacactgtgcggggggccgcctgcaaatgggcggcgaggggggcatggaaatttgcaggcggccccctttccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcaaaatcaaacacaagtactattcaaattaccaaaatattggtagggcatgtttttggtagaaatccaaataggcccttagtcttacgcatacaaaaaatcaccatcataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgtcacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcntaccntgcgccntaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgttgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagaggtggcgaacgcgcccgaagaggtggcgaacgcccctgcggagctcgcggaagcgccggtcgtgcctgcgaacacgctcgaaggcagacgaggtcctgcgatgaggaaacgtgcagttaaaacatggtgacatattcgtgcaaaagctgaaacaaaaatgaactaatctctgggctgaactgtaccgtgtgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctatgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcatccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcacctgctagctgtccccgtcgagtcaacctgtgaagagaggtaaattatatggctcgatgaagtaagtatcataaaaatttagaaatgaacaatccgaactcacgagtggtcggcagggaggacggtcggctgcacgatgcccggaaacacctacctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagataacgtcgctcggctggagacggtcaaactcgaacacgaagtccgggtaacctcgtctcacctgtacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgtccaaccccgtagggtgcgctctccaccactggtcgacctatggcaaacctctcggctgcccaaagctgaagcaacatagggcagccagcgatgatcgctcccgcgtcagtcttcgtgcacgcctcaccgagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcatcagggtgcagaaggtccgcctacaattaataatgaaatgttactacaaaacactctgttgatcgcaaataagcatgtatgataataacaacttatttacttatagtgaactgaagcaaccaagccttgctaggcccgatggtagagtacgggggaagggtgttgggcggtcctaggtgtggaaggcgcatcacgtgctcgaagcacgcggtgatatcctccttccagccaaaaacaccgtccatgggaccaactggggctcttgccagtggtagcccgagcaggtacgacacgtcctgcagtgtcggagccatctctccacagggaaggtggaacgtgtgcatctcaggtctccagcggtctaccagagcggcaaggagtgaccggtctgcatcccactgcttcgatgggtcacggtcgtccgccgccgcctcaacaagcctacaaagtggtagaaggcctgccgcacgcaacctgcatagagcaaactttaaacataagtacaagacaaagcacagttgagttgaaatgtgcttacgtaaaattgaacatacgcgtactaaggaacgtgacgggggtcgacacgcaaccactcgcgtgacgtgcgtggacggaaagtgccgagctgtgcaccctagactactgacaggaacgagcggtggttcctgtcaatcccacggttgaacagcgccggtgtgtcgtacaacatacctgtatccaatagattgatcagaaacataaaaataattagttcaacataactaacaaatgttcataagtgaattactaacacatattaaacaagagtaaaaacaaacaaaagggtcacaatacagaatatttctgattacaacaataactgcagttacacgatatgagtacttagtccgaacactcatcacgataacattatgatacaacaccgaagagttcacaatactactagtacaacaatagtcggaagtactcattacaacaacattcattgaaattacacgatagaagtacttagtccgaacactcatcacaacacaatatcattttatttcctaattcgatagcaatgttacaccatggaattgcctgctgcacgacgacgccttggccttgcgcgcctgcttgttgttccttcaccaggtggttgccttccatcacttgcctgtccagatggaccagcatccgcgccacttggaacttctgcattcttcgggcatttcttgtaagtatggccgcgcagatcacacttgctgcagcataaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcatacttatgcacttgtgtgccttgagcaacaactctatgtctccgtgcctttttgattttatcttccatgtactttgtcactacgttgccaaacactatgttgttatcggccatggacggaccaattttcttgtgtcgatccctaaagtaggcttgcgtgccgtgaaggatgaattcaacaatagcaaccaatggaagtacccgaactcctcgcattacccagttgtacacccccgccaaattggttgtcattatgccataccgagatccatcagtgtcgaacaatagagaccacttctccttaggctcattctcaatccactgagtgaaatttctgatggacgaccccgacctccttctcattgttggtgggtcatcatgtaatgcaccaagaggtatgggaggctcgtcaccttcaacttgtggtctgcgagattgctcatctgtttgcttcgttgttaactcatccaacttgtcccacaactcattaaatttcttctcttggttctgtgcacagagcctcttaaagagctccataagatgcttgttcttgaattgcttatagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcgccactgcaatgtgcactctctctaggaaccagtaccagctttcagtgttctcactctctacaaatgcaaaagccataggtagaacctggttgttcccatcacacccaattgctgtcaatatctaacctcggtatttacctgtcaaaaatgtcccatctatgcataggacagatcgacaatgcacaaaagcattgatgcaggcacccaatgagaaaaaggctctttgcagcacactctttgttcgatcatcagccgatgtaaatgtatgtaggtcatagtaagtactattattcctctgggcaatggtggctaacagactaggcaaattatcataagaagcttcaaatgtgccatacctcatctcaataatcttttgtttggctctccaggcttttgcatagcttatggtgtacttgaatttgttctcgatgtggctaataattgattttggttcaaagccaatgttaccaacaacactactgtacatctcacttgccacaaaagctgaagtgatgtttcggtgatacttctccaccccttgtaagtagcactggtgcttggtcacaatgctaactttccaataatcattccatttacccttatatgcatggacacgccacggacaatcttccttcatgcacctcacttcatacacataatttgttgacttgaccaccctaaactctctctacaaggaaactgcccaatgcttcactgcctccttcatctcatccttatgagcatacctagcaccctcaattacctcgttctccttatactcccagggtacatgatcaccatctgatataacaagtccaaagaagtcctcatttgcccaatcagtggccattacatcaccttcctcatcggatgatgcgtcgtcctccgcttgctcattatctgaatcttccctctccatttcatcaacaattataccgactatctccccctcatccgccatgcccatggcctgctcctcccttgtttgattttcctcattttgcatcgatggtccaacaacatcccctgcattgatagaaccctccacatcttcggtttgcattgaaacatttgtatctttctcttgtaccgacacaaatataacgaggggccatgaccattcaaaagccatttccacataccgtctccaagcagcagtgctgtccatcggcattagttcccaaaaataaccttctgttgcacgactcactacaatagtgatactgacattgtgtagacttcttggtctattctaaatcctctcaacaaccaactataaattgactgaaatgttctctccgcaggcctatcgatgcccttagatgtcattacaaaatccgacagatcagcaccatctggaccaaatctaagatttccttcaccgtgaactatatgaaatgtgaccttatttgacattgtgcctgatgaaaacaataactgcgttaacctcgcatttctgtactacgcactaagttacattctctacaatattgttctccaaaattctaaaagtaggttacgttttccagatcaaactaaagtacatcttacaattaacactactgtctatgtctcaattcatactattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcaaaccagtagggcttcgccgctccccttctgctgccatcccctctctctctttcctttttttttggatttttacagattataatgaaattttagagaggggggacggggttatataggagagaggcaaaaatcgccctcccccagggcggcaagggggccgcctgcaaaattctaggccccctcgccgcccatttgcaggtggccccccgcacagtgtaaaatcgccctcccccagggcagcaagggggccgcctgcaaatttccatgcccccctcgccgcccatttgcaggcggccccccgcacagtgtaaaatcgccctagcggagggcggcaagggggccgcatgcaaatttcattgacggccgtctgccacatcacatttgccgccctctgggagggcggcggcgggctactacttttgttaatttttgaaatagaaaattattttttaaaacttttaataaaaaaaatttaaaaattatgggctcaaatttctcttacccaacaaggaaccttaaggtgcttcgatgggctatataacccactaaagttatgggcccttttttttgcccacacttttttctcggcaaaacgtcgggcttaggccattgggcccatctcttctggccgtcaccacactagatcattctgtgacaaaattaatccaagtccctgttctttcgagcttatcacttaggcccatttgaattggaggaaaaacaaatgaattgaaatcctatcctatactaaaaacaaatgaattgaaaaggaaaaatgtaggaaacttttctattcctacgattctaaataaaaacgtagaaaatctagcatccactttaatctcttggaaaattccctttgagtctatctctcacatctgatttgtgcgtttatcctgcagtccaatcaaacgaccatttcttagttttccctgtgttttgcaatcctcagttttacacttgtattcttatcagaatcctgtgtttttcctattcatttgttttttcaatcttgccattcaaagggctctcggagttcatgtgcgtttttttttttgcaggtaagttaattaacagatagtctggtactcctatgtattttaataccattttatacatactatctataaaattaaataataaatatgtaaatttattacagataattgaactgttatacgagttgaaataaaaaaaagtacccattggataaaattgccaaaaatatgggcagtccggtaagtcactttagcaggattgggtccggtcgggtccggtctaacaaaaaaaatatataagatttatatattgatttattatagataagggagatagaggaaatgcactaaaattcccaaatcaatttgtaaaaatgttaaagttcctctagaatatgaagcaccttttcctatcatttgaaattcttttgaaccaatttcaccatccagaggctctcacagagaattttcttttaaaattgaactttcctacagatttcttcaaatctaatggagccttaaatagatggagagcaacaactcctccctaccctcatgcgtgtgtaatattaatgcattttcataacacagattaaaaaagatgatccataagcttgctaaatcatactggaaatataccatgcgtatcctggtataaacctcgctgctaatgcgtttctctcgtaaaaactttaagttgctttaaaatatcagtaaatcgatttgttgaatttgtaataattaaaactcaattaatcatatgctaatggttttctcgttctaagcacgtgaaaaatagataccacttgggtgaaatcatataactataaaagcaatagcagtgcagctatggcatttgaggagccaaagcaaccagctagactaagaaacaccctccacagtgcatgtggtatattttatccttcacagtacatgataatgggtctcacccgttctctctcttaacttttcatccctcctctctctctctttgcctttccccaccaaccactccccctcctccttcggctactccaccgccggcacccatctccccttccgtcgctctcctaccactcatgtcgacggatcgaagcggcaacaagctcggcactgcgtacgtgcgtggatggtgaggagcttggggcagatttggaatgtcggcggcttggcacgtccttctcgatgacagtgcctaggtggagaggtggccgagtggcgacgacgctgggcggagcggcgatggcattgggcgaagcgacgagggggcggccggatccagcccggggcagctccccttctccactatctccagcataactccccttctctgaccgccgcagcagctctccctcctctccgccgctccccctcccgcctgcgccgctcttcctttacctctccgctgatgctgctcaccccaccgcctgctaggtggctcgttggctgcatgcagatggtgacagcgggctaggcagctcatcgcaaggacaatgggctaggcggctcattggagggcaggggtgaagcctggatttatggttaggagggtgtgggcagggcgaacaagtcataagttatagtaagcaatgccgacgataaaacaagacatcatgtgttctgccataaaaaacttgaatttagctttttagctctatcattggatgtttgacagtttgagacttgagacaccatgctcgatagcgagacgcaatgggagtacggagagacgtgtgaagccgaagcaatgaaaacgaggagttgatttgcgttgtctctccgtctctttcttattaattaattttctatatcatatttattgataatggactaattaatatgctaatgcgctagttagtataatagggagggggtgggatgggggtgttagccccctccggccctgttggatgagggcgagcacaggaaggagcacgatgctactcgctccacagcgtagaagcagtgctgtctcccagcctcacgcgtcctctttttcacccaagaaccggtggtattctttggacacgagaactttattttggtgggtccggaagcaaacgtgccaagggtcaagggagaatgccactacaccgcaccgtgaatgccctaacgacacctccctcccatgcaaccgatgcttcttggcatacataatttagcaggatggtagttgaaatttattatatggaatatctcattggaagtaattgtttttctactggctagatcatctttagcatggaagataacacacaacctcacataaaaaaccgaaaactcgaaaaacgggaggcacacgcacgagtacaaagaggagttcgaaattgtgaccgtgtgtgttcacttcacagggcgcagtaatttttcttcgaccgcgactcgacgaacaaacggacgccacaggataattttcaaaaaaaaggaatatccccacccatttccaccatcgggccaccggtttgccggcggccgacgtggccggcctcgcagcggcacagccgcacccatggccgttatcccccaagcccccaccgccacacccccgcctacaaactcacctccacccccaccc

SEQ ID NO: 80349 - DNA, 7874 bp, Oryza sativa
ccccttccacccgcccacacttaactcattaatgcactgacttttcttcttaattaatacaattgatttgtgtctcctttgtggttaatccaacattttatgttttaaattaaaatatttcaattatcacttaattaaattgaaagttgtatttgcaattttctgaaaataccaacacaaatttgattctgcaaactacgtacaacacgtacgaccatatcaagtactggggtacaatacattatggtttatagcacttgttatatatagtatctgccaaaaggtcccccatcgggtcgtacaaaagtgatcttgacgatatcgacagttgatgattaattaatccctccttccaaaagtgtaagattaacttttttttttcgtccaagaccctgtttagatgggactaaaacttttaattccctactatcacattaaatgtttggacactaattataaatattaaacgtagactattaataaaacacatccataatcttggactaattcgcgtgacgaatctattgagtctaattaatccatgattagcctatgtgatgttacagtaaacattctctaattatgaattaattaggcttaaaaaatttgtctcgcaaattagctttcatttatgtaattagttttgtaagtagtatatatttaatactctaaattagtgtctaaatacaaagactaaagctaagtacctgaatctaaacaccacctaagactttggaggaattaactaatccacatgtaaaaaacccaaaaataatacgcaaagatgtaactaatgggtattaagatgcttactttatttcgataaacaatatatttaatttagcacaagactaacaatataactctatctcacttcgaaaagcaaaaaataaaatatacttaacacttttggatgaagggagtaatacactgcacaaacacagcagaggctgtaatatgtgtgagaaatttgccatgcatgtgacatcgttactttgtagcatgagttttaaatttagaatatttattttaaacatttcagtacgtgcagctcacagattgctgaaatagataatatatggagacaaatatattgtattcttgaaaggttgttgtcacggttaaatgcaaaaaagctaccgtgcgatcggtcgtgcgcggcgatcaggctccctcctcacattgctcccttttttttttaccatattacctattttagtaaggttatacacctaaagtttctatactcaaaatttatatacctaaagtatacacacctaaaatttgtatacctaacatctatatatctaaagtttacacaaaaaagtgtatatacctaaagtttacacatttaaagtttatatgttgaaagtttaaatatccgatcaagattatggattttgactcaaattaatgtttgacatataaatgttttatgcgatttattttagtttgtaattttatcgctgggcccacatggagcggcaaccacgtagcagggaagacgcgtagagattggaggcaagcggagcgatcgtgtgcgtgggcttttttctgttttaccatttcctgattgtgcatgcgtccatcccacaatcactcgcgtatcaggaggacctggttatatgcacgttctttattttcctgaaaactactttctaaaatgccacgcatgcccaagacgcgtgccgtgcgtttgagtagacttgacattcttctggctacctttggtatcgtattgtagctgatgcctggttgaactatcgtgctatgatcaattcaccatcttaactaatttcgttgtcactaccggagaactgatctttgctccaatgaaagatctttagtcctagttgataacatcaacccatactaaaaattgatctttagtctcagttgatgataccaacccggactaaagatattttttagtcccggttaatgttattaacccagacaaaagatgtctccatggttagtttaaaaagaaagcatctctacccaagtcagatgtgtgtagtaggaggcatggtaacgcgcgtgagggttgagataagagatcttaaattcgaatcccacatcccccatattttttttttgacttggtatgcatctttagtctcgtttatttcaatcgagactaaagatggattgtgcgtcctagttgcacaaccgagactaaaaatggttgcaaaccgggactaaagtccctttctccggcattgtgtgttcattaattagttagctgtgaagttaatttaggtgcatatatacagtaaaaataatatgatcagactttgtcattttctgtcttaaaattttttatgcataagtggtccaggctagatatagtaattgtaagtactatgcttgttcaagggagagaggacaatattcaattggattactgttggaggcatgtaggattgctatcaacgaaccgtttcaatgttaagctgttatggatagctatatagttaagagtattgtctggacaagataataatagtacctattttggcgtaattaagtacattttgaggttggtacgtatggaaatatacatatttccaacaatatcgatgtagctgtctagctacaatctaattataagctttaagttcagtaaacagtggccaatcaacttagtcttattctatattctgattttttcattacacaaaaaagaattataaaattttactactacacatactccctctcatattaacacaagggcaggaaacagcaatccatgttcaacatccgcgtgagcatacgagaagaccatgcatgcagccatgctcggtatctgatcaaatacgggtttcagaagtacgtatggcatgcatagaacaagagggactgtccatacttgccaatcactccacaggctgcaggctacagcgcgcctgcacgagatggatggagcctccgggctgcagctatctcctctccttttcccagtttgtgagtagtgatgttgtattgtgcaaaaactttcaagctttcacgctgcagttactacaaacggggaaaaggaaatatttgtttatatacataagcgctactcagaaagagtattgttttagttttaaaattgtttctcagaaagtgtgtttttgggtgaggtctactaattgacatgtttaatacttcatatcctttttcttctcgttttaaccatcgaaccagtacgttgtactccctgaacccaacataaccaaaacacacacaaatttttttgaataaaaaacacatacaaaattaaaaggattatgtatgcagacttaattagtataattgagtatcagcatcaacgaattaatgttgtaagcattaacactaattaaatatttggaccacttcctcttttgctttttgaaatgtggccaaggttaccaccaagtgtttagatttggcatatcagatgagaaacttcagatccttaaaatacatttcatttcatatagatgactgttacgtgcaggttactttctgggttgttgattaatttaatgcttgccctcctagtagattagacattttaacacgtatctatatatatgttacaggaagattaattaaacagcccatgcatatatataaacacgataatgcatctgattaattagtcatcactcatttgcacagggaggctgagccccaacatgaaaatgagaggagacatcctgatcaatggcctgcgagagaaactttcgtttggaacatccgtacgttttcacataaaatgcgatctcgaatgatttgaaacagtgtgatcttgacttgacacatgttcgtacatgcgttaatgaaggcctacgtgacccaagaaaacgtgctgatggcgacgctcacggtgacggaggccgtccactactcggcgcagctgcagctgccggactcgatgccggcggaagacaagcgggcccgcgccgaccgcgccatccgccagatggggctcggcgcggtcgccggcgtccggatcggcggccgggtgtgcaagggcatcagcggcgggcagcggaagcgggtgagcatctgcgtcgagctgctggcgtcgcccgcgctgctgttcctcgacgagccgacgagcgggctcgacagcgcggcgtcgtaccacgtcatgagccgcatcgccggcctcgccaggagggacgggatgacggtcgtcgccgccgtgcaccagcccagcacggagatgttcgagctcttccatggcctctgcctcctggccactgggaggacggtgtattttggagcagcttcagatgcaatcgaggtaacagtttgacatgtgcgactaacagtaataccgacatcaaggacctcatgagctagggatgcaagtagtcaatccctaaaaaaaatctgcttactaattcacttatcgtatggttatataaagtttgaaagaaaaaataactagaagtgagataagcggataagcgagcaaatcttgctaccaggcgattccattttcatcaccctaaccccatctcttagtgttttatgattgatatgccttagtaatttatataccactaaaagtattggaatgctaaaaaaatacctcccgaaatatatatagtactttatatgcatcaaattaaattgtaatatctgtctatagacgctagcctctgcagaggctagggcgactctttaagactatctatatatactatggacgtgactacacagctagtggtagctagctagtccatctataagagaccctatctacctatactttaaataaaattttctcttaaactactcatccgatctatgatctgattacaccgttgtgtttgtaacaattaaatctttataacaagatcccacatgattatattttgatgaaaaattataaattacttttatggtatatctaaattacttctagattttactaaattacttcttagacatataaaggtaaattcaataaagcctaaaggtaatttacataaattatagaagtaacttataacaaaaagaaagtaattaactttaatgcatgttttttttcattggtatgactacacagctagtcatagttggtttatactccatctagtgtcgcccttaaacttgtaaaatgaaatagtatatatcttttttttaatctctttaataacttatatcttttaaatcacatattgtttttaagatctatttgcatcactgtactccactcaaaatatgtgacgaaacgatattcatattgagtatattcaaacattttgttaatttaaaagtaatttattacatgctagaaagtaacttttatgttatcaagaagtaactattgcatcttatacatggttaattctcattagttatttcatcaatgttatttacaatccatcaaagattttatctttttttctcatgctacatgaaaaacaaaaatgaaagaaaaaaaacaatcggtgattaaacatatttatagagagttacttctgaaccatgcaaaagttactttcaattaacattgaagttacttttaaaaattgttcaacttacgtgtgttgatttgtactaattaaataaagttttgtagataaagtcatatttttatccctacaacgaatttacttctaatgtcgtgacaaagtcacttctgttttgttttaagttacttttataatatatgtaaattacttttagactttactgaatttacttttatatgtctaagaagtaatttagtcaaatccaaaagtaacttatatatatgataaaaataacttacgtatataataaaagtaatttacaaatataaatattttttattgtaatataatcatgtaagatcttgttgtgaagatttaattataacgaacacaatggtataatcggattgtagatcggataagtaatttgagagaaaactttatttaaaaacgaaaaagacatacatggctattaaaaaaaaggcatgcatgtagtagactttctcttttttttccctccactactccttcggtgcttcctgctacgtgggcgtatcagcctgcctgtagccaagtactagtggagaaagcgataacgttagccgaagatgagatggccggaggtgcgtcgcgcgattagactaaaccgagagcgcgcactgtttagattttatgatatactatctatttgtcaattggctaattttatcttatctatcaatcttagttttcaattcggtcaaatgttgaaagttctctatgatctatatatatacataaataaaaacacatctagattcattaaactaatacaaaaataaagcaaggaacaagttgcaggccatctgtgacgaccgataaatgagaaaggtataataacttatcattaaatgtctcttcaatccttttcgaaaagaaagaggacagtccttgttataaaccaattaccactctcaatggaagttgggagttagaactccttaaaggcatcgatatcgttaccttttttgacaactgatagtacaagtctgcactgcaatcaaacatacatattataaaattaatttgccaagtgctcatacaaatataatgttaaagttctttacaatatatacgatatatagttacacatataaatatctgtaatgcaaccttttttgaaaattttattaacacatatagccgctccttttacgatgtaaaaccgacttaaatttatcagttctatataatttcagtttttttgacggaatatagtttcagttttagttagctcaatccgaggaatttcaagaaaggaagaccaggttttaagtgcgcatgggttatacagtcttggaagccatatttcaattcagccctatattctgaattattcctagtattatcttcttggggcacgtaatgaagcttgaaataaaaaaaatattactccctccgttttaggttataagatgtttttgactttggtcaaaatttatagaaaacaatagtaatattttcgatctaagataaatttattataaaaatatatttaattattaattcaataaaactaatttggtaatgtaaatattactatatttatctataaacttgctcgaacttaaagcagtttaactttgaccaaagtcaaaatattttataacctgaaacagagggagtagttgctatcatattttttgcaaaaaaaaaaaaaaaaaaaaaaaaaaacagttccagtccatttgaacctatttatacacatttagagaaaaagaagaatggctttgaacctatttatacacatttagagaaaaagaagaatggcattgtcattgaattttgtcgcctatttacaataaacaataaaaggccagaaaaattttggatgtgacacatagattaatttagcgccttcgcacactaaccttgtttgctgggaagagcaaaagtgaaaaaggagtggcttgcaccatccagctgccattgatttcaagaagaaaacttaaaatgcaaattttattagtctcgtattaaaaaaattggattcgtaatcttgatatgccaacaataaattattagtaatacatagctgggttaattgaattgatggtttatataattgttatactaacagcacacccctatttggcatccgaagaaggtagacaaaattacaaattaagacacattcaataaatttgttgcgctatggtccacttttgcataatcaaacatttatattaattaaattggctttctggactagaataaataatttttatcatgtaatctttgtttcctatgaacaggatgtcgcatcttaatatatactcctatataatctcgctcaaaaagaataaatgagaagggggaagtatttcattgtccatatttatatggctttcatcgaatcgcgtggtgctt

SEQ ID NO: 80350 - DNA, 1124 bp, Oryza sativa
atctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgttttcggagagttcgttttcgccggagaagagtttgaagagttccaaggccagcaaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttctcctccctttctcttttaat

SEQ ID NO: 80351 - DNA, 5876 bp, Oryza sativa
ggttaggttgtgttctgatgcaagatgggaaggtggtttcctatgcatcttgtcagttacgtccgcatgagaactaccctactcatgatcttgagttagctgcagtggttcatgcgttgaagatttggcgtcattatcttttcggtactcgtacagaggtgtacacggatcacaagagtttgaagtatatctttacccagccgaatctgaacatgagacaacggagatggttggaattgattaaggattatgacatgggaattcataatcaccacggaaaggctaatgttgtagcagatgctctcagcaggaaaggctattgcaatgctacggaaggacaacagttgccatgggaattatgcaaggaatttgaaagactgaatttgggaattgtcagtagaggttttgttgcaactttagaagcgaagcccactctcattgaccaggttagagaagctcaaatcaatgatcctgatattcaagagatcaagaagaatatgagaagaggaaaggctatcgggtatttggaagatgagcaaggaaccgtatggttgggtgagagaatctgtgtcccagagaacaaggagttgaaagatgcaattctgaaggaagctcacgacactttatactccatttaccctggtagtaccaagatgtaccaagatctcaaggaaaaattttggtgggcaagtatgaagtatgaagtgtgagatagcagagtatgtagctgtgtgtgatgtttgtcagcgagtcaaggcagaacatcagaaacccgcaggtttgttgcagcctttgaagataccagaatggaagtgggaggaaatcggtatggatttcatcactggtctacccagaacgtcatcgggccatgactctatttgggtgatagtcgacagacttaccaaagtggctcatttcatcccggtgaggacaacatatttcggaagccgtttggcagaattgtatatggcaaggattgtgtgtttgcatggcgttcctaagaaaatagtatccgatcgaggtagccagtttacttcaaagttttggaagaagcttcaggaagagatgggttccaagttgaacttcagtaccgcttatcatccgcagatagacggacaaaccgaaagggtaaatcagattttggaagacatgttaagagcttgtgctttagacttcggtggaagttgggataagaatctgccttacgcggaattctcgtacaacaacagttatcaagctagtcttcaaatggctccttatgaagcgttgtatggtcggaagtgccgcactccgcttttgtgggatcaaacgggagaacgtcaagttttcgggactgatattctgagggaagcagaagagaaggtaaagatcattcaagaaagattgcgtatagctcagtctcgtcataagagttatgccgacaatcgccgcagtgatttaagttttgaggaaggagatcatgtgtaccttcgtgtcacgcctctccgaggggttcatcgtttccacaccaaaggaaaattggcaccacgtttcgtgggaccttataagattgtcagtcaaagaggtgaggttgcttatcagttggagttacctcaatccttggcaggtgttcataatgtgatccatgtgtcaaagttgaaaaagtgttaaagggtacctactgaagaagctaatcttgaacagatagaagtccaagaggatctgacatatgttgagaaaccaatctgtatcctagaaacagatgagagaagaacaaggaatcgagttatccgtttctgtaaggtccaatggagtaatcactcagaggaagaatctacttgggaacgagaagatgaattaaagtcagctcatctgcatcttttcgccagttcttccgaatctcgaggacgagatcctgtttaagggggtaggtttgtcacaccctaaaaatcccaaatatataaattgttgtttaattggaattattagaaataattttaaaagcctagaagaaaagatctaattttaaataataaattccaaaataaaagtgggctagataaaattttattaaatactttacttgattctatagttcctagatttttctgggatttatttgagtcaaggaagtatttttaataaatggaattgcatttcatgaataatttaaattgaaaaagttttaaaagtcttctttttggctttgggccaaaagtcggcccaaaacctatctctctctctcccacctgtcaggcccgtcacctacctcgcgccgcccggcagcgccctagctgcccgagccgccgccgcctccttccaaattctgtcgcccctttccttctctggccaaatcgattgaggggaaatgatccccgggatcccctctatcttttctcttttggaatcgtcgtccaatttcgtttggaaatagccggattcgatctcgaatcggattcgtctctctctcccgaaccctaactttccatcgctgtcgccggtcgccatgggcctccgtcgccgccctctagcccctatttaaggacccccgggacctcctctctccgccgccaccatcgccttagcccgccgccgcctgtagcgctgcctccgctagaacccgtgcgccgcagtcgctgccgcttgtccagccgtgcgccgccgtcgctccggtcgtcaccgtcgctcgggaaggccgctgttgggatcgccaagtcgtcgccgtcctcgtcccgccctccgtttctgccgaggattgccggagcactgccgtcatcgttgacccgatcgtcgccgccgcttcatcctcgtcgccgtcgccgtccggttgccgtccaccgtcgtttgggtcaccggtgagttcgccgcgtcgccctctacgcgtagataccctccgtttacgccgccgcgccgtcattcaccggcgagcgtgcgaggccgagtcgccgccggtgatgacgtcaccgctgacgtcgtcgtcgttgtttccccgtagaccgcggtagatcaagttgtctcggccgtccgttttggataggatagatctcggccgttcgttccgtagaccgccgccgtgcacccggtccaccgtgagccgagcccgatgacgcaataattcatttttccttttcaaaaataattctatattgcgtcataattcaattaaaatctatataaatgatttaatccgatttaatctttaaaaattcataactaattcatcttagctcggatttagttggttcaagtctctaaatttttctaaaattgagatctacatgttaaaaatatccacatatactgttcatgcttttttatgtgttgttttggtgattttgctcttttctgtttagattccgacattcccggagagtccgatttcgcaggagaagaatttgaagagttccaaggccagcaaggcaggtcacacagatcccaaacaaccctttgagcatgttgatcccgtttaaagctattgtttctattcaactattgcatttattttcgaatgtcattgggtggagataacctattgctttgttatagcccttttgttattgattacctattctttgtcacttgggtaataatatgattagctagaacattatatggttttagctaaagtgaataggatgcttagccatgcttagagacactagctcatataaatgggatacttatgattcattattatttaatcatggtttaatgatagctcacgatggttaatctgattggttaattaattaatttgccaactaaaacctgataaaggtgggttgtgagcacatggttttgatggtcgtgctcatgacaattaaggaccggttcacgattttcggttgtgaaacatttaccgtgccaaccacaagccagcgtgggcaacggctttattttctgtacagtatggttcattgtagagcaacagactgtgaagtggcggaaataagcccacgggggtcgctggggagtccatgccttgtttacaagggggtgattatgatccgggaacggtgcactgctttgaattgtgttatatagagggtattgtcacaatctctattcgggtacttgttaagtatcgcgatgcatggttgacatgatgttgaggttgtgtcttgtgggtacagtggtacacctctggccagagtaaaactattcgaatagtcgtgcccgcggtgatgggcgggtttaacaatgtctttcgtgattagtattacacctctcactataataaatgatgctgtaattggtaataatttgtttagctcctggtttggaatggtatattcctggtttgctgatagaagccaggattggttgttcagaatggttgggcctatgcaacgggtatgttgtatagcgttgaattaatattgtttaattaatactttactgttttattaaattctgaaagatttattaaatgctatttatgcaaaatgagactatattatgccatcctttgctatcctttgcacttgcatatttgctgcatggcttgctgagtatgtcatatactcaccttgcaatcattcatcagaggaggagttctacagtgatgctgatggtgtggaggattaggtgtagccctggtcaagttgcctgtggagtggagtcgtctgcgcagtttatcttattttccgctgcttagatctttattgattgagaggaactatctacctctgtaatgacattttattcgcttattaattagagtaataattgtactctattatcaatttgttattgtgtgcctcggctgattcctggacgagggtttacacacatgtaagcgtttgaaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcaaatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgtcatcggggccgtctgccgtgagcccacgtagacccgatcgatctcggccgtctgttttggatggatcgatctcggccgttcgtttccgtgaaccgtcgccgtgcgcccggtccaccgaaaaccctagccgctgacgcaataaa

SEQ ID NO: 80352 - DNA, 6178 bp, Oryza sativa
  unsure (1)..(6178): unsure at all n locations
tgagcagctcagccgatagctttgctccagcatcggttggtgtggatgcatattctccgtataacatgcatctgcgatgagtgcgttcttctccattatcttccacaatcggctcttgcatcggaaattcagcttctatcacagatggccgattaacaactttcatgaccatcaggtttaaccaggtctgtagcagccaccatggtccacctgccccaactactgagccgacggctatcttggccgatgcattgttttacatttggtatagatagccgaggaggattttgcccaagggaaattgtttctttgattctagggcttcggctacaaattgccaatttgtcgtagggccatatctggatccacagaagaggaatttttctagccacatgagtaaaaaggccacatgttctcgaggagtagcagatccttggcccatatatgctgccacataaccagaccaaccacctatgcttttggtcctgaagtcaaattggttcttagtgttcatgctcataggattagccgatgaagttatatccaaaccggtgatcatggtgatgtcgatcaaagttggagtcatcagcccttggttgaacaaaaaggcattgatggtgttggaccaaaaataggtggcggcagccattagaggttcgtccttagcggaattggctatggtaagggcaagcgcttggccgatcccgatctcatcccagtgaactttcttactagccgatacgcgtttgtaccatgtggtccaactcttctcaggggtggttttctcaagagatggccaagacttgaaagtattcttccaatgacccagattagggttggctaatctaaaggggattatgttggtctcaccgatgataaaatcagtgggggtcaagattgccgattggaccaagaaagtagtggttttcatgtgacaggctgggaatcacaactagattggaaaggtgctgcaaatccaaaggaatcgagaagaagaaaacaagatgcggaaaggggaaaacgatttcatgcgaggaaaagagatctagccgatgagaacttacctcagcgtactcggccgatggtgtggtagacgggctggcggaggacgacatcaccgcaggcggaggtccggctggagatggaatcgctttggaatcgccttttgcgtcggtgcagtcgcgngagagagagagggagaagtntgtttcggtggtgaaaatggaagaggacggtgtgagatttctcgagggtgacggttagtatttaaagcacgggagtaacggtcggaaaacggcaaagtgtgaaacttgctcggagtcgatatactgcaaatccgaaacattaccaaatattccagacttggggggcatgaaagcgtgttgacgtaaaacacgaggcctgggagatctgcttaactccagcgcaggtccaaaactcgccttcgggtatgctagcgtgccagttgatttgatcctgcaatcaacaagaaataaagacaaagaaaccgtggttaaacctataaacgatagccgatcggctaagtgccgatgacatatcatttatctttgagccgatgtcatatgtaaatcgatcggcggtcgtaaatagataataaagaactaaatctactcgatcagctgtagatattaacaatatataattcttatatcaatatatacttaaatcaagtgattgggatagatcggtcgccatgccgagacaatataaatcacttagatcgaaatatatattaataacaagactatatatgttcatagcatagccgatcagataaatctagcatgtaccggctaatactccaataagactctatgttaagatgttaaaacaagcagaatataccaaacatatgcttaatatacttagatgcaataatatattgacataaagggtagatttaacgtgtcaacaaagcatatagagcaaatatagttaaatcagataagatcggctgaaactccgatgctaccctaatcggcaaccagaaggcaggctagagattgatattctaagcacgacttaatagatcaaactcaactgatgcaacattaagtatgaaaagaagaacaatatctagacaatcaagccgctggaagtttcatagagtggtagatatcttatataatctaaatcaacgtcaaaatctaacctaatcggctgccctcttccaacagatgttagccaattgtaggttagatagcgatattgccagagattatgtaagatatgtgataactcgacgaattacataaacaagattagagtatcataaagatggaagcactaatcccgagaacgcaagccgtcataacaagttttacctcttgttgaagatcgaaaccgatgcagctcaactcgaaagtaagaactcgtcgaaataaagcaaaagcaaaagggtggcgatgcaccgaaattgtattgaacgtgtgtgttcattgattacatggggttcggggtctatttatacccgaaaattacaaactatgtccatgtcggacacgactcttatctctaacaaactgtaagataccataagtctttacggcagacttttgccctaaacatatctctaaggaaattacataaaattgaaagtgcatctaggcccctaatgattttgatgattgattacaatgcgattagagaggactaacacttttattcaagcaaatgtgaaggttgttatgtcctcgacatgatgtaatgagatgcataccccatgaatgcgacatcacgatgcaatgcggcaatgatcaaatggtatattgtatcttttaccttgcattgtgtcgtaggaatgccgtactattaagagggataccacatgcatataattggtagaatactagtgctcaaaatgcttcatctttgtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttcgaaatccaagttcggagtaaaaagttattgcagttttactcgagcaacatcagactgtccgatttgaaatcagactatccgatgtatcagaccatccgatttttcacagaacttcactctctgtcttgatttgaaaaaatcctatcgagtgagtttttctaagtatcggagtatccgatgtcggatcagatagtccgatgatacagagactccgaaatttcatagaacttgagtctctgtttgaggacgaagtttttgcttctaaaatatcagaatactccgatttaacatcagatagtccgatgtctcggaaagtctgaaatttcatggaacttcgttctctgtttctcgttgccttggaggtttaaaatatcggactatccgtaccccccacctaacccttttctagggttacccaactaatttattctcattcactttgggttgagcttggtgctaaattgctttggatctttgagctctctctccctctctcaaatccctccttgttctttgtgtggtggatcttggtggttgtggatttggtgtttgagggcctagtgtgtgtttcactcgatcttgagcactagggtttgaccaagagttgtgtggtgtttgttactcttggaggttgaggactcctagacggttaggtgtcactcccgagccaccgatctacgtgtggttggcagggagaagtttgtgaaggccggatctcgcctccgcaaggaaagagataccccttagtggaaggaagagtgcttagtgcaacctgttgaggaaagggttagcaaaggcccggttcttagtgagctcctcaacggagagtagaaccccctcaaggatttgaactccgggaacaacttcgtgaacttcatcattggtgatctcccttcatcctccttttagctttgcttaattgtgccgctatagatctagtcgctgtttgtgctttactcttgtttgtgtgatagatctacttgttgtgcttcattggtggatcagacagtctgatccaacatcagactatctgatattttcggatagtctgactgtggatcagactttccgaccttatttcagttttagcatccgcataaagttttaaattagcctattcaccccccctctaggcctaattgaccctttcaaaaatatcctaactaatagatacaattgccttctcaggaccctatccatgtgcggcaatcattttgaagcatatcaatctaacccgatgtcgtacaccaagtcgttttgtcagaatcggctgtatcggcttacctagtctgactcggacccagccgatccttatcgtagccgatccggactccagccgattctgatcgtagctgatccggactccagcggattcttactctgttctcgaatcgatcttcgcctttgattctgcttcggtctaatcctcttttccgatgcagatattaccaaatttggtcgttaacaccaggaaactaacttaggattatatacaggcgcggaagaatacccatactgagctgtcaccatcagctgcccatctctcatccgcagcatataaccctaaataatgatatcccataatctagacaccacgcctaaactaccagatactactctaatatcatcatcatgacatagactaattgcataagcaaacattataccctcaccaaagcatctccgagataagctagctgtatattcagtataacaagaacataatgtaaagtaggtattcatatacttggaaagtatttcaataccataaatgtatatagaagagtattctaataaaagtacaaagcttacaaaagaagaaatcatccgcagcatataaccccaaataatgatatcccgtaatctagacaccacgtctaaactaccagatactactctaatatcatcgtcatgacatagactaattgcataagcaaacattatacccgcaccaaagcatctcccagataagctagccgtacattcagtataacaagaacataatgtaaagtaggtattcatatacttggaaagtatttcaataccataaatgtatatagaagagtattctaataaaagtacaaagcttacaaaagaggaaagaaaagctactagagccatacccgaactcttccgagggcttccggactcctgatttctactctattcctgttccaccagctagatactactaaactaaactttagagaaatgagagagctcttgcttaaggtgtgtgtgtgaagtgataagaggagctcctttaatagctgaactatgacggttgtgatggttggaatggtaggtaataccctccaaccgtcattggggtttcatctcaaccgtccagccaaaacctggatccaacggaggcgagggaggttcggccgaacctcctagttcggccgaacatggggctggcccaaccagcccaccattcggctggcggcctcctctattgcttctttatgtagacttgtgaattttggcccagtttgtcgtgtcaattctgagttcttggctcattcatacataagtctgattgtcgacatcgttcgattgatttatcgtccgtgttgatgtcgattctcctccacttaatggtcattctctgcaaaaggtgagtacacctaatattagtggaatattattattctaacatatatatgcattgcaagcatcactagttctcctctattttggtaatattgacggtcgaaactgatcgataacgaccatcaacacccacatgacagcgagagaatgatgtgggccccacatctctctttgttttctttcttctttctctccttcttttctcgtctgcagcggcggcggcggcactcatccccaccgtgtgcggcaacggtgacctcctccaccatgagcagcggcagtgacgctcttccccaccgcatgcggtagcggcgccctcgcccatcatgagcttcaacggcggctgctccattccccatcgcgtgcggcggcggtggcggcggcaacttcccgtgaaggagggggaaggggaggtcggcgagcgagaggtggaaggggaggccggtgagccggagggggaagaggaggtcgccgcgggagagggggaaggggagg

SEQ ID NO: 80353 - DNA, 7252 bp, Oryza sativa
gtcccgcgctgatccgcggcctctacctccatctgttgtcgtcgtcgacttccccgccctcccccgcggcgcgacgacggcgtggatctggcggcggcagcgcgacctcggcgtggatccggcggcggcgcgacctcgacgtcaatccggtggcggcggcccgtccccatgcggatccggcgccgatgacgacgaatgacggttggagcagcggattggccgacgacggcgacgaatctggcggcgcggaggccggctggattgggcagcggtgggctagggtttggagtggcggattggccgacgacggcgacgaatccggcggcctggaggccggcaggattgggcggcggtgtgctagggttcggcttttttgtttttttttattttgttgaattcattttcgcatgcggttggtacaggggatgcatgtggttgctctagccgtatgcaaagatgacaatctttgcagaagatttcacgtagccgcatgcgaaaatcgttgccgtccgtctgcaaagacgtattcttgtagtagtgtgataacaacttaattccataacaacttttcaaaaataataacatcatactatatgctttatggtatcaaatattacttaagagatatacaacggtaatatgaactatgtaagaatgcaaaccatgtaatttagttgtgtttttttaaagccggtccaatttaaattttaatacgtgtgagattaacattctcaaattattttggaatttttcaaaaatatttggttgatatttcaatagtaaaaaagcctacagttttgaatcatagatgtaaagaaaattcaccaaaaatattttcagctggtaaaatatatatcattggttttttggcatattattttaataattgtttaaatgatatgaaaaaagttagaatataacccaaaataaaatatttattttagaagttcaaatatagttaatatcagtccaacgacataagtcgataaaaatagctatttattttaaaagattataataaattagggttcctaagtagtaatatataatgaaaacatgagagagaatagaaggggagagggcgtgaataagggcggagggggtggaagcccattaccaatgcatgcggcgacggagggcactgaaaatccatccgacgttgtatatatgtaccggcagtagagacatgctcgggtatttcgcaagagtaataattaatctagtagtactttcccagttccagaatatatctctactattataattattataattattgaagatgtttttgtcaaaattttcgtacgtcatcagtatttgagtcggtttttaagttcgttcgcttttggaaatacatatccgtgtttgagttagattttattgtttccttttggaagtataaaaggagtcgtataagaaatattttgaaaaaacttgcatgcttgaaatacatactcctaattgcagctcatgattttctgaaaaaaatatccaatcgaatttccacggtgaattttactctggctaaaccatataacaataataaaattaaaatagtatttacctgctgcaatgcacaggtattttttctagttgatatatatttttcaatgttttgtaatacgaaatgcgcatcatacatgcaattaaattattttttttccaaaaatatgcataaatgcaatctctagaccgtattcttttctgattaagttgtagattttatcttggtttttattagcacttttttttcaaattgataaacggtgtatttcatataaaactttctatctagaagttgctctaaaatatcaaacaaatatatttactaaaattataataattaaaactcaattaatcgtacgctaacgttgttttagttttacgtgcccttacttaatccccattttgatgtatctcgaacgtggccttaatctaattggatacgtgcactgtatttattatggtgataaaaaagaaggtaataacattttataaaaagaaaatcagtactggtagttgaatgtgccttaaatttcagaatggaaggaataaataaaatgtttaattaatttgatcgtcatatgcgcttgtgagttaaacacattataaattggcgaatatccatgttgttattgttacgaaatatttgggtgatctcatccatatatatggatagagtagcaaccaacttagggacatgacggttggtcgtgccccatacctcttctcgcctcacggcgattctagcaacggacgtaatggttcccaaaccatcgtgccttctgttgccgcctctttcccccctatatattgtaaccattattatcaataaaggatccgctgattcattccatcaattctcgctctcgctcaatctccctcgctacaatcaatcttatttacaatacgtttgtcgcgactgagaaaatttgcattttcccgaatgctactgtattaatccctatcccaggaaaagccagggtacaccacacaaacatgatataaaagacacatctttattatatcgataatacttacattattacaaaggtgcttcaggcctgacaatcaaaaataaacaacagcggactagcgggcctacggctccatctccacaggcgctcaactggggtataagccgggactccacctaagacttcttctccaaagcttctcttactgaagggggggaaagattgagcaagaatgagtacaaccacagtactcagcaagtcacaccagaagctgcatgattaatgcaaggggtacaagggggtaataatatggggattaggttttgcagtaaacagcatttaaaagtcacttagttgctcaaagctattttgtaaacacgatcctagagctacacaatattattaatcaaggccgtgaaccctcacgaacctgccttaacccaaggcctacgatgattcagaccgaattggcaacccgacctgggccaaccattccacattttagttgttaagcaagttttaagaattaaaccactaacttgggtacatttctaggcttgcccataaccgagggcgcggctattcgaatagattatactctgatgagaggtgtacatctttacccacaagacacatctttactctgcattccacggccgtggaacccgtcgtaaaggatctgacataacccctttacccatcctagccatgacaaaagcaccgacccaacctcgcctacggccggaatcccgagacaggtaggtaagattaagcccctagcagcaagacaccggccctgtgccatgacatctcgactaccgagccgcagcccgtgtagccttcatttgccctagagatgtccattgagccccgactttgtccatctccatccgtgtactcttgcttggactagactgagcaccgagttaagccttacccattagacatgtggttagtacggtagtgctttgcaacagaggcccgaagatcggtgcttatagtggccgaggtgctactagcggaaccatgcacctcgagcctagcctaaaaccattttgggagttttgaatagaggggggggaggtgtgtgttcaattccatcacaagccaaccattccacagtgtccaaatgatatgagaactcccaaagtctaaagttataaaaccacccagtgttgcctaattaatcagcgaagcatctacctaaattcatactagtggaaccgttaatagagtacccactagttggggttttgtttatcctagggtgaacaaggtaataataacaatagcaaaaataataaggtcataacaaaggtaaataggtatggctaaataaaacagtgataacgcgggaatttaagtaaagcggtaatgcaatagtttaaatcaaaataattttataaactgggattcaatatgctcaagggtgaagcgacttgccttgctcagagagaacggccttccgaaccttcggcgacgaccgcgaaccacacttcgggaacctccggaacgacagaagctacgcgaagcacacaagcaaagctacaaccctataaagaagcaataacaatacataaaatgaaagcacagggttctttaggttataacaaacattaaaagacttgaacaggtcgattcggagctcatatgaccaagatatgatcatccgaagtttaatgctgttacatggagatttgtggattattataattaagttttgcaactataaaacatgtgtaagcgctagcctggaaaagacaagaaggctgcgccgttgacatgcggaccccacatgtcaacctaagggaccacagtagaccgagtacacagggacggtctacgggtcgacggaagcggaccccgtatgtcaaccgaggcaagttgccgacaaacggactccactagacaccacgcgagctgcacacgtggaaaccacgcagctaccgagcgggaacacaaatagggtcaccacacgctcacacgaatgactaccgacacctgtacaagggtaccgaggtcgacaaccgcacgacgggtacaggacgacaccgaaaggacgaggacgggagcagcgagaagggggatccttaccaccacgcgacgaggcgcggcacgatgacgatgaacgggcgcggcggagacggctcagggacgacggaggcgaacggcgagggaacgacttcggtggcgatccttggacgaaggcgagacacggccggcgcaacgcttgacgacgcggagccgaggacgaagacgactacggggctgcagcaaccttgacgaaacacggacgacgaacagcacggcttgacggaggaacgaacgccactacgaccggggaacgatgagaggacgaccacgacgacgaacaccggcggggttcgggtggaggggagacgaggccaaggtcgacctttccgctgcaacgctggaggaggagacggcgacgtcggccaacgcacgggcacggcggaaggggctgccggaggcgacgttgacgaggaggaggatggagaggccggcacgggccacagcgttccggcgaaatagaggagcagccagaggagaggacgacgctgcgacgtcgacggaggagacggcgacgtcgatcggcgtaccggcgacgaacagcagccggccggagacggtgcagtggtggcaacgccactggacgccggcgggaacgcgcctccggtggtcaccgcgcgaaacggagggcaggccgggggagaggaggcggcttcgacgtcgaggatggcgacggcacagcctacgggtgcacgggtgaggagggggaggcggctggaggtggccggcggcacgggagagagaggagggcggcggggagaggcggtgcggccacgggggagctcgggaagaggcaaaaacgagagaacgcacagagggggttccattttataggcgcggggagggatccggccacgggagagggcggaacggaggcgggaatggcggccggcggccatggaaggtggccgggaatggcggggccgttccaggcgactgagggcgcaattcaagggggaaattagggggaattgaagagaaaggaaaggggattaattccccctaatcaatttggaatgaagggaattgattcgcgtggatttgagggaggaaacggatagggtttcacgggagagggaggagccgggcgggaggaggacgacgaccgggtgggtgggacccaccggtccgcacggtcaacacgcgtgcgcgggagggtggcggctcgacttgggctggggcaggcccaggcaggaggagaggagggaggggtggcccaagagagagatgggaaaggaaaaagagagggagggaagagagacttcggccgctggccgagggagagagagggaggctttgggccggacttggcccaaaggaggaaggaggatttaatttagttttctttttaataaactttgataattgttgttgttgcttaataattatttccgatgctctggaaattcaaataaactttgagggctccttttagaccaaggagaatttaacaaaaattctccgggccacattcgaatttttcttgtacgtattttaatgtttgccaatttctttttgaattttaattaattctattattccttttagagaatgatttttatttcgggatgaatttatcaggacgtgacaacgttatcagcacttcgctctaagcgaagagatactacatcgcttttgattccgagaaaagcaaaagaaatagaagaaactaaggaaattgaagaaagaagaagggacatggcaacaaaagagttcgacgaactcgccctcgatgggactaactatcccatctgggcttccgatataaaaatcaattttgcctctcagggcattttaaatataattgaggaacccaatgatggggacccacaaattgagcacaggaagctcaatacatccctttttcttttgaggctctacattcacaaggatcccaaacatgaatacatgttagagacgagccctctcaacctttggaaagctctaaaagagtgttatgatcagcaaaaggaactcatttggcctaaggctaattatgagtgggttcatttacgcctacaggactttaaatctgtggcagaatacaaccatgctactcataacatttgctccaggttgaagttttgcgaacaagagctaacggaggcagagaagatagagaaaactctatcaactatacttctggaagacaagatactgactcaacaaacagtatcgcgctaacaatttccagaaacattctctgcttatacatacattgactcaggcagaaagacaccatgagctttctttaaagaatgcccaacagcgccccccgggctctgctccactgcctgaggtgcacttcaatgtacagaataatgctgagaataagaaaggattcaagggaaattctttgaatattaatcctatgaatctgactggaaagcgcaaacgcaacaacaacaggcgcaaattcaagggtcgaaagaaaggaaaagggaagggtaaggcaccacaaccttgtagcaatggcaacaggcattgcaataggtgtggatctgacactcatgtcggtaaagactgccgcatcccgaaacatcttgttctcttgtactaaaaatccctcaaggacaaaaaatcttctaagaacccaagatttgaagcccacttcaatcttacacatgaagagcgccctgaggttgcaagttctcaccaggctcctgttgaatcagagagcaacc

SEQ ID NO: 80354 - DNA, 2065 bp, Oryza sativa
gtgcatcacccacccggtgctgccgctccggcaccgctcgtcggcgtggaagttgaggctgaactcctcccaccggaacgtctcgccgccgaacaccaccaccggctcctcctcccctctcggccgctccgtcctctgctttatccacttgccgccgccgccgccggtgacggtgcggctcacctgctgctgccgccggccaccatggccgtcacctgcgggcaccggcccgatgaagtaggcctcgtcctcgccgccccggccgtggcggtggagcagcgcccacggcggcgcgctcgccgggtcgtcgaggaagacgacgccgtcgacgaggaggcgtcggtgctgcaagtagggcaggaggaagaagcagagaagctgctcgacggacggattgaacttgaaccccggggagagcccctgcgactccgccgccgtcgccattgacgcagttacaaatcgctcccgcctagctagctaggtttgttttttttttctttttctttagaaaaaaaatcatggagaagaaataaccgttatatcgggagaggttggacttttcatcccgattcgggctcgacccctcgtcgttccgactccgaaaccgtccatggcccgtacttttacatctcggtcgtctctcatctcgtcgcccagtgagagcagcccacgccacgataggtgtggatagcttttttcgtaatcctattttagccttatattgcgttcttattttttaatatacgatgccgttgattttttatatatctttggttatttatcttatttaaaaaattatgtgattattatttattttactgtgatttgatttatcatcgaaagttctttaagcacgatttaaatattttttatttgtacaaatatttttaaaaaggatgaatgggcaaacatttataaaaatacaacggcgtcatatatttaaaccggaggtaatataagtttaggttaaaatgaataaaaaaaaagcccactttatttttgaaataactcaattttgtagcctaaaaatttaggctctttaccacccctagcacacgatcaactgaatatgcacacgtgcgtgtagcctcgcgtgggttgagcataaaaccacaatatattatttggttgctcgtattcacatagttggactcatcttacttacttacatgtacacttcgccatgttcactaaaagattattgttttagctaatcaaagatatattaatcaagggattaaaagataaaaacattattaatcaagagattaaaagattgctatgctttcattaatatgcagagaaaataagttcagggagaaaacgaggaggagagaatatatatatatatatatatatatatatatatatatatatatatatatatatatatatatatatatatattgatggttagaacgagaaaaaaaaagttctacaaaaatagtatacgtgggacaattcttggataaaaatataatcttatattgtctacataccgcagaacggataaaccatcggtctcaagtcgaacgaccccctaatttgaccatcagcctcaagatatgtcgctcacagtgaatcggcaaccagacactggtggagaagtggtttttactcccggttcgtaacccccctttagtcccggtttttcaaccgggactacgaatccgggactaaagatcgctatctttagtcccgggtgaaataaccgggagtaaaaatcgatctctagtcccggttggtaacaccaaccgggactaaagatactttatctttagtcccggttggtaacaaccaaccgggactaaagagggaataacagcagtacagatggtcctcttttttcttttttattttctcccgaatcaagtgggatgcatatccccaaatcccaaatcaaagtaacatcccaaatccacatcacaaatctttaagttacttatacacataaatcaaatacatcacaaatcctaaaaaaaattacacaaatcaaattacatcacaagtctacaaaattcatcgcaaatacatcacaagttcacatcacacacaaaacaaatac

SEQ ID NO: 80355 - DNA, 7512 bp, Oryza sativa
ttgttctttatagttacttcattcagggctctatagtcgattaccattctctcagagccttcctttttcttaaccagaagcactggggctccccaaggggatgagctaggtcgtacataacctttactttccagctcttcgatttgtcttttaacttctgctaactcattagctgccattcggtagggtctttttgcaattggtgcggtgcctggtgccagttctatggcgaactcaatctctcggtctagtggcattcttgttaattcttccggaaatacgtcgggatattcacaaactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcctttatattccttccaggggaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtttcagcttgaatgtgattcacacggcctcgaccaaagtggttggaagcacgtgaaccttgtccacttgcctgagtgctaggacgagacttagctgccgctggagtaggagttctggcagtgctgccattagcatgccctgagttggtgttggtaggattctgagggcactgtctagcatagtgacccatctggttgcaccggaaacactgaactgctgacggtccttgaggtgacttgaaggaggtaacgctgtttggcgcagtattgccactaggggcacgctgctgtggctgaggtgccggacggtttatctgaggacgaggggcgtagcctggctggcggttagcctgagtgaccgactggtggtattgcacgggttgaccgtagcgagggcgaggcgcgcctcgggaagaatttccctgatggttagacttgtgtttcttgtactcttcggtagcctcttttctggcatcctcaagtagaagtgccttgttgatcatgtgttgaaaagtggggaagtcatgagcaagcaactggagtctcatcccaactgcgattcccttcaagaacttcctgatcttcttcttgtctgtgtccacctcctcaggggcgtaccgagccaacttgttgaactgacttaggtactcattgacactggtgttgccttgcttaagcctgttgaattcctctttcttcatgtcaatggtgctttcaggcacatgagctgcacggaaagccgtggcaaactcatcccaagcaatgttagtgggttcagggtgtccattgcagtaattctcccaccaatctgcagcaggtcctcttagttggtgagaggcgtagagcgtcttctcaacaggagtacactgcactaagttgaattttctttcaacatccttcagccaatcgtcagcctcgacgggctcgacggtctgagagaactctggcggacgtgaccttagaaaatctgtcagcttggatctattgttgcccatgtgagggtggccatttccatgcacattatgctgataaccggctacggctgcggctattccttgcaagatttgtgtctgaactgccattaagtgttgcatgttgttttccacatgaggtggggaagggaggcgttcttctccagaattgtgactagcagtgcggtgagagcggtgagactgttccatctctgaatcacgggaagctgtgcgatgcgagcggttgctacggcggggttgctcaacttctgcgttacgggaaacagtacggtgcgaattgttgctgcggtgagactgctcattagctgattcatgatttgcttctggttcgactctaccttcttcaaaaccgaagtgggctggcgcacgagctgcacggcaggggcggctagccatctaaactcccagaagagggcggggtaagagtcagatcagcacttaggagggcaaggagcaaagtaaatagcaactcagatagcacacactaggtataaactgaatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcagaacaaaagggcctatcacacggacggctgcagaagactgcctcctctactcctcgtcggcctggctgcctcctgtagtcggctcctctgtcgaagaaacgtcgatcggctgacgcgaagggaccggcggaacctgtcgagggccagcagcagcacgggccgctggcggtgggggagctgggtggtggaaacggaacacggtggaagaaccaacaacacgcttccgcgcagtgcggataaagcgtggaccacggcgagaggaagcaactggggtgtgtccgggggaaaaccgtacacccggtacgttccctggtccgcggttttagaagttcatttagttcgcaagcaccgacccaggtgtcgggttttccaagtcttttgtaaaaccaaagttttacccaagttgtttttcagattttaagttttgaagacgaccgtcgatactcgcatagagtgcacgaatatcgaggcgcaactgggtggttacaaggggacatggtataacaattaacaaaggaaggatcaaatgcaacaaattaggcaggtccgccaatctgccttgcagacgggacaaagattaagtgcaatcctatcaatgcataatattttgcaagcaatataattaaatttcaaatataggctcaagatgttcaaaggtggcttgccttgctcgagatctggagcttgatcctcgaaatcctcgcactgcgggtcttctggctccggaactacacgcgaaacgggacaactcaacaaacggcgaaaagtaaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcatttttggaaaagaaaagaaaagaaaaagggagagggagggaatatagactttcctcgggcggctagggcgcggcccgagagaaagggcggctcggccgagcttaacgggccggccggcccaagaaggtggcccaaggcggcccaagacgcgcgcgcgcggaggaaggagagagagtccggtggaccgggctcaccacgcgcggtcccgggtgggacccgcttgtcagcggctcggctcaccgtgcggagggagcacgcggcgcggcgctagggtggaggatggacgtggtgtacgcacgcggttcgcggtggacgcaggtacggcgggcccacgctcagcctcacggctcgcggtggaacgcgcgcacggggagggactgaccggggtcggctcgacccggtctaggctgagctggcgccgacgtggcgcctacgtggctaccacgcgggctggcgggaggtagacgacgacgccggccggaacggacggcggtcgacagcggcgagcgacggagcgaaccacggcgatacgggtaaaagcgagcacaccgggcggttgcacgtgacgaggggagacgaaccaacgggtcggatttgccgggggttgctcgacggcggcggattgcggcggcggcaaccggcggcgggagaagggggaaacggcgacgaggtcactaggggctaattcccggcggcgagagcatctacgcggttacgggaatccgatgctagcgtcggattgggcggaactacgccgagcgaggccggcgacgagcggtgcttccgagctcgggcggcgacggcggcgagcacacggcgagcgacggcaacggtcggggctgcgccggctaacttcggggaggctactcgagctactaccgaaagctaaggggagggagatggagcgaggaggaagaacggagggaggcactaccgtgcgggacgggcacggtgacgagaggccgacggcgcgggagtgatctctccggcctcgggccgaggaagaggaagaagagggcacgcccggagtccccttccgcgtccacgaacgcaccggctctcccggcgcttggcgatggacggcggaggcgagacagagcacgggagcggcagcaatggcacggaggcgaatggaagaggaagggaaaggggaggctggggtttaaatgggcggcaatgtcggtttgggaacggacttgcgcggtcaagggcgcgagctggcgctcggcggtcgcggccaaagcggcgacagggaggatgacgccggcgaggagaaaaaggggaaaaggagggggagaaagggggcttgcccctttgccgattcgggaaaaaggaggaggtgagcgggggcgacgcggcagagggaggagggatgctgcctccgtcccttggcggcttgcgcgcggagtggcggggccgggcgatgacgacggcgatgacggcggggcggtttggagcggagcggcgacactggcgacaggcgcgtgcagaggctgacggcggcggcgaccgggcggtcggccaccccggcacgcgcgcgcggctcgcaacgggaggcgcggcggatggagtggcgcggctcgggcacgcgcgctggctcgcggggccaagcggctgcgcgggcggctcacgcgcacgcgcgcgggcagagcggagaggcgcagggcgcggctctcgcgcgtgcgtgcggcgcgcgagggaggggcactcggcgcggcgacgcgcgctcgcgcgcgcggcgcggggcggagcggagggagagggggagagagagagcgggagcgcgccgggggagagagcgagagagagagagagggcgccggggagagaggggaaagggccgggggagaggggaagatgggccgagagaaaatcggcccatcgaccccgggggaggcaaaatggacttttgcggaggaatttgatttggaaggatttggattcggaattgaactcgacgatagatcggggattgagatcttgagatggcatggacactagacaacaagcgaagaaacaaatttcgcaattagggtttttaggagataattttcccgctaggcgccacgacggaacgggcgctacagaccaacccccctaacaagaatctcgaccccgagattcagcacctaagggagcagctccggaaactcggcgcggagaagatcttctcgctcccaggttgcctcatcttcagaatggttgctccattggactttgtagaacttgatggtcttccttcgagtctgacgttctgcctcttcaagaaccttgatcggtctttccttgtaggtcagattcttttccagcacgatattacccaggggaacttgctcttctggaactcgaagacatttctttagctgggatacgtggaacacgttgtgcacatctgcgagaccttcaggtagctcaagctgataagccacttcgccacgtctggcggttatgaggtaggggccgatgtagcggggtgctaacttgccggacatcccaaacctcctaacgggtttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggaataggcggactcatgagcttcctttaggatgagatctcttaactccttcttggccggtacacagatgcgtggaccgcaccaaactgtgccttggttgtctatggagaaattggtgtctttcttctcctgtattctttttattaattcttttatcccttcgtcgtctttctgagcctcccggatttgcgactctagggtaggctgtactgtcaagctggcagggacacctgactgtaccacggtcagcattaacttctgcaattctctgcacaggtgatcttggtcaggccgtatttgagctacattgcaataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcagtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttggaagctgtcttcacaggctgcagaccattgaaatttcttttccttctttaacagctcggtcataggtctggctagcttagagaatccttcaatgaatcttcgataatatccagctaagccaaggaagctgcggatctctgacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgatgatccctaagattttccattatcaacctcaggtgttcagcatgttcttcctcgttcttggagtatatcaggatgtcatcgatgaataccacaacaaactggtccaggtattccatgaagattttgttcattaagttcatgaagaatgctggagcattggtgagtccgaaggacattactgtgaactcatatagaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccttcctttttcttaaccagaagcactggggctccccaaggggatgagtaggtcgtacataacctttactttccagctcttcga

SEQ ID NO: 80356 - DNA, 3519 bp, Oryza sativa
cataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttattcttcctatatgttct

SEQ ID NO: 80357 - DNA, 17428 bp, Oryza sativa
tccgtgtatacgtccgggccgtcctcgcggagcgctcgtccatggtctgtccttgccatgtgtgttgtgcgagccgcgagagagaacagagcgagatagagagataatagagagagaggaagaagagtatggcaggcgggtcctgcattttttaattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgctgacctgcactccagttgttgccattttctgtaactatatttcatattaaaatatcagttatgacttatgagtttgacactgtggagcaatgcattatagctttctgatatagatataaaacctgcagagtcaagcttgagctcattctttctaacttcatcgccaagatgacaagagttcaatgcctggataacacaacaaatataagttatgcattagtttgacaggtgcacattgaagaattaaaatgtcagtaaattaaaattaaaagacctcccaaatttgttcatcgctgtactcctccaaagggtcaatgttatttcgtagggtcccctcaaacatcacaggatcttgtggaatgatactcaatcttgtccgtaggtcgtgtagtccaatggtgcagatatcaaggccgtctatcaacacttgcccaatagatggctcgacaatacggaatagcgcttgaatcaaggttgacttgccactgccagttcttccaacgatgccggtcttcaaccctccgggtaaagtgcaagtaaggcctttcaaaacaaaaggcaattgtgttgcataccttacctgcatcacatacaaagcacttagaggaaaaaataacacttcaccagaaatttctgcattaggtgttgtatgttttccatgttaagaaagaagatatagtgttgtgagggtatttccacagtggtatgctggaagtcgtacaaaatagtatattatgaaagaggattgcaactctacagtactagaaaaaaaatctgcatgccaatttttgtggaataacttcgatataaaattaatttaataacacactgtttttctcagaaaatattatgaatagaaatgttgagagttctaatcaataattgacatagctccgacattgttagaagtgaacttatataacaacatagagttcaagagacaaacatggaggttgcgaagctcaatttcaccatttgtcggccactggcagtttggtctactttttgatattgtaaggggtggttcagaaggaataaacatgtattgaaaaattctttcaacggatatcattctattttccaaactacagagcactgcaatagcccacccttgtaacatattcagactcaatccataagtgactgcaagaccagctgtctctgtgaagtagtaaatatgagagttagcacggatgttaatacaataatgaactaatttgatctgactaatcaaattaaagcccaccgtacttacttgggtcaattagagcagctggcaaggtgaccagaagtatcaaggcaaatgcgaagataaaggatgaaagaatgtccaagcgaaagcacaaccattccattgaagcagcattatataaacttggtctagataaattatccatgaaatgactgacggcattgataaactgtatttccttgccaaagcatctaatgatatttgatccagctactgattcagcaaaatgctgcatcacaggagctctgcaaactccagtcaacctctgcaactctctagcaccatctatgtaatattgctgaagggaaggaattgtggtaattaaaaacaaacacaaaatatgagtcgtcttgaaaccaataatgtcatagaaaatgcataattatagttttgaaatatggtaacaattattattgttcaatagcatattttaagacaaaatttgattgttcagaagaacatcggaaatgtacaaggacactcctatatacactaggatcaacctgaaaatttgattgggaatatttttgccaagtaatgtatcacatcatatatttacttaatgattttattttgtattatctgtaattgctttgccatccctttaaattttaaattaaatctgtgaaaagaaaaacactgatgttcaattttcagttgaatctgtgaaaaattgtcaatatagtcatgaatcaatgtatttttccttctacatacttaaaaattataaactggaaccacaattggtatcgaacataagatatataataaaaagaatatctgataccacagagatgctgcaataattgggacaaaaattacgaagactggccatgctacccgtgacattaaaataattgttccaagaagttcgatagcaggaaatagaacatatcccatcaggtcaaaaattctggtgtccactgtgctttgatcactagaagcctgcaattttgtttcaactttcatgattaattgaatatgaataaaaattctaatggcattccaaggagataacttcaattttttcattaaaataaagatggtgaaggtaaattacttctctggtccaagatcgaccgttagaagtggagtcaaagaaagccattgaggccgggaataggcatcaatgcttcttatcaaatagcatcattgcagtcttacatccacccatgacaagaagatgggatcttatgaaaatgaataacgagctcacaaaagctaacacaacatatacaagtaccattttcaagctattgactggaggattcacatctttggatattggagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtagcactcctgaaaaatacaaggtcgtgttgaataactttcatacagtagatatactcttgaaccctgaatattgttcaagaacaggctacctaaaaactgtttagctgaaacatacaaaagatctgattaagacattaggtttctgtccacacaataaactatgcaaagagataaactgctattacttattttggaagttgggaaatgaaaaatcaaacaaaacaaacatgttctattcgtctaaggatttgataacggcactagcactgacaactgaagaaggttaaaaaaaaaccccctaaattgactgggagaaaatggcgttgaaatcatatgatgtaaatatatattttgtagtattagaagtcttaagtaccaacaataagttattagtttaagcattcagtgatgatttacacacatatagaaataggatttaaagatttgttttgaaaaataccttgaacaagtgcaacccagtatgagcatcaacagcactgaagggatcatcaaacagaaagatatctgcatcttgatacaaagcacgtgcaatttgtatcctttgcttttgtccgccacttaggttaatgcctctctctcctataattgtctgatcacctaatggtaatatttccaagtcctttttaagacagcatgcttcaaggaccttttcatacctttccctatgcagttttgtgccaaaaagtatgttatgttcaattgtcccactctgtatccatggcgattggctaacataggcaatcctaccacatgtttgaacatctcctgataacctcggtatctcaccgagtatgcatgacaacaaacttgattttccagatccaacagttccacagatagcaaccctcattccttgtcgaatacggaagttcaaatttcggagagtaggaacctcagaagatgtgttccaagagaactgaccgttcctcacctcaatcgatacatcagttgtacctcttagaagtttagttacaacatcgctcgatagttcctcgaggtgcataaaagagcatatcctgtcaagtgatacttttgtctggatgatcacagagactgtgtctgggatactattgattggtccttgtagctgcctaaacgttgctagagcagacaatactttccctgtttctaatggaatgcctagaagcaaacaacttccaaaggtgaccatagcaataaaagcaggagctccaaagaagacagatataagcataactgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagtttttttttaaaagtatccgatctcaccatgcccatctcagcattgaagcacagacttaataaaaatagcaaaattagtgcaacagactgaaaatgagaatatatattacgcattactccttgcatacctcaaaaagaaagaaaaaaaaagcacgcatgtggaataggatggtgtcagccacaaatcgaaatctgtgcgaaatttttgtaaattaaccagatactggctattcggtgggagagatggaggagaagagaagttggcgatctcgagccctccggcaaagaggcggtggtggcggcggcgatcacggagagcctataaatgaatgcggcggtgagggtcttgagcccaccagcggggctagcgcaacggtgccgagccgaccgaagaggagcacggacgtgccgctggtggctggggcaagccgccgccgccgctgccgccacggccatccgggtgtctgcgtggtttttctcagtgatcagaagttggaaagaagccgcgtctcactgaaaaatttgataatttaacgcttttttccgttgcccaaattaatttaattgacgtttgtaaagatcgccgccacggccatccgggtgtctgcgtggtttttctcggtgatcagaagttggaaagaagccacgtctcactgaaaaatttgataatttaacgcttttttccgttgcccaaattttaaggagtgttaaattatcaaatatctccgtctcgctcgactcacgtgaccaaaggagacggaaattacctatgcttgcggtacgtgggttttttctaatttctcaaaatcttataaaacacatttgtttgttatagatttgggtggcgagtttattaacgacttaaaagtaattcctatcacaattatgaaaaaaaagctgttatagaacttatttgcaaatctgaaccccggttttcttcacagttcacacgctgtacgaccgtagcattatcaatgtcatgcctaaaggttattttaaaattgagtaaatttggagtttatttcaaacaaaacaataaaaatgttagttaagttcaaattagtgcggattacggatttcacatatgtaacgcttgaaaccaatatcataatccccgcttgttagtaacggttcccttcttccccttaccatctattttcctccatgtcataggcaactaactaaatatcttcaacgaatgttcacttgctctcgttctaggggtgggggtgggtgggcatgagttgcgcaggcagccgccctcctattcaaccggcggtgatttggagaactggtccggtatttcacgaggctcaaaatagtttgtaaggggtaaaaaacaatattaaaattcggggattcgtgaattaagagcaggtttattagtgtagtaagctaccagcgatagtatttgtccgtgtctgatatagccatcaagagagaagctcatgcgatgaactagctgtttcgctagctaaatggaaataaacaaacatttaattcatgcatgcacaaccaaattggcatgatcaaaactaaccaccatccttgtagctatgtgtgttgcctgtgctctagcgtgttagatagggagaaaaacagaaatacatgcaaactagatcgtggagatatgtcggaggcccaccaaatacgtaggtatcacccatatcagctgcaagcgagcagtagaggctcgtttcttacactatcgcccggtgacagatctagcgtccgctttttctctttcttcttttctccctcacccacataggatttcgctaatgtggaataacgtatagcctactgactcaaccttattatatatacctgctctaagaagtgtaagtcgccatcttcctcctcgtacatcgtaattcgttgtaaagaaaccacctcaacaaaaacaaacacgtgtgtttccatccaaaactcatcccaccagtaaaaccagatggatgaaactcaagccttgcaaattttccttctaatccctttgcaaagtaagggtatagcgctagtaaaatttagaagttgagttaagtaatatggactattttttttgaaaaatgaaataaaattaagatcgttctcgaatcgggtatacatggatgaatacaaaggaaaagaaaaaaaaggaccaatgtgaagaatcaaaatagagatgacaaagtctgcaggcatatacttacctgctagcttcttcgttatgcctaaaagcctaacaaatcgatcagaagatcggccgctccccttctcaacgccggctgctgcctgctatgcgccgtgccaaggccagccgtcttccacggggtttcgtagcagaaggggttcatatgtactgcactcctgtatttgtgtggggatttttttattacagtacaaagtacagatttgtttaggctaatccaatagaggtaataatcatatagaaggaaaccattgcattcgtacccttcttatgtggagaattaatgccccttttatttgacacctacagctacccaaaagtatgattagtcaattaatgaaatataatcgtacctgccatatattgaaatccaaatttacagccgtgggcctatttggcaagtttagagaatattgcgagtttatagaagggaaatagtagtgtggctgcattcggcatgtttggcgatggagaggactgatagttttgagaggaaattaattaatagtaagattagaatttgatttttaagtctagcatgttttgcgatgaagaggatggaaagttttgatgggaaattgattaatactaagactagaatttgactttcaaatcctagtatagcatgtttggtacaagtggtgcgaagtgatggaaattactactccgtcccataatataacaaactagtaccgaataggacactttatagtataacgaatccggacatgcttcctgtccagattcgttgtactatgaagtgtcacatctggtcggagggagtatcttcctagtttctctataaaagtttggttagtcccttcggatacaagaatgaatatatatgtctagattcatcaacatctatatgaacgtagatccaatcccacaaccgaaaaaaagtacaatttcctataaagcgaaaaacaaaaaaaatccataaaaaataaaaaaaatctagaaaacatctagaaaggatttatatttgtcgttttagtagtccatatatatctcttctctatctctaatctaactaaaaaatgcgcggaaagataaaaacggtttaaaaaaacacgtgaggaaaaaatatcagaaaaaagcacaaaagaaaacacgctagaaaaaaaggttttcgtagtaaaaaaaacacgcgagaaaaaaatatttccatcgtctgtaaaaaagcaaaataaaaagcatacgaggaaaaaattgtcagaaaaaaaggctaaattgatggacgcttggttggttaggatcatcgatttttttttcatctcctaggcttttgtttcatcatctattctcctgtattggagaccctgcacacctctgtagtcaattatcatactattttttgtgaagtatagctactattcttgataacatattatatggaaataatattagaaaataaacatattgtaattgttatttagaaaagagtgcacagtggctctattttgtgtagacttgaccatgcgagtcagtgtaggatttgattggttgtaagaatgagattaaaataatatttaagattatatgcatgttgtcacatgaataatccaattattttaggtaaaccaaacatcggtaaggttgccatcatcgaggttgggccattacatttaagatgttctaattttctaattttctgattgtcatcaatatggttatgtatgaaaaagtatattatcattaggttttttcatccgttgcaaccacaggtatgtttgctagtatatataaagaaactcagtcggacgtccatggtagagtgaaatgtggaaatcaactaaaacaggggagaaagaaatagagttggtttcaactttcaagaaaagaaaagaaatagaaaaatacacacaacaagggaaagacgagttaaaagaactgggacttttcctcacaaaaataaaagaagaaatcgattgggacttaggggtttagagttagcagtgatctctacgatcgatctgttgcattgccacctcgctcgtgctcttactttaatctgttgcattaacacgattgattctcaaactttggtttcaagaaagaaaaggactcaaattcacattgggttctatatataggccttgtttagttaattagttccctaatttttttttctaaaaaacatcacatcgaatatttagacacatgcatggagcactaaatatagattaaaataaaactaattgcacagttaggggggaaatcgcgagatgaatcttttgagcctaattagtccatattagccataagtgctacagtaacccatatgtgctaatgacagattaattaggctcaaatgattcgtctcgcggtttccaggcgagttatgaaattagtattgtcattcgtgtccgaaaaccccttccgacatccggtcaagcatccgatgtgacacccaaaaattttcttttcgcgaactaaacagacccataatttgtcacgcccagaaattcactagtaatttccgaactaatttgcgcataaaattcttgtccaggaatcaaccgaggtacacaaactgacaatttaatatacatattcatcaaaagaactaaagcgataaatacttactgaagaggcacttagtcctcacaacgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcacaacccaccattatcaagttttaattatcaattatttatcacaacacgattaaccatcgtgagctaccataaagtatccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaattaaacctattaaagaaaacactattccaaattgattaaacaatttacaaacgatttatactgagattaaagattaaaacatcctccgaaaattattggaactaatttagtggatgatatatagtaaaaagaactaatatgccattgaaaagggataacatgatttatattgactttggatggctgagattaatcttgaccgagtcgaccaagatcggatggtttggattgatctggcaagctggcctcacgagataccgactcaacgagtcaattctacgtgacacgggatcaccgaaatgattaaccgaaaccggcggctctgaacggctctaaactaaaggacgactcaacatggacgaacgaacgaagcacggggaacacctcgttcgaacgaacgagcaaacgactcaacaatggttgcggctaaaccgatgagctagacacgattcacggtaaaaccctggtacgacaaacgataggccggtagaaacctagggatgcacctacggctttgcaactcggctaacggactacgggaagcaaacaaaccacgatgacgatgacgtgggatagaggcggcgttgcacaatttggagcaacgactaagcagcgacagtgacacggtttagcagcggcacgactgcgtcaacgacttggcaaggcgcggcagcagcaacgactcaacaatgacttagcaagatggctaccgagctacggcaacgcggcagcgacacaacgcagcagcaagtggctcggtcgctgcggtagcgggacgacatcgacttttggcacgcacgagcagcagctacacagctgtggcagggagcggtacaacggcggctaggcggctagcgcagcggcaatgctaagccaacagctaagcgcggcacggcggcggctactcaacgacacaaacaagagattaaaacctaaactgagggaacacagatagaaacctcaccaaaccaaagcgatcggagagggagagacggcgatgactacccggcggcaacacacggagacgacgatgacgctagacatacagcggattagattagattggattaataccctaggaaaaaaacctaaatcggtgaacggcatgggagcggtggttgcaggcgaaccacggcacaataatgcaaacgagggcaccgggagaaagagaaggcgacggcgattcttaccaacacttatgcgacgacgaacagtgaaggagatggccggcgacggactccaaagggcggcgaggttcgggtccacggcagcgacgattttccggcgacgagcagcggcaacggatggatggacgggcttctccccggctgcgacgctgtgggtggcgacggcaaagcttggcgacgacggaaggagcagtagggcctcgccggagatcaaaacgcgacggcgaacttcgggttgacggcgacgatggagctccggtgggtttcggctacggggaaggggtggacggggtggagcttgaccttgcggagccgagagaggcgacggcgtaggtcgtcgacggctgaggcggctgctaggggcggctggagcggctgccggcggtggacggagaagacgaacgcggcgacggcgctacaagcgacggcggagagagggagaggtggcggccgaaagaggagagggagggaactctatttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaattgttaaaaatacttccggtgctctaataattccaagaaaaattattaaaatacttgaacactataagtatttaaaaaaattataagaagaccatttaatgattaatttaatatgcgaatcattgctgaactgctctttgtattattaaaattagtaattgagctctgaaaaattcgagaaaattgcagagcgtatatttaattatggagaatttaataaaaattaaatgcagccatgatttatatttaggaaattttatttctcacatttaacttcacttgtaaattaatgaacatttaacataaattctaataataatttattaaataatttataaatcataaaacaaaaatcaggatgtgacataattgtacaatctcggattaattaattaatttagggatttgctagacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattgcaacagtaattagaatagcttccttcactgttcttcgaaaaaaaaaagaaaaagaaaaaaaggagtcgaggacgagaagagagcacaccatcagttttattttattaagaggggtgcaggaa

SEQ ID NO: 80358 - DNA, 641 bp, Oryza sativa
atcgtattgcccgagcagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgctttgctaggatttgtgggggccccatggacaattgcaacttatgttgttgaaggggggatgaccaacacttacacaaatataaagagcatgtgccacacagcaccaaatgtgttaaggggacttttgtctcaccttgcagacgccatatctgaatacattatttaccaagtaaactctggggctcaatgtatacaaatatttgattcatggggtggacaacttccacctcatgtgtgggagcagtggtcaaaaccatat

SEQ ID NO: 80359 - DNA, 6790 bp, Oryza sativa
tttcccccttccctcccctctttcggccgccgctccgccgcgccggtggtcgccggcggcgaccatcggggcgtgggcgcgccgcctcccgccgaccgcgccggcgtggccgccctcgggcgcgccgagtggctgccgcgtggggcccggccgtcagccgcccgcgccctcgggtgcggctgacgtgtggggcccacggcgccggccggtgtgagcccgggtgcacccggtccaccgtggaccgtgaggctgccgcgtgggccccactcccgtgaacccggtccgcgcgcccctccccctcggctgacgcaataaaccctttttaaattaaaatttaaatgaagaaattcgcaaatattcatttaaagagcatataaacttcaaatggccataacttggccatttgaactcagaattggactgttaaagtctctaatttttccttaagaagtcaagaacccatttttgtactttgttcctgcttgttatatggagtttattagagtaaaagcccttttattttccattggtcgtatagacgctgcagcttcggaagatctgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattattaccttgttcaccctggaataaacaaaaccccaactagtggacactctactcatggtaccagtagtatgattttaggtagatgcttcgctggttaattaggcaacattaggtggttttacaactgtagactttgggaatattctcatcacctggacactatggaattgttggatcattgtggaattggattcacacctcccctctattcaaaaccctcaaaatggttttaggctgggctcgaggtgcatggttttgatagtagcacctcggccatataaggaccggtcctcggccatataaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaatgatgtacacctctgatcagagtataacctattcgaatagccgcgccctcggttatgggcaagccgagcaatgtacccaagttagtgtttttaattcttaaaacctgcttaacaactaaaatgtggaatggttgacctgggttggcttgggacgagctgggacccagggtcgggttaccagttcggtctgaatcatcgtaggccttgggttaaggcaggctcgtgtgggttcacggccttgtttaataatattatatagctctagaatcgtgtttacaaaatagctttgagcaactaagtgtcttttaatgctgtttactgcaaaccctaaccctttatactataacccccttgtactcccttgcatttattctgcacttatgggtgtgtcttgttgagtacggtggttgtactcagtcttgctcaatttttttcccaaacccagaagaggagcccctggacgatgaaggctttggtgtctagctcgtgcctgccgtcaagcgcctgtggtcgtcgccctagtcttccgctgtttttcgttcgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacagatgtagagcataaccattgcctcaacaccaatcacacaaaacataatggaacacttgatggcaaaaatgttgatctccttaagtggtggaattagactcttcctgtgtagctcacttcagacaagatgttatattggttcaagcatatatcctctatctctttaaagcaagcatttagccaggttggaagaattataactattgaagaactgatgagacagttcttcatgcctagcacctgagaaagttgagacatacttttgccttaaagactggatagaagcatatcaacaaactgttggtatttcttacgattacagataaaatccgcatgcgcacggatatacggatgtagcacttccactacggagtattcaatgggtatcgaatccaagggaacgtgtgagattaattcttcctccggttcatccaaggacaccaagcgaatgtaggcagaggatagagaggatttcctagtgagaaacagtgtctagggaaagcttagttttaatcctaacgcaatacttcaggcactgtcaacccgctgtttccagatgtcgctttactccgtacccggacagggaggacttaagtgctcttgagggctgtcaccacctctacacccaccaaaaacgtactataggatacgcagcaattacaggataataattacctctaaacaccatgtctaagcaattaaaatctactttagtgtttataactcaccaaagcaatcactatattttagttgattatagtgaacaataatcccgtatgctaattaggaactaaccaagagataattctcacaagataaatctaaattacttaggaaaataattctattaataatagagtaataaacagaataaaagagacaggaaaggattaccgacagatccggaattcctccgacttcttctactctactctcttcctaattctagtatacaaatagtacaatagagcctcttgtaattcagctcaagcttgggagtgtgtgtgggagtgaaggagtgaagctccttaaataggacagttaatgacggttggcgaaggggaaatgtccgaagtgccctccaaccatcatcagggatgcatccgggacgtccatgccaaaccccagcctgaacggctgagatgctgattcagtggctaggcccatctggcctggcctttggcccatctccccctctgatcctgctctatccaattctcggagttttgggctgattctccagtgttttgataaagttcaaagcccatccttgtatggatatgtttccttctccactttagtttgattttcctcccaacttctgggttcatcacctgcattgaataaataccaacactcatggaatatgttagaaataatccctaccactatgttggatgttttattatctggacattatgtagatgttggcgatataaatttagcacttaatagccgccaacacagatgcaacactggctagaggatctagagattgccgatgcaacagccaacacattggtggaatttggcatcaacaccgatgacaacgtgccaataagaattaataatgtaatatatgtaatagtgtaagtcaatcattgtactcttttccttttccggaggaaccctactttagggagtaaggtttttaacaaggtaacaactttgtatccctactatgaaatcaatttatttgcagtgcatatttttattttattttcctgcatagttagaggaggcaaaacaaatctcagtatcccatgcgcaggtagctgagcgaggcgagaaactgagttagaccatatcgttttccctctatatcatatttccctccgaaaatttcagaactcccaagttgtttctttttccctcctctgtttgcagattggccgcttagaacagccacaaaccagagcaaccagacaactagagtactagtgtcgattatagaaatcagcaatgagaaaagagttaacgcatgagatctagagtggatgagtaaagggacaagatttagacaggttcaggccttctcaatgaaaagtaatacctactcctattttggagattgcatccagtattgtattgatcttatgatcaaattgtggtcatgaccttgagaggctcctttccctccttatataggcttgggggtagggttacaagaaggaaagcccaaccgaatacgacataggtttccttatcctcttttactataaagttataactcactaactcctaaacttaacatgcaaagattctacatcatcatccattaacaagatgtcatatcatcatccactaaaaatcattaatttaaacatcatgcaaacatgctatattatctataattttataatttattaaattttatagcttttaaaatacaagcatgttaaatcatcatcccacataattcacataacatttcaatttatgtattcattatttttttataatatgctttgaacttatatagttcatcctcacttagttaatgttatttctctcctctcattaagtcgtatcacatcaatttttttagtgcttaagtgattaatctatggtccaaattatccctctccttttcttctgtctaaactatctcaatcttttctttttttgtaaagtcatatcaccttacttttacatttgaatcatcattctatatactatttaaatttaaattatcataagccatgttaacttacataatcttatgttgtctagctatcttacacattatttgtacttgttcttgtcatactaaactcccgtggcaatgcgcgggatttcacatagcacatgtataataactaagacttataaactataccttggaatacaagacaactcaactttcaaaaccccatggatccattcgtctcctatctccagttggataagccgtccgtgtaggtataggtacctatagggtttattaggttgctcgcatttccttagcctggtccagctccctcatctaggccgagtttgtcctagctaaggagatacacatgcaactgttttgttgtttgcattggttcagcctaattagcatgagattttgtttggttagttgcattagaaatacagtttaaatgtttggttacttgcattagaaatacagtttaaaagagattttgtttggttggttatatggatctcatatgtgaatacctagggtgagattaccacttagaactaatggatgaaaatttctaccatccaaaaactgatttttgtaattcaaagcagtttaggttataataaaatccatatattgtctaaagcaaaagaaaaatattgctagatatcgctgtgcacaagatgttgatatatgatgaatcggtaacacaaaatagaaaaagtaaaagagaaaacaaaaaacaaaaatcaaagccggtcaggtgttcagcttgccgttcaattcgctgctcccagcttaccgtccgccgctcgccgctccccgctcccagcccatcacagcagctgtggtgtccagatgaccagatccgacggctagctgtgacccctgtggcggccggaattcggacgggcaggcagtcggggaagggagacgttggtggcgacgacgtaggaagtggtgcagcaccgacgatggcgaggtaggcggagggagtgatagatacagaagtagatagtggctgtggcttctccacgaggtccacgcgagctccgccaaggcacttggctccgcctactccagatccagccctcatctccacaggggctgactgagctccagccgctcgtcgccgcctgctcacaaattcagttgttgtgagttgtgaccctgcagccgcctccagccctcatctccaacgtagccggccgagctccaccaagcccctcgtctctgccgtcttctcgccggttgttcttccctgcttgctcgtctccggcggtcggtggggacggaaaccgcggcttgtaggaggacgaggagatcaggagccgggtgagagcagggcaaatactcgggtggggcggtgaccccagcgaggccggtgcatgtgcgggtgcagcgccttgcactcgcgggtgccgcgcgctgcatgtgacgggccaggctgtgttgcgaagctcgattcgagctttttccctcagcctggctctgggctccgttttgcagccgctcgacctggcccaaccaaacgtgcaagcaaccaaacacaggtgaggttgcatcccagatgcgggccaagtgcgaaccagacaaccaaacacgcccataatttccacaaagagtgctagacaagcaggttgcaggcgaggcgagcttgccgcttcgtcgggccttgttagaaataatcttgtactaggtgatcatatttattttgttgcatagcatcacatttagttgtaggagtagactaatttagttgtcagctgcatgcattagtcgttgtggcatagcgagctaatctcccgtgaagcacaaaatatgttagagtgcttatagtagattggcagccaagtagtgcgtgcgtgcaggttggattagtctcaggattatgtggtgaattagtcttgcatgtattagttagttgcagatgcatgtgcatgcatgcaggttagttggttggtgcaagcaacgacgtcggcgaggactcagtagtggagatgtggcctgagtcaaacagttgcgatacttgtagagttg

SEQ ID NO: 80360 - DNA, 510 bp, Oryza sativa
accagaacagttgtgtatacatgctactgccaaatactcaaattcttccatataaccattcctttcaaatgagcatgttgttactgtctcagtctacattaagcttaatgtggcttcattctaagtaggatcagctgctaacattgatccggaagaagctcagcaggcacttgaaatagccgaagctaggtagctagagactagactgttccggtccctttgggcaaagcataactagtattctctctcgccgtgcacgcgcacgtgcacgcaataggcgctccgcagtcacacatgattgccagagtccaaagatacttttaaggccgaccactacataggagcgataggaaaccaagccatgagcgggcgctccgaagtaaaggccaaacacttcggcaggatgctgctttatgtttaatttatttcgctttctgtggaaaacttgtaataagtgattatagttttgtgcatctatgggtgcagtgactgggatattaatattccatt

SEQ ID NO: 80361 - DNA, 16858 bp, Oryza sativa
tttttgtaaaacttttaataaaaaaaattataaataaaaaaaattcctatatgagcgagtgaacatgggctgtgctgagatgtgctctccaggccgagtggcatctggcagctctactcagcgaccaccgcgaggaagccgccgctcgccggagaatgacaactcccctcaagttcggtgaagcgacgggtgcgttaaactgtattgtcattgtagtgagatacctctagaggtctttcgactacttttacaaggtagtggactaaaacggtttaggttgaaagtctcacccattcttttgtttggtattagatacttccctaatattcgtatttttttattgtcattgtaggtactaaagcatattttaatccaaccttcatactgcgattgttattactactccattcgtcttataaaaaaacaaatctaatacatgatgtgatttgtttagattcgtagtatcatgtctttgttttttatgggataggaaaattagaaactaatttgggatgattggggctgttaaaaaacgacaggatatgatctgtacatattctagtattacatctttcccttttagggacgaggaaagtagaaactaatttgggatgattgggttgttcaaaatacgaggggggatatgtatccatgattggataatttgcagctccatcatggagagtttataaaactgattcagaaatgcggaatcccatttcattcccatctagttttcgtcctatgatcatgttctcatgtaacatcgtcttactggaccagtatgtactctttggctggtatgctaagttgagctgggttcgacactaaaaaaaaagttcatcatggccaggctatctggactttgcgcagttaccttagtaatgctattgcaagacaacagcaagaacctgttgacgctttttcgtggccaacacacgatcacctaacgatttgcggtgtaatcaacggagtcgtcaaaatcgatagatcaaaatcggctagtgaaaccgatttctagattaattcactttcgcgaaatcaagcgactaatttacaagcaaattagcaaagaggataaatatcgtactatgaacgactagtttccgagcaaactagcaaaggataacctcctcgctttcgtggagaagcacgaccatttttcagcgcaaagcggcaaagattaactaaattctagggttgctagaacttagccatgaaaacaaaattaaaaagaacaaaaaaaagtaaaagagatgaatagtgatcgaaattgttcgggctttttttctgccgacgcatggactgactttataagcaccacaggccgcatcaacgatctcctttttctgctatcgttccttccttccttcctatccggattccatactggtatactgcatgcaatcaatcaatgatcttctataatccacgacaccttgtggcctcctgtagcctattcctccacaaaggatccggatgcctccctgcatgtaagctacacactgaccctatgtggactaatacttgcgacacacctctgattacatgtcaccaaaccaggttaattgctgcagccacacccaacagtttgcacacacgatctcttagtgcatcataaattcctgcacatgcaaactgagtatattttccaagtaaatcatttgacagttttatcattttattcaaaaacaatctggcctgcacaaatgtactaactataagccaaattatggtgcaaacacatgcccccctgtttttggtataattagaacttttgttttaccgaaaatactagaaaaattaaccactcatgattgactatactctaaatgtgatgttagtcctaagccaatccatagtcgtcctcccaaaatgatacttaaataagtatcgatcctgggaccacccatagtcgtcctctcaaaacgatactcataagtattcgtcctgagaccaccatagttgtcctttaacgatactcaaacaagtatctgtcctaagaccacccataatcgtcctctcaaaacgatactcaaataagtattcgttctgagacaattaaacttcctgcaatacactaggataaaatatttctagtatttttcactgagaattttaagcaaccttcacccctcataaagtaaacaaacttattattcccaaaaccaatagaaaaaattgtttgccatactaacttacctatttgaaacgatttttcacttattttttttataagccttgactactctagtttaatcaagacctacaccctgtaaaagcacctaatctatagataggcgatataattcatcaaagtatatttcacaacccatcaccgaacttttccatcttacctagtctttacaagtaattaccagagaaactcataattcatttgattcaaattttactactaattcggtcatccctaatgtccattaaaccgaattaacctaacctccaactcgatctggtcatgatactacactatcagtagctattaaccaccagttactagctcggccagaacgacaagacaagcccctgtctccattgcattcagctggccgaaccatcatactccaatgacgcatgtacactactactagaacgtagcaccaagaccacacgcatgcactgtgtacccctatcagaactaccaggagccagcactactgcatgtattcaccacggtgctactactagataaatcggcttccactgaattgctatgcaaactaacactactatttaagccgatttattcaatataatcacacctctactaatcagaaaacaagaaaactgttgcgtcaagtaatttgctttgctattttcctccctgaatatatgacgaacagtaaaggtatctgacaaattaattaaatctaaacatcggtccaaataactatttattttttttagtccataaaaacactaaacttcccattaatcaattgaactactaaaagtgaaacatcaaaagcatatgcatccctcgcaccaatatttaccaagctttgcaaaccgaataatagagcatctactcggtctaaagtgcaagaatactctaaacggactgatagggaccaatgtgtcataaacaatattacttagtgaaattaaaacagtaccagctccttgccaactcacacaaactatatacgaccgaaataatttctaaagagttataaaaaatcacggttatttctagcacctaaatgtttcggtctctaaaagtgataacaacacctacaactaatagtcaatatgcaagacaatacggtaacatccctccataatataaagattgatgaaccctgagttccactcgtcactcaaggctgttgttggcccgatctttcggtgagttgagataactacgatttgtggaaaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaactctaaaggctacctagctatttaaggaggtgggaggacctctaggtcgtcctccacctggttggggcgcaccccacatgggccccacttgggccggggtcccaaacgaagttacaagtccattggcccatgacaggtgacgcagcaccttgtttttgtatttgcggccaaacgagatggagtctgctgatgaggccagatctgttggaaagaggactccgagaactttccatcaagtactcatgggacaaaaacggaggtcgtatgcagattcggtagccgtgtgaagtcagcagtgtagcaggtggccgaatcggattccagcacttggaggacttgatcttgatatcatcttgttcatccatgatgtgagctatggttgtatctgtagtagccatggtcacatcatcctccccttcttcacggaaaaccgtcctcggtttttccatatggtgctcgccacatagtccattcaaaataacctgtttcatccaatcaaaactagagaaactcgaagttgtgtgattagcaataacatgtttctctaaatccgaacaaatgaaaactctatgcaccaaatatattcctctatcattatattcgccaaagatatggaaaatagcattagttggacatggcaaatcagacttagcaaataatttctccttcaaattatcgagctcacaaaaatcatcaaaatgaacatagcccaaaatattgaaagaagatctcaattcactctcctctacttcatcatcaatgtgaacaacatgtttaaaattagcacacaatgaaacactagatatagtatgtttattcactagttatggcatggatataagtgaagtactatcgcacaactcttctttatcacaaggaacagaatgcaaatcaacttgtgacaaaggcaattcagaagtaggttccactaaagtttgctctaggtcagcatggaaagtggaaaaatgtaattcattagaagcatactcaccttgagtaatttctgcaccatttaatttaccttttatgccctcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttatttcccacagtatgccatcaaaaagatgcagaaccggtacacttattactagcagccttaatcatttgagcattagaaaaatcatactcatcaaattgtttttctactgctagctcccaattaacataagcggcggaatcatacttaccatcaaaactaggcaatttagattctacccttgtaagatcattatcatgtatcatgcgtgaagaagtcgctatatctcgttgatggtgaagatgttgacattgagcatgaccatcttgtttccccttgcgcaatcctgccatggttagcagcaaacaagaaacatacacaagaatatacacgctcctatcaactactaggtagtggcagctcaaatctcacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctatggagctctgggtaggcttaaatatgtagcaaaggaaagcaatggttcaaatcagagaatgcaaagttgaataatggttcaaagtcaagtaccatgctggtcctagactagatcgtactagagacgcgagcctagagacaaatggtaccacaagatagcactaggaacaacttatgcacaactctgatatatgaaagcaaattcaaagatacaactgatttttctcttttccttttttttttcttctttctttctttttcttttcttttttttggtgcggcttttctttttcttttttttatgcacctttctgccttttttttcttttttttggattttttaacaaaaacaacctcaaggactataaagcaagtttacagggactcaaatgtaaatataaaaaaatacagggactcaactgtaaatgtccaaactcaaaattaaaactatacaaaaatggaatgctctcgtcccgtagattccgtttttgcagacggatctccaatccgatacacaaaaatttttcaccaagctgtctataccgtgaggagaggggatggagggagtcggactcaccaatgccgagaggaaaccgtggctggagatctcaccaatgtcgatctatggaaaggctccatgtgaaaacagagacaaatccctccctttttcttttctacgttggctaccaaacagaaaccaatccaatctaatctagacagatctctcctccttccttcttcctcgcacacacatgcacggcaaaaggaacacacggcagcaacacggcctcgggacagcgcagaatcacaccacaaaaaactagatgcaactcagcaacaacaaaaccgaccgatagaaacttctgaaaaactagaaaaatgaaaccttggcggaaagacgattccgttttcgtaggtcctgacgacaacaaagcacacgacgacgatgatgacagtggtacaaaacgtgaccagaactcgaaactctaaacgaactaaacgctatgaccagcaacacgacgtgacgatgcaacacaaaattcaacaaagcaaaaactgaaaaaaacaatgcaatggcacaatatggctaggtgaatgatacgaatttttttgtatggctattttctggttataggaagataaaaactcaccgagcaacgaaagctctgataccatctgatgaaccctgagttccactcgtcactcaaggctgttgttggcccaatctttcggtgagttgagataactacgatttgtagaaaaacattgacgatccgactacaaccgtacgagacgttgtgttgcgccttagcgatcgatacacctctccgtgggttgttgatcttgccaactcacacaaactatatacgaccgaaataatttctaaagagttataaaaaatcacggttatttctagcacctaaatgtttcggtctctaaaagtgataacaacacctacaactaatagtcaatatgcaagacaatacggtaacatccctccataatataaagattgatgaaccctgagttccactcgtcactcaaggctgttgttggcccgatctttcggtgagttgagataactacgatttgtggaaaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaactctaaaggctacctagctatttaaggaggtgggaggacctctaggtcgtcctccacctggttggggcgcaccccacatgggccccacttgggccggggtcccaaacgaagttacaagtccattggcccatgacaggtgacgcagcaccttgtttttgtatttgcggccaaacgagatggagtctgctgatgaggccagatctgttggaaagaggactccgagaactttccatcaagtactcatgggccgaaaacggaggtcgtatgcagattcggtagccgtttgaagtcagcagtgtagcaggtggccgaatcggattccagcacttggaggacttgatcttgatatcatcttgttcatccatgatgtgagttatggttgtatctatagtagccatggtcacatcaaagacccatatgatatccaaggataagaataaaaccatgagggataatcatacatacctgagaattggttccatgacataggtatcggtggcataagtgaagaatatgaataatgtggtggcgaaagaacctgacgattggatacaaaccattgatttggtgcatgcctctgaactcccttctcctcttttgcctccacttctcttttaacatctttttcattatgcacctgaacacttcctttaggaacccatgccatacctctatccctcagcttttctgcacttagtttgtgtaactgcttcttctgccaatttgataagatacatgagtgtctcggttggctaccattgcccacgaagctcttcggcggattctgatttattactaactctgccgaagaagactctcacttcatacttacattgtgtaaattttctagttgttgtacacgtgcatgccccccaggttcaataacctttttctgaactgaagccttttttacactcacacgtgctaatcgcagcaacgctctcggcgacggcggctaggataccgataaacagatcgggaaagaaagacaaaaattatggatagatcaatttcggccagatcaggaccgaaactctcttccccagtggagtcgccaaaatatgttgacgctttttcatggccaacacacgatcacctaacgatttgcggtgtaatcaatggagtcgccaaaatcgatagatcaaaatcggctagtgaaaccgatttcgagattaattcactttcgcggaatcaagcgactaatttacaagcaaattagcaaagaggataaatatcgtacttacgtgacgacgaacgactagtttccgagcaaactagcaaaggataacctcctcgctttcgtggagaagcacgaccgtttttcagcgcaaaacggcaaagattaactaaattctagggttgctaggactcagccatgaaaataaaattgaaaagaacaaaaaaaagtaaaagagatgaatagtgatcgaaattgttcgggctttttttctgccgacgcatggactgactttataagcaccacaggccgcatcaacgatctcctttttctgctatccttccttccttccttcctatccggattctggactggtatactgcatgcaatcaatcaatgatcttctataatccacgacaccttgtggcctgctgtagcctattcctccacaaaggatccggatgcctccctgcatgtaagctgcacactgaccctatgtggactaatacttgcgacacacctctgattacatgtcaccaaaccaggttaattgctgcagccacacccaacagtttgcacacacgatctcttagtgcatcgcaaattcacgcacctgtaaactgagtatattttccaagtaaatcatttgacagttttatcattttattctaaaacaatttggcctgcacaaatgtactaactataagccaaattatggtgcaaacagaaccatttggtacagaaactagtgagtgtggcaaaaatgttgctacggtagtgatcataacggtggtgcgactaaattataacagtgttgattgatagcaatagtacaacggtaaattctatatatagaaacaaatgataatgtttgtatatccaactctattatatacaaaatagaattgcatatatagtaatacgagttaaaagtgagtgtgtaacaaatcctatttgaccagctcgcgcaaatgggctagaccgccagagtaccctttatcttatactagtctcttctgattttatctgggtgactaattaggacgaagaggaggcactaatcagaggaccaaaatgtggcacccaagcattttttatcaaatgtggttagtgtttggcaacacaggcaagacaagaggaggaagagatcatgggggctgataaactgaaaaagagggatttaactcttgggatgtagaaagctgagaaaaggcttgagtcctgacatagtggtcacctttcttttgggggagagaaattaggatcaactcttacctttccagcattcctttgtactatatgggtttattttatttgccagggtattttcataagaaaatgaatagtccgagggggaggttttactggcaaggcactgccaagaaacagaagtaccacttcatcaaatggcaagctttgtgcaggccaaaagattttggggggctgggttttatggataaatggatactgaaattggagtcaaataattcagagatgtgtatccaggtcctcaggaagaaatatatggggcaaaaaagttttttccagagtactgcaactagggggtcccagttctggaagggtttacatgaatgcaaaatgtggtttggaaatttgattaaaaaaaagtgggggatggcctgaccaccagcttctggaatgatgtgtgggttgataaatgtcctctaaagatcctgttccctgacttgtatgctgtggactctcaacaaaatgctacattcagagatatttatcaggaaggggcttgggagttgagtttcagaaggaatctcaatgaagaggggagagctcagttaattgagctgctctctaaaaatccaggatgtggtcctgaatggggggggggggggcactataaagtggtgtggcctcatactaagaagaagcagtttacctctcgattaatgtatagactcttgacttttggaggggtagtggattcagacatgcaggggatcaggaggagtaaagttcctttgaagataaaacattttgtttatcatgtgggcaggggaggattccttgtgcctttcagctggttaagaggaactggaagggaggagagaataaatgcagtgctgtgtggggtttctgaaactgttaatcatgtcttgttcaattgccctattgcaaaatttacttggtgtgtggtcaaggaagttttgcacttccctgcaatccctgtctctttctgggaaggcttagatttgttaaaacagaagttaggggggaagcttggtgtggtggtgtttgctagttggatttgggtatttggctaactaggaatgactgatttttgagaataaattgcttaagtctcctttgcaggtagtttacatgataatttcgctgttacaacgctggaggctcattcaaaagaagaaaagaagaggttcgtttggagcagctgattgaagacctgatgaccaaactgcaacaactccgtccttcagggaggctgccaaatgatttagatgttggttaggagtagtttttatatgctgatcttgggggcgtttgtgttttctggaacagggtgtgggtgccctatgcctggttgctggaatttttccagtaacaacgatgctgtaaaatcaaaggtgttttttattattattctgtgatgaacaattggcatcggagattatcggttttgatgtttgaaatttattcacgtagtggttttggagatgattggatttacaggtgaattacaagtgctgttattttatgttaccggtcagaccgggcagtggttgccggtcagaccggcgtgtatcgcgcggtcagaccggcgcagcccgcggtctgaccggccgactctgtgtcgatttcggtttcgggttgtttgtttggatatccgtgattgtttcatgcttatggcttctagatgaatactatgcgtatgtaatactgttgtttgctaacaataagtcaagttggagatagcttggtctcggaatatggtttctttgtttattttatgtgtaggtgaatcgatgcctcgggagagtatttacagtgatggaccgggagttggcttggggataagacgacgtccgtgatggtcagagatcatgcgggatactaaggctaaagttcaatacacgtggttggtgaagattccatatggcatacaatggaggtattgtgtgcgtatgggatgcggagttgaatttggaaggagtccaaatttggtatgagtggttatgtaaagtttgtttcttgtactaaagggtttcctaaggtgtttaggacttctagtatgagtttggttcgtggctttaggctgcctacctcagggtataaatagagggggagcgtgaggcttcctgagattttttagagcaattgagctgatagttgagtcaaggtttcgagtttccttgagatttttgtaaggaatgctgttggtgcactttgtaaacatagggagaatcaataaagtcgtcatccactttaggagttcttcgatttgtttttcaccgggtttcgacggtctaactggcgacacaccggcggcatcgtggcggttagaccggcgggtgcaaggcggtcagaccggcggcggcaacaggggcgacaggcgattccagggcggtccgaccgagagacaaggcataggcacagtcagaccggcagatcaatcttggtcagactgatctccgtcgaatttgagggtaacttttatttccgctaaaagttttggtttttgggtataccaattattcaccccttctggttggcttagttgttgtgtttcgatcctacaagtggtatcagagacttgttttcttctttggattttaaccgatctagagttcttgccatggctgttagattttcaactaagcctcacgttttcgatggaacggattttctcatgtttttgatggaacggatttttctcattggtgtagtaggatgcaatcttacattatggctgaagattatgatatttggagaaaagtttctcatccttatgtaattcctgaagaaattaatactgctgctttaaaaactgagtttgaacaaaattgcaaagcacgcaatattcttttgagtgggatttctcgttcggattatgatcgtgttgctcatcttcaaactgcccatgagatttggattgctttgagtaattttcatcaaggaacaaataacattaaagaacttcgtcgagatcttttaaaaaaggagtacattaaatttgagatgaaacttggaaagctttggatgactatctttctaggtttaacaaaattttgagtgatcttagatttgttgattcttcttatgatgctaattatccacaatttgagatttctcgccactttttgaatggtcttgatatgtctatttgggagatgaaagttacatctgttcaagagtccgttaatatgtctactttgactttagattcgctttacacaaaactgaaaacacatgagatgaacattctttctcgtagagttgattctaagtcgagtgctttggtttcttcttcttcttctttggatgttgatgcttcttcatcaaagtcttctattcttgctttatttaatgccacatccgatgatcaactcgaacagttcaaggaggaggatttggctttggttgctaacagaattgctcgagctatgaacaatgtcaggttcaggaagagaggtggtccaaatcattgctttgaatgtggtttgattgatcatcttcgttcgcattgtcctaagcttgggagaggcaaaagggaagacaatgatagagagaagaacaatgacaacaagccgaagggtacattcaaaggaaggaagatcaaggagaatctcaagaaggcttttgatcaagtctacgccgcgtttgagccactaagcgacgtagatggtgatagtggagatgaagataagggaaagaacatctccgttgtttgcttcatggcacgtggtgaatcatattcagagtgtgaagacaatgaggtaagtgctcttgaggaagctattaatattttgagtgcaaaaaataagaagtgtgagaagatgtatagaaaataggagtttatcattgaatctcttaattctgaaattgctagattaaaatctcttattcctaatgatgatgattgcaaaatttgtgaggttttaatgaatgagatttcaaaaattagagatgtcaatgttgcacatgatttgaaaaataaatcctctcttgctcttagttttgctttgcacacacgcactttggatgagttgtttttaactaaaaagttgttgcaaaaatatcaaattgtttttcatgctagtttgatgtttaacatgatttgtgctaagaagttaaaacaaccacatgatgttttagattgctcaacatgtactttgtataagaagaaactaaaagttgctttaggtcgtgttgagtacatggaagatgttgtgaaaaacaatgaagtgctttcttgctctaagtgtcgtaaaaacaaaggtgttatggtagattgtgaaaattgtgctaatttggaaaaagaggttttgtatttgaaaaattctttgcaaagattttctgagggtaaaaagaacctcaacatgattttagattaatctaaagttagcacacataaccgtggtttaggttttaatccttatgctcatcatactagacatcctcctgttgtgttaggtgttggtgctagaggtggtgagattttggttaaacctgatactaataaaactgtatttaaatctgtgggtatcatgtctacattgagtgcatcttctttaaaatccaatgttatgcatgcaaaacctcctgttgttgcttgtgttgctaagtcttctgattctactaatgtgtctaataatcgtgaaaaatatgcttgttctttttgtggcaaatatggatatattgatggtttttgtttcagattagctcataaacagaaaaaggagagagaggttgcttttgcaaaatcaaagtggcaaaaatctaggtttccttcgaggaaatcggttagaccgcagtggttcccgcggtcagaccggcgaccggtcagaccggctgcagagcctcggtcagaccggacaccagtcagactggcagtgaagcggcggtcagaccggcccccggtcagaccagctgcaaaccctcggtcagaccggcctcggagaaatttttctgaaaattctcaaactgtaattgcacatggatatatgcctattggatcttctggtcgtgtgtctcagtactggattcctaaatttttgttatcatctaaccccagtactgaggcttcgacttctgcttgtgtgtaggctttgatggcgcggaaggagaacatgtggatcgtggatttcggttgttcgcggcacatgaccggtaataaaaattggttctcctccctaacaaaggcatccaagactgaatcgattatctttggtgatgtttttacaagtgtcgttctcgctacaggtttggttaaggtaaatgagaaatttgaattgaagaatgtagctttggttgaggacttaaagtacaatttgctttcagtttcacaaattgttgatgaagattttgaggttcactttaagaaaactggaagtaaagttttcgattcttgtggtgattctgtgttgaatatttctcgctatggaagagtgtttaaagctgattttgataattctgtttcacctgtgataacatgtttggttgctaaatttgataaaaatgtgatgttttggcatcgtagacttggacatgttggttttgatcatctcactaggttaagtggtttggatcttgctcgtggtttgcctaaacttaagaaagattttgattcggtttgttcactgtgtcgtcatgctaagatggttgcttcttcacatgctcctattgttttttgtgatgacggatgcaccgggacagctattacacatagacacggttggtccagctagagtgcaatctattggaggaaagtggtatgtgttggttattgttgataatttttctcgatattcttgggttttctttatggcaactaaggacgaagcgtttcaacactttcgtggtttgtttcttcgattggatcttgaatttcctggttctttgaaaagaattcgaagtgataatggtggtgagcttaaaattgcttcttttgaacaattttgcaacaaaagaggtcttgaacatgaattttcttctcctcgtgttccgcaacaaaatggtgttgttgaaaggaaaattcgtgttttggttgagatggctagaacgatgttgggtgagtataaaactcctagaaaattttgggctgaggcgataaacactacatgttatatttcaaatcgggttttcttgagatcaaaacttggaaaaacttctgatgaactttgatttggacgtcaacccaaagtttcacatttgcgtgtttttagttgtaaatgctttgtcttgaaatctggaaatttggataagtttgcagcacgttctaccgatgcattgtttcttggttacgccgcacattctcatggctatcgtgtacttattttggagactaacaaaatcgtttagacttgcgaagttttttttgatgaggctagtccaggtactagacccgatattgcaggtacattgtcacaggttcagggggaggatggtcgtatttttgaagacgagagcgacgacgacaacgacgaggtcggctcggccgatcagaccaggcgccaggccggttagaccgccggcaagccgccggtcagaccgacacaggaggtacggtcagatcgacctgagtcgtcgggttccggtactgttgatgctgatcgagatggtcctccggagattacaacttcgactagtactgatacaggacgtgaatcaacttcagaagtcactgctcctttgcacattcaatgacgacatccgccggaacaaattattggtaatttaggtgagcggactacaaggtctaaggtaacgactcatgatgtttatgcaaattctgcatttgttgcttcttttgaacccaaagatgtgtcacatgcattaactgatgaatcgtggattaacgtcatgcatgaagaacttgaaaatt

SEQ ID NO: 80362 - DNA, 590 bp, Oryza sativa
atttatcttaaatctgtagttccgtgataaaattagtgttaaatctgtagttttgtaatacatcatgttaaatctgtagttttctgataatttgaccaaaatacctgtagtttcgtgaaatttactcttatttatttttttttgaaacgttttaattttcattaggcttggagccttggacccactgggtattttttttaaaaaaaaaactgacacactgggttaagtgggcacgcgtaggtgtacgagagcgcaagcatgtggagcatagcatatgccatgtgtaggccttgcttgggcacattcaatgacgatgtgctcacactgaccatacatgtgtatcttcatgctcaatattattcgtacatggcaagccatcatggttaaattatgactacggttattatgggcatgtttggttcattgcccaaatgaaccaggtaaaaaaggaataagttcattttacatccctaagctttttgtttatctaaatacacctcctagctacaaaatctattaacttattaaagaaatagaaaaatgagcctccacgttcgctctcacggcctaaaattcccatattaatcgaa

SEQ ID NO: 80363 - DNA, 1900 bp, Oryza sativa
cacacaaggattttatcacggctgttcaagaacagccgatgggattcttcaacgaagaagtcctaatcccgacggtgaattctactacgacgaatcgacaattcataacgtcggtccttcctcttctgacatagcgccggcgtcgaagtcgtagctatatatagctaccgagcaaaagaattgtactatatacgcatgtatatatatttatatatgtacacatttacttttgtgttaatatatattttggtaacatatatatatgcacataaaatgttaagtgctttaaattatacatatgtgtatgtaatatatgatttacacacacacacacacatatatatatatatatatatgtatatatatatatatatatgtatatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtagtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgattatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatgg

SEQ ID NO: 80364 - DNA, 14600 bp, Oryza sativa
atatctacccgggccaccggctagcctccaatcctgtcgccggccagccaccattccaccgcctcccctccggccggatctggcggaggggagggcgaggccgccgccccgcgcccagccgctgccggccggcctcccatcccgccgccccgcgtcgggccaccaccggctggcctccatcccgccgccccgcgcccagccgccgccggccggcctcccatcccgccgccccgcgtcgggccgccaccggcctcccatcacgccgcccgccagaggggaggagaggaggggagggggccataggagaggggaggaggagatggggtgagagaagaaggaaggggatggacagagagcaggacttagcatgcgcacaagggggctcgaggctttttttcccggttgtttaacaaccgggactaaaaatagatctttactccggttggtgttaccaaccgggactaaagataatagaggggtctgacaccgcatcccatttattgaaccgggactaatactccctccgggctaaaaatacttgccgttttagacaaggctaaggtcaaactttagaatctttgattataaatcatttttaaaatatttctctttcaaatatgatgactacatgtatagattagtcttaaaaagtagtttaataaaatcatatatttgttaacacttttatacatattataattgaaaataatggtcaaggttgtttttgaagaccgtgcccttgtcaaaaacgataaaaacgacaagtattatcaacccggagggataatgatttttagtcccaccaaccgggactaaagatcaaaaaatactcattggcttttgaaccgggaaaaaaatgatttttagtcacggttttttgagcaatgggactaatgtggtttttgaccaaccacaaaaaatggtttctccaatagtggaaaaaaggaattgatgcggtaaaaaaatagtaaaaatttattgatcttgtttaacatgccaatagcatgttaggccttgtttagtttctaaaacaaaaaattttcaccaatcacatcgaatgtttgaacacattcatgaagtattaaatgtggataaaaaaataattacacagtttgcgtgtaaattgcgagacaaatctttaagcctaattgtgtcatgatttaataatgtggtgctacagtaaacatttgctaatgacggattaattaggcttaataaattcatctcacaattttctggcggaatatgtaatttgttttattattagactatgtttaatacttcaaacatgtgtccgtatatccgatgtgacatccaaaacaatttttttaactaaaccgggctactgtattcctagctactaatttactttagatgatgtggcacacgtatatcgctagcggccgacgatactaaacctgctcttagccgaaagtcctaaggggcgatcgatcggtcaccctccccacattgatcaccacctcctccacgtggtttccttttttgacatcaccttatttttctattttagtaaatttatacacctaaaatttgtacacctcaagtttacacatctaaagtttatacacctaaagtttggagacccaaagtttagaagtcaaaagtttataaatccgattcaaatttgaatgacttcaaatatttttatatatagtatttctatacgtctaaagtttatacacctatagattatagtttatagaccgaaagtttataagtcaaaagtttacatacccgattcaaatttgaatttaaatttaaatattttttatatatagtatttctatacatcaaaagtttatacacctaaagtttatagacctaatatttataagttaaaagtttacatacccgattcaaatttgaatttgaatttaaatattttttatatatagtatttctatacataattttttccaactttgtttttttatttttttaaaaaatttatggtgtagtaggaagagaagaaggggaggaggaagggggagagagcgtatattggggatggggatcgaatcacccattagccacacccgctcttagctggtcagatacgtacgtatttttgtatcagcccagttaacaaacaccggtggagaagtgatttttactcccgtggagaagtgatttttactcccggttcgtaaccctcttagtcccagttttctatctttagtctcgggtgaaataaccgggagtaaaaattaatttttagttccggttggtgttaccaactgagactaaagatagagcctttttagtcccggttggtactaaagaatgagccaaactagatctggttgctcctttattcttttcttttcttcatttcattatttttaatatattgatttcactccatcccgcccccaaaatcccaaatcaatcatccccgaattgtaaaatctcaaatcgattatcacctctaaatcctcaaatcctcaaatcgatcatctccaaatacatcacaaaatcttaaaaaaattacatcacaacttctacaaaattcatcacaaatacaatacataaatcaaatacatctcaatccaaatcacaaatcctaaaaaaaaaagaaaaaacctaaatcggcacctaagcccaccgccgcccatcgccgcgcccccacgaggccgcccggcctaccgcgaggcggcccggagcatcgcccgccgtcgcgtcgccgcgaggcctctagctgctgccacgccagccgcccggctctccgcgcccggccgccgcgcgccgccactgcaggtggggaggaagggggagggagaggaggagaggaagagaggagttgaaggagagggagaggaggagagaaagagataaggtgtgagccagcggaggagatagaaccgagagggaggagtgtcgatccgatccgcgcgcatgcctctccatgtatgttgatcttttttgccggttggtaacgccaaccgagactacaaatatatctttaggtagtctcggttggtgttaccaaccaggaaaaaaagagaataaaatttggaaatatactgttcattcattttatttttagaaatattcaggattcaaaaattttaaaaaaaaatataccatcgatttcgtacaaccttgcgcgaaagtgacgtggcgtgacgtcgcgagtgaacaacgcgaaaccgcgcggaccgttcggtctcgccgaaccaatctgcgataccggatttcaaaatgattaattagtgactaattatcatgattagcaattaattaattaattaattattaatctctaattagtattagttaaatagttaattacgtcattagtgactaaccaaagggagcattggtacggtatcgcactctttttcagcgataccgcttggtctcgctcgttcttcccgcgagagcgcgcggtctcgcgccagaccgtgctatggcgcgagagaccgggcggtctcgcattttcattgtgcgagactgtctttaacgtcacctcctcgtcattttcgcttaatggtggtgcgagatcgacggtatatttttgaaaaaaattacatatgtgcactatatttttaaatttaattcggaaaaaagatcgatataacataagctttactcccggttagtgttaccaaccaggactaaagataaaaaagtactcctgagcttttaagctgggattaaagatatttttagccctggtttttaatacaaccgggactactgtgaaatctggtcgaccgaccaaagatgggtttctccagtaatgaaaggttgacaacatggagacttggtgtcttgacactgcaaccatactgtacccaaaatcacacaagttaagattcaagaactatatatttgtgcagttacatagcatcggaacaaatttacaggtaatatatgtatggaattcataaaatataagtatagcaacagcacatgaaatctgatacatccctgaggactgagatgcatggggttcgacagccttcagtcattagtgtcagtgatatgctccagaagcaatcatagagatgattacattacatactatgtttacatatttatccgactttgttccttaaaatagataactcattattggttaataaatgtgtgattctttcatgagactctttatgttgtttgttactatttctaaaggatccctgatcaaatatcatatgtggaacaaatatgtttaaatgatcagcacatgtattaattgatgatcatgtcttatggatcatgatatagagataccaaattaataatgtggacacttgttggggaatatgttattggaaagacccaacatgagacactgtaagagccatatgtgttgtgtcatcagtgatctcatttagtgttggtgttgaatccttagacctgagattatcatggttcccaacatgtgtagtagattacttaaggactgctaaacgctactccgtaattaggtagttataaaagtagttttcgggtatgctgtgaaacatgtagtgggatatgaataatcaagatgggatttgcccctcctatagagagatatctatgggctcctcaatgttgtagattatggaagtgcatggccatgccaaaggtggttgaggagtcaatcacaagttatataatctatcacaggttcgattgaatgattgagctattagaggatggcacatatctagccttgagcttaatcgatatcatgaggcaaaggggttcatacaagtatacactagagattcagccgatgtgatctttatgtatgcccggtgggtcaatacgttctgctaggggccactgttgacacgtggaccgaaaaggagtttttgggttacagccgagtgtacatgaacctacagggtcgtacgcttaatgggctggaataaggggattggatggagatccaatatgagcttaattcggatagggatccgaataggagtcctatggacctttggaggcccgagtgatgtatcctatatattcgtgaggggtgtgaccggcggattgattgcatcacgtgagaaaccctagccgccactcccctccccgagcaaaaccctagccgcacgcgggtgcgagcacatctgcgcgtagcgttccgtccttgtacgtgtggatagcagtagaggtgccgctggtttgcggtgctgatcagcgtgggagtacagcaaggagaacgcacgtggaggagaaggtcgagccggtgcgatcgactacttcctacgcgtaggggtggaaacgagccaggccctggctcggctcgacttgcagtggctcgtgacaagctaggcttggcttggctcgactcagttaggaaaacaagctaaaacttgagctcggctcggctcgtttcctggctcgtgtagttattaaaaaaagcatgaacaaatcatcaacatgcaaaatttaaataagtttatatattaaattcttcaaactcttaatgataaatttcaagttgagaaataataacaccatgaaaagtaaaataatctttataaatgcataatggcctaggctcgtgagccaaaacaagcagctcgcgagctagctcggctcggctcatttcagtaacgagctgaaaaggtggcttgggcttggctcgttaggcttacaagccgagccaagccaaccaaactcgagccaagcccgagctgagctcacgagcccgagattttttttccacccctatcgacgcgtgctacttcgcgggagttccttcgatttcttagcgccttcttccgatgcgcagcgcgtcaagtggtaacgatctatgatctaatttttgtatggttaatggcttacgcgatagaaaattttcatttacgctatcgtagcctacgcgtatcccatcaatttggtgacagtttatcccaaagattaccagaatgtacatggaagcgtcagaagaacgttcacctcaaagatttgccagagcgtacaggtatcttgtttgagcctccatcgcgtccttgcaaccttgcctgacgaagacgaatggcttgaagtactatattgatttctgatgctaggggactagaagctccaattgtttgcacattcgaggtgttggtgttttgccaacctgatacctaccattccccatcagttcttgtcctataccaatcttctcttgaacacatgtcttccattttctcatctaattaacaggtacacacttagaggacaaagaaaaagagaagaatgcgacaactattttctagttatctttgcatatgttctatttatagctagatagctagtgttgaatttataagcacataatgatttaatttattctatataaatcataacattgcagatataatttagcatgaagaacgcatcattaaatctacatatgtaaactaagcagtaaaacatgaatagatctaatatgcgcaacatgttgataacgtaccgagggtaccggaagaccggttgctcagcaggaattactcgcggttgcggacgtcgacaacggcgcgcagtacgcgagcgaacaggaagacgagccattgtggtcgaacagggagcagtcgtgcgaagcgcttcccaaaaaccttattgctgccttctcccggtgcgggacgtcgaaggcagaggttccaaagacctgctctcccgatcaccatgcacgccgacgagcggaatggagtagactacgagtgacagtgcagtacataggaggagacaaacccttaattttaaggaattgaaaattagtttttttaagagtagagtgggtgaattgaaaattagtttttttaaagagtagagtgggtgaatctggccaattctagcttcaatgaaaatccttaaaattgaccattagaaccaaatccaatgaaaaatagttttcagtcaggtgtttgtgagaaaagaggggtgaggaattgaaggaaaaagtatgaattaccctcgaactattgcggtcgtccgaattaccctcccttaacccaaaaaccatcattcgttcaccccgaacttttaataccggacgaaataccccttctcgacccaatgcaaaagcggttttgtcctacgtgatgtacgcatggcaatccagtcagtattttattataaaaaagtgctggggtccacctgtcatacatcctctttcctctccctcttctcctctctctctctcatccacaagcagagacgacgggtatgggcggcggctggaggaggcacggcacgcggaggaggcggtgctggcgatggccgagatggagaagaccaagtgtcgcgcggccatggaggcggccgaggcggcgcaccggctggccgacctggaggcgtagcggcggcgcaacgccgagaggccgacgagaaggtccgcgccctggagcgtgtagtccgattgcctgcgcttgaacacaaggcagacggcggaggcgaaggctgcgagcgcgaggaggaaccaggagcagacgcagacgcaggagcagcgggcgtggcgggtgtagacgtgtagtgctggaagaggcgcgcgttctccggcggcgggatgcggaacaccttgtccttgggcatctgcaccacgtacgtgtctagctacgccggcggcagctgctggtactgccgcgcgtcggcgggcggctgcaaaatcactgatgatgcaagccatcgactgcaaattaaggccatgcatatatacaagtgtgcaagttagctctcgacaaaatcctttacccaacattccaaaacacgagctttgatcaagagaaaccaatctgctacatatgcagcacataaccacattcccaaagtccaaaacgcggcgccaaatcagatcagaaaattcagaagagggcagagacaaaaaaaaaaaagaacaaaaattccggcacgccgtcgcccatcgatcccgtggagccagcggttcaggatctcggcggagatcaccacggcgctgctgttcctccaccagaccaagccggagccgctcgtgcactgcgacctggacctcaagccggccaacatccttctcgaccgcaacatcctgctgcaggtgctgacgagtccgccgccgacggactcgtcagccacactcgtctactccggtgacgagtctgccgcccatccccatcatccccgcctctccgccgccacccacctgtccgcgccgaccggccccacccaccgtcggccgcaccgccatgcgcgccgtccgctgccttccccgcactgccgtgcgccatgccatgctgcgccgcctcggccgcctccatggccatgcggcacttggtcttctccatctcggccatcgccagcactgcctcctccgcgtgccgcgcctcctccagccgccgcccatcctcgtcgtccccgctatagatggccaaaaggcccgcccgacacggcccggcccaggcacggcccaccagccatcgggccagcacagcccgatcggcacttcgtgccgggccgtgccggctcatgggctgtgcctcccgcccaggcatggcccaccagccgtcgggccgtgccgggccggccgaaggcacgggtggcccatcgtgccttttttaaataagtctattttctatccctcctctttgggatgtgacatatatatatatatatatatatatatatatatatatagcgaaaacaagtctaatttcggtccctccactttgggctgtgacatatattagtgaaaataagtctattttccatccctcctctttgggctgacatatatgtaggtaaaataagtctatttaacgtccctattctttcgaccgtggcatataatatgtctatttttactccctattgtttatgtgtcgggcctggcctgcggcccatcgtgccatgccgggccggcccaatgtgtcggcggagaggcccaggcacggctcggtggtcgggccgggccggcacgggcccgacccttaacgggccgtgccgttcttgggccgggccaaaacgccgtgccgtgggccaggccatcagacctcggcccttttggccatctatagtccccgcttgtggacgagagagagaagagaagaggaagagggaagatgacatgtggaccccaccatttttttaataagaaaatgctgactggattgtcacgcgtacgccacgtaggacaaaaccactctggattggatcgagggggataatttgtccggtattgaaagttgagggtgaacgacgtctggttttcgggtttagggggtaattcgaacgaccgcgatagttcgagaaggtaatttgtaatttttccggaattgaaaaggctagtggttaccacttggcaaattctccatctttcttctgagttcctcttcttgatattcatcctgcagagtaaatggaagggtattctgtatatgtgtttatcattgcttcaactgaaaaacaagcccgggttgcctccttgttcatgctttatcttttttttcctgttttcaagtttgtttggattggactctaatttttaggaaaatatccactaaacttataaattgcaaatataatttctgtataaagtttatatatataaagtctagaaagattttaaaaagtttatatatactttttatattaaaaagtctagggtacacaaaagtctatatgtagaaaatttggatggaaatagttcatataaaaaagttttcgttaaaaaagagtaataaaaaaaggaaacaaaaaatttgagtggaagaaaaagaaaaaacgattcttatgaccatgatgaattactccctccggtttgataatacttgtcgttttacataagggtacggtcttttaaaaaacaacttttaccattattttttattatattatgtataaaagtgttaacaaatatatgattttattaaagtactttttaagactaatctattcatatagtcaccattttaaaagacaaatattttagaaatgatttataatcaaagattttaaagtttgacctcacatttatgtaaaacgacaagttataagtccggagagagtacgagagaataaggtacgtaaaagaggaaaaagaaatgaagacatacataagaatggagaaagaaaattgaaaacagcccatgcggtctccaaccttgaccagttcgcgataggctagcaaggcacagttgctgcgaattttttttatttttaattttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggccccctttgccgccctccgctagcccgcccccggggcggcaggggggccgcctgcaaatgggcggcggggggcctggaattttgcaggcggcccccttgccgccctgggggagggcgattttatactgtgctttatattttttataaatatcaatagttatcaaatttttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcaaaatcaaacacaagtactattcaaattaccaaaatattggtagggcatgtttttggtagaaatccaaataggcccttagtcttacgcatacaaaaaatcaccatcataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgttgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagaggtggcgaacgcgcccgaagaggtggcgaacgcccctgcggagctcgcggaagcgccggtcgtgcctgcgaacacgctcgaaggcagacgaggtcctgcgatgaggaaacgtgcagttaaaacatggtgacatattcgtgcaaaagctgaaacaaaaatgaactaatctctgggctgaactgtaccgtgtgaaaccggtgctgtaggtcgcactgctccgaagctaggggcgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcatccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcacctgctagctgtccccgtcgagtcaacctgtgaagagaggtaaattatatggctcgatgaagtaagtatcataaaaatttagaaatgaacaatccgaactcacgagtggtcggcagggaggacggtcggctgcacgatgcccggaaacacctacctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagataacgtcgctcggctggagacggtcaaactcgaacacgaagtccgggtaacctcgtctcacctgtacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgtccaaccccgtagggtgcgctctccaccactggtcgacctatggcaaacctctcggctgcccaaagctgaagcaacatagggcagccagcgatgatcgctcccgcgtcagtcttcgtgcacgcctcaccgagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcatcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacaggaggaagggtgttggccggtcctaggtgtggaaggtgcatcacctgctcgaagcgcgcagtgatatcctccttccacccaacaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtgtagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaatgagctgtggttcctgtcaatcccacggttcaacagcgccggtgtgtcgtacgccatacagcatcaaatagattggtcagaaacatataaataattagtcaacataaataataaatgttcataagcgaattactaa

SEQ ID NO: 80365 - DNA, 8776 bp, Oryza sativa
  unsure (1)..(8776): unsure at all n locations
atatttctttcttaatagtacaaaactatatcttatatagtctctctagttatataattcttatcggtttgaacaagaataaaaataaatttttataaatttgactatcaataacaatgaccatgatgattttggagccaaacctacaaagctacattggatgttatgttatccatgagagatgcttttgccacatgatcaacctggtggtccaagcatgtattattgtcattgagaatttattgatttttaaggtgtcgaaacatgaattcggcaataataaaacggggtagcgcacgagacctaaaagtggatggatgtggagacaaaagatttagacaggttcaggccctctcgatgagaggtaataccctactcctgtttggggatttgaatccgccgggtgtattatagatctgacgatctagttgtctcatgccccctagagggcttcctgcccaccttatataggatggggggcaggattacaagatagaaaccttaaccaatacggtatcggtttcctaaatctactttacaatcttatcaaaccaggactttaggccgttccataatatatagggaaacgtaatacccaagtcacgatctgttacatattccatacatatatgttatcccctattactagtcggataaccatgccgtgtggatatggggtacccataatctccacagtagcccctgagacccttcacagtcgaaaatataatcttctctcgaactagattactccaaagccgagtgcttcaatcatcttcgccatggtctcccgagtacttttaccaaatctgaggactgtggagggctgaaaaataaagtcaggtgcatcgaatagatgcacctaataggtgtagcccctgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcataatatgatgcgtacaacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccacacctgaaaatatatggcacatgtggtataacatccgagtaagtaaactcataaaggatttaccaaccgcctaaaaaatgaccataatatataatcagcctaagccataatattggtcaataaaaatgcacacttacatggcaaaaagcaatgatattatatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataggtgtaacaattgaatcccgactggcgcaagtattcagttgataacccttacggggaataataaatagtccagtctttgagcatagaaaatagacccatgatcacgaattcatagtgcatatatccagagcaagtccaaattgaaggtatgatacttgtgtttgagctagtaaacccctgagcatatagcttgtccttctgtcgtagtcacaattgtccattgatggtagcaatcaaaagtgatgaagttgcatagctgtggagcgaagaaaccagtcggcagcagacaagtcagccaacagtgaagatgaaggcatccagcaacatcgacaaaattgagcagccatggtggcggaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaatgcaaccgtcagtagcaatagagatgatcgactatgatgacgaaattgctcatcaaacagtagtagagtgggctatgttgaagaggcttgacagtatgttgacgaagatgacgatgttggtgatccagccaatagcagtgtagcaaccaatgataatgacaaagacgctcatcagcatttgcatagtaggtcaaccgtgaaggtgaaataataagtcggtgaagacataatcatccattagcaacagcggagatgtcagggccgatgaaggaaaggtgctggtgatgatgtcagtgacaataatccttcaaattaatgttatagctgttgtagatgcttcacttggaggagagttaatgctgttgtccaactcgtctaaaccgaaatatttgatgttgttgaagtagattgtctgctccgaagcaaagatgaagataatgactcctggagttgactcgttggctgattaattgattgctccatctttgacataaagcttgtcgaattttgagccatgtatttgtgtagccccgactctttgtttagttgggaaacaactgaacatagagtcgagaattatagcttcttatcgtcgagtagtcattgcttgattgaagataagtgttgaagatgtccaagtagaaatccatgatgacaaagttgcattgccgtgatgaagtgacagaagcaaactggtagtgaagacgcgcaattgtgacgataaaagcgccagtcggcggcagacgtagacagcttgcgttgaagatgatgacgcatattagcggtgacggcgacgtagccaaccgtgaagaagatagcatcagtcggcgtcataacaggccagctatgcaggcggaaacaccagtcggtggtggacgaggcggccggtcggtgaagacgtagacgcccaacaacggcggcataataggccagccgtgcaggcggaaacaccagtcggcggcagcgaaggcaagccggtcggtgaagacgtagacgcccaacaacggcggcataataggccagccgtgcaggcggaaacaccagtcggcggcgggcgaggcggccggtcggtgaagacgtaaacgcccaacaacagcggcataataggccagccgtgcaggcggaaacaccagtcggcggcgggcgaggcggccggtcggtgaagacgtagacgcccaacaacggcggcataataggccagcgtgcaggtggaaacaccagtcggcggcagacgaggcggccggtcggtgaagacgtagacgcccaacaacggtggtataacaggccagccgtgcacgcagaaacaccagtcggcggcggacgaggcggccggtcggtgaagacgtagacgcccaacaacggcgacataataggccaaccgtgcaggcggaaacaccactcggcggcgacggaggcgggccggcggtgaagtcgtagacgcccaatagcggcggcataataggccagccgtgtaggcggaggcaccagtcggcggcgacggaggcaggccggcggtgaagtcgtagacgcctaacagcggcggcataataggccagccgtgtaggcggaggcaccactcggcggcaacggaggcaagccggcggtgaagtcgtagacgcccaacaacggcggcataataggccagccgtgtaggcggaggcaccactcggcggcgacggaggcaggccggcggtgaagtcgtagatgcccaacagcggcggcataataggccagccgtgtaggcggaggcaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcggcggcataataggccagcgtgcaggtggaaacaccagtcggcggcagacgaggcggccggtcggtgaagacgtagacgcccaacaacggtggtataacaggccagccgtgcacgcggaaacaccagtcggcggcggacgaggcggccggtcggtgaagacgtagacgcccaacaacggcgacataataggtcaaccatgcaggcggaaacaccagtcggcggcgaacgtggcggccagtcggtgaagacgtagacgcccaacaacggtggtgtgaccaaacaaccgtataggcgaagacaccagtcggcgacgatgacggcaagctggtggtgatgttctgactgatccattcctggagcgtaagagataagcttaaagccatgtatcccttttgtgcatatctggatctggatcctgcagaacaaacatataggatgagtagtatctgatataaatataatactcgcgaaaaaatcaagtatctaaaaatatttataaatatgtatttcacctcttgtcaattttgatttccccgagcagatgactctgtacgtttaaacactctgtccgactagtcatagcccccaagcatcgggagtcgacctaggcatttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagcttcgtcgtattccctcgatgacagcagaagtagccgatgtgggaataaagcagtccatcaatggtgacaaaaacaccagtcggcgccagtggaaccaagccagtggtgtagatgatgaagcccattaacagcggcgaagtccgccaaccgtataggcgaaaacaccagtcagtggtggcggaggcaggccggcggtggagtcgtagacgcccaacaacggcggcataataggccagccgtgtaggcggagacaccagtcggcgatggtgaaagcgaagttgcccccaacggcgacataataggccagccgtgtaggcagagactccagtcggtggcggcaaaggcaagccggcgatgaagtcgtagatgcccaacagcggcggcataataggccagccgtgcaggcgaaaacaccagtcggcgacgccgaaggccagccggtcggtgaagatgtggacgcccatgaacggtggtgtgaccaaccaaccgtataggcaaaaacactagtcggcggcgacggaggcaagccggcggtgaagtcgtagacgcccaacaacggcggcataatagaccagtcgtgcaagcgaaaacaccagtcggaggcggcgaaggccagccggtcggtgaagacgtggacgcccatgaacggtggtgtgaccaaccaaccgtataggcgaaggcaccagtcggcggcgacggaggcaggccggnnnnnnnnnnnnnnnnnnnnnnngcaacggcagcggcgcacaccaaccgtggaggtgatgaaaccaatcggcagcgacgaaggcggccggcggtacatgtataaaataatagatcaaataataattagtgatctgtgaattaaatctaatttatataagaaaatttagaacgataaacctggtttgtgatccaattttgattcaaggcctgtcaatggatgaaccgtagcatgcagccgtgtcatgcagccgtgtagacatgtaatcgtcggtagcacatgcatggattagtttggagaccactttgtgcatgtaatagctgatttgtctatggattaatttccttgaccacagatttgaccaggtatatttaatttgtatcctggactttgtgtcttgccgtacgtatccgagtagtattgacttggtgatgtacaggctcaaccgacggtgatcttcgcatgatttcggcggcggctgcttgctgattgcttcaaatcatgccctggtgacgaaaccgacggaccaacagacatggcagcattgtagcgacggatttgatctcactgacagaggtaaaattgacgataacaagctggttgtagatcgattcgatcggtgattaatctcctggttgattgaccagatccagatagaatttttggcgacgaagaccctgcccttttgttgagaagatcacggccaaagacaagagtagcaccgatgacgccggcacaaagttccatcgcacttctcgacggaaaactcgacgcaacccctacctggcgcgccaactgtcgaaacatgaattcggcaataataaaacggggtagcgcacgagacctaaaagtggatggatgtggagacaaaagatttagacaggttcaggccctctcgatgagaggtaataccctactcctatttggggatttgaatccgccgggtgtattatagatctgacgatctagttgtctcatgccccctagagggcttcctgcccaccttatataggatggggggcaggattacaagatagaaaccttaaccaatacggtatcagtttcctaaatctactttacaatcttatcaaaccaggactttaggccgttccataatatatagggaaacgtaatacccaagtcacgatctgttacatattccatacatatatgttatcccctattactagtcggataaccatgccgtgtggatatggggtacccataatctccacataaggcaaatagtttattgattttaatgcatatgtgacatcatcaaccacattgtctaagcaggtatgggcgttattactatcattggaggtcacacactgatcaaggtgaggttataggactattgtagaggacctttgaggatatttggcattaacgtgaaacataactggaacacaacatacctcatgccgcgtcagctgaaagggtatgaggaaataatttatgatttgattgattcattgcacttgataataaattatgccgagatgaggatggtgatggtgatggtgaggttttgcttcttaccgaggaagaatgggacatagctatacgcatgtgtaaatttgtaaagccctttcgtagaacttcagttttgctatttggaatgcactatcctacttcttgttcggtgcatgaatgtctttggaagttatcacttatctttgaagaaaaccaacatgacaaaattttagcttccattgttaaacccatgcatgaaaaattcctcaaatacttcactgctattccaccattattgctttaatttggtacttgatcttcataaaaagttgaaaatcgtggagactactttcatatcattaggtgatgcaattgatctttgattattcaaaagtttatcaacatgctagagatgagttgtttagagttttccatctgtaccaaactaagctagatgttgctcactgggtgactgaggagaccccacaaaaaagaaaagcaaatcaagtgccctcaatttgtggaagaagatcaggggtaggacaaattggaacccggatgttgtcacgtcccaaaatgactctaaaatacatcctctaaattatgcctagaataattaaaaaactgtgtgaaagcctccaacaattaaaatgtacaaggttaaaagtcaaataaggcttagaggatttttgtatatttcctaaaagcctaaaatacgtaaataaattttagtggaattttcagagcacaaataataattgttaagaaataaacaaagttaaaaaggttttataaaaagaaaaaccctaaaatccctccttctctctaatgggccaaattcggcccatctctctccccctctctctcctctccccgcggcccactcggcctctccccgcgcgcgcgccgctgacgggcgggcccgcccgccaccctcgctgacgggtggggcccacccgtcatccccgacctcccgccgctcccgccgcctcccccgcgcctagcgccgccgccgccgccgaatccgtcgcatcccgtcgtccccgcgttcaatcaataggggggaattactccccgtgatcccctctccctttccccccatttttccctctctctctcgcgttcaaacgggcggatttgcccccgcaaatctcgccggcgccattgatggcggccggacctcctgcgccggtttccttcccctccggccgctctctcccccttccaaccctatttaaaccctccccacacctcctccgtccgtttc

SEQ ID NO: 80366 - DNA, 3028 bp, Oryza sativa
attttatattataagatattgcgattatttttaatctaacatcgaataattttgatttttttagaaaaaatgttactatgttattgtaaacttaattttgtatacggaaagaaatcaaaacatcttaaaaaattaaacggagctagtagttaccggttttaaggttttaagggttgtataattcataactaaggtttcgtaggtttgtcatactttttttcgagcttgtcaaaagtgaggcaatcaaaatcctgatcacacttgagccagtaaaataaaagatatatgccacattttataagtcactaacatatatatgggacctatattacagaaacgtaatattgtcatgtttgtggcaacaacgcaaacacgcatgtcaaaatatctaatcacagattgttataaaatacggtaatggccaaccagacagtttcttagtaattagcttcaccgcttattattgttatgaaataaatagatgatcacatctatataaaagatgggatcggtaaccgaaggttgcgcacaacagttgtgtcgtacccctcgccttctcggcgctccttgacaacgggcacgatggttcccaaccatcacgtctatggtggccacccattcctgtataatcgcattgattaataaagtacacaactattctctcgctcccacaatctcaattccctattcaacatattatcagaacttcactcttcgcgagaagaagaagagtagatggagaaaagaaggtatgcgtaccttcgattcctttctcggccttcctcgccgcgatcgtgttcgccgccttcgccatctcctcctattcaacaattttcatataatttgacgtgacttttaataagccttcaatcgtacatggaagctagtgacacgatcgacaaatcaatgccaattaaaagtccacaaatttagcaacttaaataaataagtatttaattaggtctatgtacacataacattagaaaaattggcacgtctaggaaaggtgactgatgaagataatgcattgttcttatcattgacacgtcaccctaatttggttgtcgtaacttcacacaagtacacaagtgatacatgcattagttcattactcccccgtcattttttttaaatttttagcttttagatgtctactccctctatcaaaaaaaccaacttaagagttagatgggacacaatctagattcgttgtactatattggtcacatccaactcctaagttggatttttttttttacgaagggagtatctttttaggttatagcgcctactagatctcttaataccatttcatcttttttttattttagccatcaaactattagtattctcttcttctcctaagtttctctcccttctcattttccctgtgaaaatggatggtgtgtacttcccctgtcttataatacatcaacataatatcagatagaacatatatactagtattatgaatctggataaatttgtagcactagaatgttttctatttgatacaaattgttatatttttaggatgtagatagttttattttaacatcttccttgtaaaaaattacatcacaaattctaaaaaatacatcacagattcccatcacacacaaatcaaatacatcacaggataaatcataaattgtaaaaaaaagaaaaaaaagaaaagccggccggccggccactgccgcctcccctccttccctccgcgccggccggtcgccgcagccgcacgggcccccgtgccgccgcgccggccgccgccgagcggcccttcgcctgccaccgggcgatcccccgcgccgccgcgcaggccgcctccgcgcggccccccgagcctccgcgctggccgcctccgcgcggacccccgcgccgcctcgtcggccgccgtctgcttcgctgtgacgaatggaaggaaaaaaaaaggaaagagaaggtaggagttagagataaggaagagataagaagttggagagggagaaagagatagagggatgagtttgttgtgtggacgggaaaagaggatcggtaatagggattatatagtgtgtttttaattttttttttcccggttagtaacatcaaccggaactaaaaataggtttttagtcccggttggtgttactaacactacaccatgccccaagtttgcttactacatatctgtcaggaaaggccctatatgctgccaaattatttgtcagcaaaacgtttcccgacagataaggtctgtcaggccaagtgctgccggcaaaagtctttcccgacagataaatctgtgccgacagatagaccgatagtgttgctacatatttaccgacagatagttttaccaacagacagacttttaccgacacttaagaagattcccaacagatagcatgtcactgtgttatagatttaccgacaattaatgtattgatggcaagcacaagaactaacaagcaatcagtcagtaatccacacaaaaaatatactaattaccaatcatccattttatgaaccatacctcaaattaaatttgcagcatatatatggatgaatatcactccaaattttgcaacacggattatcacctttcagtaagttacacacatgcataacacaatattcaactattcataactattgttcacaaatgcattctgacatatcatcatgtaactattgttcacccatcaagtagcagtattcctatatagcagttatccatcagctcaaatagctattacataagagttcaagtacatagcaataattacataatttagatgtaactaaggttcttgtaggtgtattgaggtcccaaaaacaaaacaaatcatctcttttatggttcttgtaggttcttgattttttttacagcacctctgctagccctttttatggttgcctgcaaaataatggacagagtaaatgaaatgaataatcatcagtagtgtacagagtaaacatatctagtgtacagagaaccacagaagaatatatatagtccatggcaattagaatagcataacag

SEQ ID NO: 80367 - DNA, 5675 bp, Oryza sativa
ggccgaatgggccgcgaggagaggagagggagggggagggagatgggccgggccggcccaagagggagagggagggaaaggggactttttagagtttttctttttataaaatcattttaactttgtttatttcttaataattattatttatactctgaaaattccactaaaatttatttacgcattttaggcttttaggaaatatacaaaaatcccccaagccttatttgacttttaactttgcaccttttaattgttggaggctttcacacggattttaattattctaggcataatttagaggatgtattttagagtcgttttgggacgtgacaggcattaaaaggacgatgtatcttatgggtcaagctgtacaacctagtgttaattaatctattcgaatagccgcgtccgcggtcatggacatgctcaatgatatctcatgaggggtagtttgtgaaaactggaaatgaactgtgtgcaggttaatgaatatagctatgtggtcctgtgtggacgaatcctgtgtggatggatagttggtaatacccattatttataactattgttttaaacctgtttataaattgattataactgcaaattgctgtgttatacaaaatagccattgcctttgttgtcagctttgcatatgcatatttctgtgtgcttgctgagtattccatgtactcaccttgcaattcccccaattctagaagaaaggttcccgctgtttcctgaggagtttgttgctgaagacgaggaataggtcgtgagtcccagttgactgcctgtggcaagttgaatggagctactacgcatttatcatatttccgctgctactttaatattgtccttaggccctttgtggcagaataattgtaaactttagccataaggcttaacacagtcattattattgttaaatattaggattccttcgtgatgttggctgtgatattatcgttgagtctgtgtgtgctagcttgatcctggactagcacttatacacaagaggtcctattttgggtactcacagttttcgataggtttatttttagcagatttatatattagttaactgcaaaagaatgagctagctaggaagagaagaagagaaagaagggtagtttggtaattcgtccgagggatagatgtatgttttatatatgcagatttttggttagctttaattatcttgttcaaaatatttgaactaactaaagttgtattattttttccgcaattaattaattaatacatagatggcggacagggcatgggtgaataaagagagatatcgggcgtcatacattgaaggagtcgacatattcatgaaagcagctaagaagaatgttgcatctaagaagaccaaagatattagatgtccatgcgtgcattgcaaaaatcagaaaagttggaacgatccatctgtaatcgagcaacacttggtcacacatggatttgttgagggatacacaaactggtcatatcatggagagatcccaagcaagcaagttccgaaccaggctacagtacacgacgaagtgttgagctgggacgaggatgtcattgtagtagctaaagaagaagaagaagaagaagaagaagaagaagaagaagaaaaagtgcatgcagtagaacccgttgatgatgatgatgttgttggtggcaatggtcagcacagtacagttgatgatgccgatgatggtaatgtcagcgtagatgttagtaattttgcatatttgccagagatgttgcgtcatgctgaacctgaggttgttgctgagtccgctcgtgggtaggataactttgatgcattgaaaaaggcagcgaatgatcttttgtacgatgaggcaaagggctgtgagaaggattccacattgttgtggacggtgcttgagcttatgagattgaaggccagaaatggttggtccaatagtagttttaacgacttgttggttctgttgaagaaactttttccgcaacccaactccctgccaacaagcacctatgaagcgaagaagcttatatgccctttgtcactgggtgtgcgaaagatacacgcgtgtgttaaccactgtatcctattccgtaaagagtacgaggatttggacagatgtccaacatgcaagagtagtcgatacaaaacaagccgtagccagtccgagagtttggatgttgcccttgacgatgtagaagagtccgatccatgcaaagacagtaacaaaaagaagattccccagcttgtcatgtggtaccttccggtgaaagatcatttgaagcgtttgttctcaaacccgagggatgccgaattgatgcgctggtatcatgaaaagcgaaaaaaagatgggatgattcgacatcctgcagatgcaagacagtggaaggaatttgacagaaagtatcataagtttgcagaggacccaagaaacgtaaggtttgcattgagcaccaatggaatgaatccattcaatgacttgagcacctcacacagcatgtggccagtactcctaaccatgtacaacctcccaacgtggctgtgttagaaaaggaagtatatcttgttgaccatccttgtacaaggaccacgacaacctagcaatgacatggatgtgtttctagagcctttgctggaggatatgcgcgatttgtgggaacacgggatccgagtttgggacgaattcctgcgggagtacttcacgctacatgcaattatctttgtcaccgtcaacgacttgaccgcactgttttccctattgggacagatcaagggaaagacgggttgcattatttgtgtagatggtactgtgtacaggtatcttaagggatcgaagaagctagtgtacatgcgacaccagcgtttcttaagaaagaatcactcgtaccgctcccaagcaaaatatttcgacggtactgttgagaaaggtgtggcaccagaaccatggaagggtgataaagtgtttagaatgaccaaaaatctgaaggttggttttgggaaggtaaaaaagaaggaaacaaataagcggaagagaaatgatgccgaagtgccagcaagccctagcgttccattcaagaagcactccattttctttaagtaccttccgtactggaaagatttagacatacgccattctatcgatgtcatgcacctagagaaaaatgtcttcgatagcaccattgggactatactggacatactaactaagaccaaggatggactaaaatcacgtaaggacctcgtggatatgcaaataaggaaagagcttcatcctgtggataaaggtaataatggaaaagtgtacctaccgcctgcgtgctacaccttgacaagagaggagaaaatggcattgtgcaaatccctacatcgggtgagagtgcctactggcttctcctcaaacattaaatgactagtgtcgatgaaagatctgtcgctttcaggctacaattcccatgactgtcatgtaatgctcacagtattcctcgccattgcaattagagcagtcgaaccagttcacgtaaagctggtcatcacaaagctctgttatttcttcaattccatatctcagaaagtaattgatcctgaagagttaggtcctctccggactttcgctatacagacagtgtgcgagcttgagatgtgtttccctccatcatttttcgatatgatggttcatatcgtgcctcatagttcatatcatgcctcatagttcgatatttttcttcaacgcctcatagttcatatcgtgccttagataattgcacttgggcccctatacctgcatcagatgtggcctttcgaacgatacatgtccattctaaaaggctacgtacggaaccgcgctcacccagagggatccatgatagagggatacacaaccgaggaggtcgttgagtgttgcattgattacctaaaggatggaaaagcaattggtttaccggtacctcgacatgaaggtagattatctaggaaaggaacaaaagggaagaaaagaatccacgacaatgactacaaaaaagtgaaagatgctcatttcactgtgctgcagcaattcgcaatagtggagccgtacatagagcaacacctgcatgaattacaagcaacaaatgtgggtcgatctaatagatggatcatgaagaaacacaagcatcactttactgaatggttcaagaacctcgatctaccagatggccataccatggaagaaagaacaattaaaatgctagctgacgggccatcaagtgtgtatacctcgtggcaagcatacgatctgaatggatacacattttacacaaaagcgaaagacaaaaggagtgcatgccaaaacagtggcgttcgagtagaagcaatcgacacaactgggcaaaagagcacatactacggattcatagaagaaatctgcgaactagactacgggccaaatatgcagattccactgtttcggtgccaatgggtgaaacacccagccagcgtgtctgtggacaactttaggctgacaatagttgactttgacaacgtaggccacaaggatgacccatgggtgcttgccgatcgggtcgctcaagttttctatgtgacagatccatctcatttgaagaaagacatagttatttcgggaaaacaaaggattttgggagttgatgatgtcgaagatgtcgaggcatacaatcaatatgagaacatgatactattcacagattttcgaaacaagatattacgcgtcgaagaatcaattggtgaatcgccgaagccatacatgagaaatgaaggtgtagggaaaagtgttagatgctaattcattatatatgtatcatgttggacgtatcgatgaattttaatgtactataatgcgtgacaatgatggatgagatgaatttttgtatatggaatatggtgacatgataattgttggatcaagaaatagtttggtataaatttatttgtatgcatgcattaaaaaaatatcaggcgcaaacattaaaaaatcatattttatttttttgataaattaatcatatttgtgtaaaaataaataaaattattttttcagttgagaatgacatgtggggccaaagggttttcgctggcggccggctttgcccaccgctagcgaaaactattttcgctagcagcccacataagcttgccgcaagcgaaaatgttttcgctagcagtcggcgcgttcctccgctagcgaatatgtcttcgcctataagtagctagcgcgcggctgaaaatttcctaagtcccagaggcgcgcgaaccctaaaatttgtgccgccaggctgccaaaatttcgagcgccgcttccagcgataaccacagcgcccgccactgccgccgcctcctccattcacgccatcctccattcggacacagctcctccattcacgcctccaccgcagccgccggctcctcctcttctcggcccgccgccgccgccgctagatccattaacgcctcctctccaccgccgccgctagatccagctcctctccgaccgacggccgccgcatcctcctcctctccgccgcctcctcctcgatcggcccgccgtctccaccaccgccgctgccagatcgagctccacctctcccccggctcctccttcctccacctcgggagttgtcgccaccaccgggactcgtccgccggctcctcttctccgccgccg

SEQ ID NO: 80368 - DNA, 4917 bp, Oryza sativa
ttgcgaggttgggtccattctttgtacagtaacatttccacacgaagctggcataaaaaagtgcattagaaaattattactgcaaacagtttaatacatgcaaaataaaaatcttgaaatataaacacacttctatagtatgtaaggaggctacttaaaaaaatatatttgtttggaacatctaatagatcaatcaattgtaaccttttgtagaaggtgagtatatgacatactcaacaagtcacgcagcaaatatgcaagtgcacaaggataccaaaggatggcatagtagggtttcatttgcataaacaacatttaacaaatatttcagaaattgataaaacaattaagtattaattaaacagtattaatccaacgctacacaacataccctgttgcctaggcccaaccattctgaacaaccatcccggctgcacagttctatctccagaccaggaatataccattccaaaccagaagctaatcaaattattaccagttataacatcttttattatgatgagaggtgtgagactaatcacgaaagacattgttagacccgcccataaccgcgggcacggctattcgcatagttttactctaatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttaattgtcatgagcacgactctcaaaaccacgtgctcacaacccaccattatcaggttttaattggcacattaattaattaaccaatcacgattgaccatcgtgagctatcattaagccatcattaaataatagtgagtcataagttatcccagtaatgtgctaatgtttctaagcatggctaagcaatcatatctaatatatctagttgaaccaatatataaagcccaactagtcaagttataataacccaaggtatcaaggaataaagtagtcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttagaattcttcaaattcttctcctgcgaaaacggactctccggaaacgtcggaatctaagcagaaaagagcaaaatcaccaaaacagcacataaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgcatggcgacggttcacggaaacgaacggccgagatcgatccatccaaaacggacggccgagatcgatcgggtctacagcggctcacggcagacggccccgatgacatcggcgatgacgtcaccaccggcggcggctcgggcggcgcaaactcgccggcgaacaacggcgcttcggcatgaacggaggacaccaggacgtagagggcgacgcggcgaactcaccggtgaccaaaacgtcggcggaagagcaacggacggcgacggcgacgaagaagaagcggcggcgaccttcggcttgacgacggcgacggtgctccggcggtcttcggcagcggcgaaggggcggacgaggacggcgacgacttggcgaccacaatggcgacctccccgagcgacgacgatgaccggaacggcggtggcgcacggctggagcgacggtgacgacggcggctcaaggttgcacggcgttagggcgcttccgacggcgagagacgaaagcaagggtggcggcgggtagaggagacaccgggggtccttttataggggcaaggaggcggcggcgagggcccacggcgaccggcgacgagaaggaaagttagggctcggagagagagagaccaatccgaatcgacctcgaaaccaacactttccaaacgattttagccggggattccaaaagagaaaaggtagaggagatcccgaagatcatttcccctctattgatttcaccggaaacggaaagacgcggccggatttggaaggagacggcggcgctagggtttcgggcggcggcggccagaggtagacgacgggcctgacaggtgggccccacctgtcagcggcagcgagcgcgcgcgagggcagctgcggctggacttgggccgacttgggccgagaaggagagagagcggttttgggccgactttcggcccaaagccaaaagagacttttaaaatcctttttcaatttaaattattcatgaaatgcaattccatttattaaaaatacttccttagctcaaataaatcccaaaaaaatctaggaattatagaattaagcaaagtatttaatgaaattttatctggtcccattttatattggaatttattaattaaaattagatcttctcttctagacttttaaaataaattctaataattccaattaaacgacaatttatatattttggatttttagggtgtgacagtacagttgtacacctctgatcagagtaaaactattcgaatagccgtgcccgcggttatgggcggtcaaccagattcaccgtgattattctcacccaagtctagtctaatggaattgaatagtctaggtggatggttgggcctgttgcaacgtggggtagcgttggacagtgggtggttaatattgattaattattacaactgttttactgctttcaactactatttataaatgctcgctctatgcaaacgaacctctatagctatcccttgttaattccctgcatcatacccctattccggtatgacttgttgagtacagtgggtagtactcagtcttgctctattttccccaaaccccagagtttgagtatgcgttagatggtggcttctccgaggagtaggcttcgtccgtgccgtcaaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacctcggccggtcctagacgggggttttaacgcacattctgtttggaatcctattcgggaatttctgggcgtgacaagttggtatcagagccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgcatgaccttggtggtgggctaccccaacgcgccagagtactcaactgttccaccgctcagtggcgagcttcctcaccgtgttcgtctggaggttcatggctatgtggacacctgccttgctaatatggtggttcaggcatctggaggcaccgcagatcacgcctgtcaggaggcagcatatctggtgatggccaggcttcgtgatcgccacaactacactttctgcaacacggcgtaccgcttccaccctcgccgagcaagcggtgatgacgtcagcacctttcgcccgacggccggcgagaacgacaccaccttcggccacatgtgcgccgtgatgaggggaagggacaggatgcactctgacctgcacaaggcgtccaaggccttgaatgatgggaagctcgtgaggatcatagctctgaaggatgagatagcacgcctgaagaaggaaaacgctcagttgaagggtttcccagcgccaggaggagtccggatccgcaccacgcccctcaagttgacgactgtacccatgcgcattcagcttgcgcctaggaacccacctcctcccgcagctcctccagtacctccagcagttcttgcagtgcccgcagctccagctccagccccagctccagtcccagtgtcagctcctgcgtctgctctctcctttgctccagcgtcagccgctaggggtccagccagtggcaacggaggttggttgcctgctactcccagtggcagccgcgaccacagcagcagcagttctagtggcacagagccgggcaccggcgagacgtatctgccagactccaggagccgctcagagggacctggtgacgagcagga

SEQ ID NO: 80369 - DNA, 9453 bp, Oryza sativa
accaaccgatctttagttccgggtatttgaaccgggactaaagataacgatctttagtcccggattggtagtcccggtttgaaaaccgggactacaggggggttacgaaccgggactaaaaagcacttctccaccagtgtatattcaataaaattggcacattctaattgttcttttttcaaaaaagaatacgtgacggtaacgctagctcggacggttgcgcggcttgcgccattgccatggctacgtgacgacggcatgcaagtgctatgctgtacgctggggccggctcgcgagcagaatcaccagatatggtgctcgcctatactgtgttcatcgagagtaaccgaacgaaaatgtatatatgtaactgaagttgcggcgttttgcgtgcatttttagtaaaagtcatcgagggcaaaactaccataaaagagaacgtaacaatccgcctcaccatgtcttctgcgtacacccttgctcccgttaaatttataagcacataatgatttaatttattttataaataaattatgacattgtagatgtaaactagcataaacgcatcataaaatctacacatgtaaactagacagtaaagcatgaataaatcgaatatatacaacatgttgaacacgtaccaaggataacagaagaccggtttctctgcagaaagcatgggcggacctaggggtgtgccgggttggcaccggcatacccaatttcttttgggaaaacactaggatgtatatgcaatcaaaggacagaattaaaaatagaatactctactctcagaaaatagaatataacaatgatcacagtttgtcatcttgtaatcgtcaacaaatcaaatcaggggaagagggaaggacatgaagagaaacgagaaacaatggggaaaaaagaacagctagatagattacgatatggggttgatagttctgaattttatagatttttcataaattatggaccaaatttgaatagaattttgaaaaatcggaccaaaatctgccaaaattcttccatcataattgggtgttttctttttaaaaaatatatagtgaagtgatcgctagaatgggcacacccagtgcaatttttctaggtccgccactggtaggaagtactcgcggttgcgggcgttgatgatggcgcacagcacgcaagcgaagagggagcagtcgcgcgaagcgcttccaaaaaccttattgtcaccttctcccggtgcaggacatcgaagacgaatgttccagagacctgctctcccgatcgccagtgcatgccgatgagcgggatggagtagactacgagcgacgacgtaatacagaggggaggcaaaccttagattgatttcacctgtattccgtggaggcagtgactcaacttatatagaaatatcaggacgcctgcatgatctccactccacgtaatcgaactagataagtcacgctcaacttatccagactccacgccgttttatgcaccggattattcagagtagactatgagcgacgacgcaatatagaggaggaggcaagccctagattgattccgcgtgtgttgcgtggaggcggcggctcaacttatatagaaatatcaagacacctgcacgatctccactccgcgtaaccaaacctgataagtcgcgcgtaatttatccagactctacgccattttatgcatcggattattaggagtgtttccaaaacaatcaaatccgaatttaccgcagcaaaacaaaactgcaaaagaagactgcatctgcgcaagggtgagaaaccaattttggcggacaattgcatatgtcatgcacgcaccgccacgccatgccatgccaggcgagcaactatgcgcatgttccccctcttctctccacctcacatgcctcaagtggctaggagagcatcctcccttataaggagatcttcctttactatctagaatagtcaaggtgtactaaatttcccatccatgccatctcataaggtgggcttttatgattttctaaagaattaatcttcgaatgggctaaggtctagctattaattccgacagctcctaatctcttttactttgttctcgttgttaacactggcccacctttcaccgccggctacacagcttcaattcatcgttatgctgtcgctcgcacgctgctatttcgctaagcccggaaagttaattttcccccctcacctcctatacccactcttcccattccatctgacctcaaccgcgaaccctaactgattgggtcgccatcttttcgcctgagcaagagaaggagggcatcacattcccgaatgtggtgtggatccattggcggaggattcaacgtaaatctactagcataaataaaggtcaggtttatttctttaaatgaaatagtgctacctctattttgtaaaaaaaaaaagattgaagtaattaacaaacatcatctaaataaaaatgaagggagtagtccttaatttaataaaataaacttcaccacaaagtttttttaacaatacctacgttgtattgtgtaatttaaaaaaatagaaattaatgctaagctctaaatctcgcttggccgaatccttctcagcctaattccttttcttctcttcactctactactgttcccctcagattggatgggcctaagcccatattctctccttttctttcgggaaaagtacaccgaaggtccctaaacttgtcatcgagatacaaaatcgtccttgaactacaaaaccggatacaacgcatccctcaactgacaaaaccagtgtaaactaggtccctcggctgttttgaccccggttttgaccgacgtgacagttgactcagcgtgggacccacatgtcagtctgtccacgtcatcacccatctcttttccttcttctctccgttccttctctctcttctctccttgcgacgatggtggggcgcagccttgcagccttgcggcggcggcgtgaccctgtggtgggctggtgagggataggcggcggcggcggacctgctctgcggtgcccggtgagctgcagcgccatcgacgctgtctctccccgttccccttttttttcttttatttttaacttgtttctctccctcgatgccgctgctttccatggcagctagcgtggaggttcgcgcaggcgcagcggctggatgtggccggatgcgaccggaggccaggacgacaccgcccacagccgtcaagcccccacccgccgcacacctctcccaccggccgagctcgccgccgccgtctgcaccctacaggtcgagctactcatcgccaccgtctcaatggcattaatgtctcatcgccagctgctcccggccaccgcccgcttcaccaccggttagctatcccggcattaatggcgatcgatggctaggggaaaagccgcgacgagaagggcggaaaccacggcgccctcgacctcgctgagagacttcggtggtgggcgccctagcaggcgaccgcgatgaggtgcggcgcggctgcgcgtgctacggcgtgaaggtgcgcggcttctacgcggaggatgttagcgacgaggggcgctgcagccgcgctcacgacgacggcaacgagtgacgccaaggccgcggtcacgtgggcggcgagtggtggagcgaccgcgcgaacgacgactaccaggggctccgcggccgtgcacacgatgatgacgtgggtctcctgctccgggaccgttgcggccgtgtggcgggtagtcctgacgagccgcgccgtggagacgcggcggcggtgggggcgcacgtggtagatgaggcccggcgggtggggaagagactggcggggtaaggagggagaggtcgggcagcggcgacgcgggagaaggggaggagagcgtcatggcaccggcgcacggcagtggtggaggagaaggggagcgcaggcactgctgttgtcgggagctggaacggcgggaagcatggcgtggggacgggggaggacagtcagagaggcggctcattggggacagccctcacggatgagcaagggcaggaaggacaacggcggctagggcggcgatgacagcgtgtcggccgaccaactccctcctcgctgcatcgtcgactggggggacttcgacagggcacgccgcgtcacggacgctgtgctcgccgctgcagaccctatgggcgaggagacaagggaggccatggcggtgcccaaccgcgatgtgctcctctacatgagtcgcggtggagcccggtgtggcatggcgccatccacggtgaagacgtccgcgacgcgaagacggcctcggacgcaacggccgctaacgtcgcacgcctctttgccctctacctgccagcactcacctacggcatccacaccaacctcctcctccgcctccccttctcctgcatcgccgccgccaacctcattccctcccgcctcgcgcccaccggctagctgcctagactggacagagaggaggaagggagagacatgggaaggagagagatgatgtggatagattgacatgtggggcccacgtgggtcttacgctgagttagctgccacgtcggtcaaaactggagccaaaaccgccgagggatctaatttgcataagttttataagttgggggatgtgttgtatccggttttgtggttcaaggacgattttgtatctcgacgacaagtcgagggaccttcggtgtaccttttcgttttctttcccgcaggggctaagcccatcagcctagacgcactgccctccctagtaacaaaacccatgcaccagaccaggccaatccactctctttcctctctttcctctataggcaatccaatcgacgcagacgcagacgtagaccaggccaatccactctctttcctctattggcaatccaattgcgtctgcgtcagactcaacgcggcgcggaccacggaaacggagcctgcgtctgcgtcaagccgtccacgcccgcgcgccgccaacgaaccctcgacccaaaacgctcaggaggacgccaccgccattgatggtccgagctctgatctgcttcatctcaccacatctgatcatctccatcggaggcacgaagtatggtccagtggttctttcttggaagtcctaaagaacacaatcgatctaggcgaaatcgctgttcggttggagatcggaggcggagctctaggcctccatcggtcgtcggacgccgccacaagccccacaacctgggagagtgggcgctgcttgcctgcttccattgacttcctcttcagccgcagccgcctacggtgatttaagtttcctctcatctggtctcccttcaatcggcaccaatattccgaaatataatccgaatggcctgacaaccaccaacgaacaaataaatgcatatgctaattgtgactccatgtcgtagattttcaaaattggtactctctccgttgcacaatctaagtcattttagtatttttcacattcatattgttgttaatgaatttagtcatatatatccatctagattcattaacatcaatataaatgtaagaaatgctaaaatggcttagattgtgaaacggagatattgtgaaacgaaggaagtacaatttatttgttcgtggattcagaattggcaaaaaaaaaattagtttgtggaaccttcaaaattttgtcttctgctaattatgtgtccatgggattataaaacgtgtgttaatcctttaatattacaagttaacaactgattctatgcaaaacaaattaagaaatatcatgaatcatcaaaatacttcaattatttctttgtacattgtttgaacatgacatttttctatatgttcatgcacgataaagacataatatccccttcctcaccccaaaaaaatccccaacaattaaaattttatttttctaatactttgtaatttcaatagtttattctacaccatattcactttactttcatagaaatttcattatttatattgagcaataggtggctaacttcgtaccccattcttgaaatcacatgtgtgtcattgtggtcttaggctgtgttcgctgcatgcagttgggaacatatctccagcgcacggaaaatagagcaatccattagcatgtgattaattaagtatttgctaatttctttttcaataatggatcaatatgatttttttaaagtaactttcgtataaaaactttttgtaaaaaaaataacgtttaatagtttgaaaagcgtgcgcgcagaacacgaggagatgggttgggaacccatcctgccgaacaaagccttaaacttgttccgaaaatacttctaatcggtcgtccgatccaaacataaaaatcgaatggctcttgactaacttctctaacactcgtgactacacatcagcacatgcgctgcataccaccttttgccagtgacttgctactgcatacctgttgcttctctctctcttgtctctgcactccatactacttgcatgcattcatttaataatatacaaaacgatttttctcctaaattacttatccaatatacaattcgatcacaccattgtattcgttgttattgaacctttacaacaaaatgtcacatgattatattctaataaagaatagtcatatgtttcgatctgttaacattctttgtttcatacgtaatagcgatatgtttcaatatgtcttcaacatgtttcacaaaatttccaaaactaactgcactactctctctccacctcatccatacatgcatgcatgcattttaacaagtttcaaaatattttttctcctaaactaattatccaatctacgatccgatcacactgttgtattctttgtaattaaatctttacaacaagatatcacatgattatattttgatgaaaaaaacatatgtttcaatccattaatattggttgtttcatatgtgatagcgatatgtttcaacgtgtatcttcatcatatttcataaactttttaaatgtttcagttactgattttttatttcacactaaataacttgatgtttcactcgttagttaattgaaacatttgactaactgatttcttttttttgcatgttggtggtgtgatgacgcgcagcgtccgatatttggtggaatatcggacgtccgatgcggagtcttctccaacttgttcagcagttatctattcctttcccggttcacctgtcttgattagagatcacctatgcaatattgccttgttcggtatttatctattcctttctccgttcatctacgtttcactagtgaccactgtgcgacatcgccattgttaccaggattccagctagttcttggagctcgatccgagcaattccctttgtctccacatggctagagatttgagagccgcggttgaagtcgccaatggacttaagcaggtaagcctattcacaattgttctattggacactattaaacatttttgaaagactttttgtaattaatgtgtaatattgaaagtcaaaaaatataataattatcataattggtttgtgtgtttgatgacattagtaaactttcttctttgattgagagggacttataaatttgtgaagaaaaaatatttgtaataataactaaaatcaataaattttctcaaaagaaaataggaagtgagcttttcaaaaactctatatgaatttaatgtaggctatgctataggagaaatgcctgactcacaattgaagttatcaccgtaagaatatccttcatcctcaacaatcatgttatgcattatgatgctttgcagcaatgactttaataagaaattctcatactaaaagatgagttgtatacgtacaataacaaactgagaacgtcgaacaacaaatgcacatgtgacatctttttcttgccccttctttgtcttgtgcagattacttgtccttcattcgtcggggctactctctctttttacatgaacacaattttcaagatggtgaacggtgtattcttaagaaacattttatttaaaattttctttaaaaatcaaataaatttacttgtaagtttgtcattgttaatacttgactaatcatgcgctaatgttttaattttttttccacattcagctacgccacttgagcagaaacgaatgggacctaagagtgtcacataagattaggtgatgagatagaggagagaaacatgagccacatctcttatgcaagggagaagctctatacaaacataaaaaaggtgtgaaaatattagtagtattggaatatgtgtattagagatgacatattggttcctagtcacactttgccatcactaaccgagaaaagttatcacactttgtctaaggtgggtgatcaactttctcatttaacaccggaggaattgcattacaggccaaacaagtgctcttcttgtagtcaaaatgtttcctgttcgaatccactgaaatgagtggattaaattttggattaaagtggcacgcttttcaaactgctaaacgatgtgtttcgtgcgaaaactttctatatgaaaattgttctaaaatatcagattaatccatttgtcaagtttgtaataattaaaactcaattaatcacacgttattactacctcgttatacataaaacacttaatctttatcttcatcatctttacatctttaggagattcaaaccccacctaaatcgggatcttttttatcttcctctctttggcatgtagcacagaagttgttactagatgccgaggtacgcttggtcctgcccttcaatactctggagacaagttgagctcaggctgagtcaaaacagcctgttcctctaacaatttctcaagctccagaatgtgttgtggctgttctttcaaggagagaatttgagcagtcagggaggagcattgtgttggtagtttgaactgaatggaagtctagagtaaccttggcctgcccaggcagcagactgcatagaaggaataagttcaccggaggtccctcaacttaacagcaagattttttaagatcccttaaccacgaaaccagaaatctccactcctaaactatacaaaaccgttcacttaaagcccctaggcagtatatatgggtggtttcgctgacgtgacatcttagacaacaaaaaaaaatttaaaaagtacgtggggcccatatgtcagcgggacatatttttttcatctcttttcttgtccttttcttctctcttctttcttctctcttctcttctttggtcagggaggccagcggccggcgatgggcgggcggcgggcgagaacggcagcagagcggcgacgggcgagcgcggcgggcggagcggcaccgggctgcggggcggacggtgggctctgcggccatgaccaccgcagttcctgcggcagcggcaaccatggcctctccgaatccctcctccgccgtgaccacggcagttcctgcgtccgacgacaatggctagatggaggaggagcgcggc

SEQ ID NO: 80370 - DNA, 1884 bp, Oryza sativa
agacattggcgctgagttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagtttccgatcgataaggtgttaatggtttattttcgaaactattggtgctggtaaaaaaaatgttctgctattcctctatcaaagcatgtcaatgtcaaacatttgctaaagttgtactccctctgtttctgaataaaagtttagctttgattttttttcttagtcaaactaataagattatataaaaattagtagcattttcaacccaaaacaaacatattatagatttaatgaatctaaaatttggtattttagatgttgataattttttctataaatttagtagtaaaatatcacaatgacttctaatataaaacggagagggagtatatacatatgccaaacaattttaccaaaatttgggtaatacccatatatacacatatattaattccacattggctcaattttccaaatggcacattaattcacacaattattttttgcacgatatcagaacaacttctcccatttatatctctactattataaaaactgaagatgtttttgccagaactttggtacgtcatccgtatatgagtcggtttttaagttcgttcgattttagaaataccaaaggagtcgcatagaaatctcttaaaaaaaactcgcatgctaacttgagacgattggact

SEQ ID NO: 80371 - DNA, 9398 bp, Oryza sativa
gatatgggtgaggcagtgggtctggcggaagggcaaaccaccccggcgccgtcggaggccgaggtcgagttcggttccggcagcggagaaggggccgaagtcggctccggcggtggctccggcggctgatccgagtgggagaagcacgatacggaggcggctccggcgaggacgcggcgtagcgccggcagcggggcggaggagaagcccgtgaggaggacaaccgccgcggtggggaagaagaaggacggccgcgggctgaggtcgatgtcggttccggcagcggagaaggggccgaagtcggctccggcggctgatccgagtgggagaagcacgatctggccgcgtctccggtgaggacgcggcgtagcgccggcagcggggcgtggcggtggggaagaaggaggacggccgcggcggctccggctaggacgcggcatagcggcggcagtggggagcaggaggatcgagcgaggaggacggccgcggcgggtccggcaaggacgcggaggagcggcggcagtggggtgtcgctcctgcgaggacgcggggggtagtgagcgaggaagagaggcgcgcggtctccgcggccgcgggtggagaaggagcgctgtcttcgcgcgtggaatcctcggctgtgaaatcgtgcggtggagaaaacttgcgcacggatggacggtccagattagtccggatgatttggcctagtattggaggggaagtaactcctactttttatattagctaaatatttcaagtgtcatatgctacttaaattgtactttcaatagcacagctaagaatagcaagtgtgttatcccaacatctattgtgatatcaattgtattgcacttccaattaaacatgggttttcaaaatgtttcatgctaaatcgcatagttccatggcattctttcttaactatacttatgaaattatattgttttgaaccctttctttctctcatgttgtcaatttaatttcatgatatattctcaactataacatgccactctctttagttgaaacccatggagaaggacctaaggtgattgtatcccgtatttagttttgtgttcagttgggcttatggaaatggacacatcaacgtttcattctttgtctagctggctgttgaggtacatttgagatatgtttttctactaatgtcagttttcaaatcttttggtcttccttctttcacaacttgacattggcaaagaaccatccgaaaaatatttctatagggaaatattgatctaaccatactttgttcacttcaataggacatagagcaatttttaaaattttaaagtttaggcactaatatattatcaatgaatgtggcgaaaatattttgatatattcttctcatagggagtagcttgcactaaactgttattagtgtaggcggttccttgggacaatcacctgcattaaactattgagaaaaccttgtctatgccaccgagtttactctagttcaacgatttgccattagctttgtctccctctataatgcatcattgactttatctgtttttttctataatatgctattggaacggatacttttaaaaaaatactcaaaatgtcgttcaagacctacaaaaggttacaattgattgatctattagatgttccaaacaaatatatttttttaagtagcctccttacatactatagaagtgtgtttatatttcaagatttttattttgcatgtattaaactgtttgcagtaataattttctaatgcacttttttatgccagcttcgtgtggaaatgttactgtacaaagaatggacccaacctcgcaataccataagtaagtcctacgagtttccacccacatcttaaggctacaaaaattgcttaccatcgcatccgtgtttgagctctgtctgcttctgctggccaccaccagtcaccaactattggcagtctttaaaccataaatataccagtaatattctaataaaaatgcaaataatagataggttccacaagtttcgatgtccccaatacattttgtaggaacatgcatgttaaagaaagagaatttcggctgcttagagctaattctaggtaggcattacatcaaccggaccgagacatggttcagccggcctccacagcccgagtgacctaattacctggtccaacaggccagagtaatccagccaacccccttccatagcacggctggccactcagctccattgagccaggcacagtagtagaaatgaaatgacggacctaaatttgtccgataatacacacttaaggtattcaaattccttagcaaccatatatggtctatatgtcacgagcctactcgataacagaatggttgtcaaccatcctgatatcatgaaattgcgctaagacatacagatcattactagcatcaatagcaccgaatttgatattcattacatcccgcaactcctttgtttcggtcatgtacatatacaccccaaccaaacaattgcaatgaatgctaagaatacatcccacgaagatagtagtgacttcctcaaatttcttctggttgctagtactaacccaaaagcatttcatagccatcaaccaatgagtaacccttatgtgccatctcgtgaagtgcatatcagtgaatttatgcggctttagtgcatcggcaaattaagctctagtaaaaccatagtgcctatagtaaggtttttggactattgaaaacataattgcatgtagatttaatttattccataaataaatcatgaggttaaaagaggtaaactagctgaaccaagtcagttgatctggacttgtatacaagatagctacgaataacaaatcaaacatacgaaacatgattgagatttaccgatggttctgtttcgattgtggaagaggatcagcttgaaggggcaaaccagctagcagtcacatagagcgcttccaagaaaccatattggtgcctttttcctactgtaagtcatcaaaggcaatggttccagagactttctctcctggtggcgcggtatagagaaagtggcaaaccctgattgttttttgtgtgtgctacgtgcaggcagcaactccgtatctatagagataataggacatctacatgatctcgaaaatacgtttctttgcataagtggatgttgataaccgttaaatacaaatttcgaccaccaactatcacaataaacaaagggagaactaacatttcttacatatatatcatttacaaataatgtagttccacttatattgtagaaatactatggatgcagggattatacactaaagtgaaggagaattgagccggcatgcaaagaaacacacctctagcgaacacacgtattgaggggctcacaagtcagatcaaactgacctaaagttgggcctaaccaccaggaacaaaccaaggagcccacctgttagccactcaccaaaggcggtgccaattggcgttgggtctggtacattcgaaccctggttcggctgaaccaatcgtggtgcccccatttcctcccttctacgtggtgatcccttgttggctcctgatggcggttgtggagttaacgacctcctcaaccatcataagccagctataaacagagatcacctcttcactctcaaagcacacactcaaggtgtaaatctctcactccataccttgcattctctctagtagcagtggagttaggttatgagtaatctttgagcctatagtcttcttggagattccggtatgtctttggtacttcacctttcttgtaagactatagttgctttaatagaattatcttctttattctattgtgttcatagttgatatgctaattcattagttatatgctctatgaatagattatacttcatttatatgattcacttgattagattagtcgatctatgctatggtaatggtccagtgaccttaacgggttgcactagttctaacttgtccatccgaagggtgggagtgccaggggaattagtgtcattatttagtaacataagcatggtgcttaggtcagcaaaatgttgttggatgcgggtatgtcccacggaaagtgaggtagatgagaggtggtgacaaacatgtccgtcctttgtgttcctccacatctgggtatgatgtaagagttcgtaaaatgccataaccacgctggcaaaccaacaaggagtggtctctcggtagtacctaggtgcctagaactaagtcctaaccttctaagcatgtatgtattaagtgtaaactatacattataaatacaaaagtacatttaaaccatagatctctttagttcttctccactacctagtgtatcatttttagagatgaatctcctatgtatcacactacccttatccatactatcaattaacccctatttagaaaagtaattatagcttgattaaggaatgcatgaacttatttttttacaccgccgcttttcctgtgaaaagataaatgtgatacccttggaatactccttgggtgaaatgctacatatgtatccatgcgcttgcggatttatctaggaccttaagaaataccaacagttgctctaaactatcctaactagatgtcgttccacacactagaaaatccaatccgcacaaatcacactaacctatccagactacacgtcattccatgcaccggaaagtccgatgtgttttcaaacaccgaattacgcagcaaaacaaaattacaaaatgaagttgcgtctctgcaacaatgaggggccaattttggcatgtgcattcatctagttctcaccactacaagtttctaaggggcgaggagaacactctttgacggaggtaccgctctcctataataggcaatgtggtactaaagatttacatgcatccattcttttaaagtgggcatttatgatatttaaagaaattaatcttcatatagggtcttcatccacatatcaattccaatagcttcgagcagttttgcgaagtaaaacgcaaaatctttgctataaaccagtcacatggctatctgttagcaaaaacaagggaaacttaatctgagccagcttccctcataaaaatagaaggatgagagattggttaccttgggtgagagaaaacaatgactctaccatctagtgtcattgctggtacactgcagaaatagggaatgttccaactgaacaataagttgatctgaggcaaagtaccagtagctatggtgaagcacttggacagatttgacatctctcaagaggagagagagggtgctgatttcaaccagcagcaagccaaagggcgaccggcaggtgatgagcctcatgtggtgggattaaagcacggtggctaccattaaggttttctttttcttttagaacgactagtcctctcacgcatattcctttactaccaaagtaacgcatatacgtggaccttttcagcatacttcttttcctctatcaaaaagccaataccgacgctcgcttatcagcgaagttctatcgatagagcaagaaaaaattacaagattacaaccagaggagatcataaccagaaaaacgaaaaaagtataccaccacctacacaccgacagcgccaacacacagacccaagagaagttgctaccattaaggtgaacccttcagttttgtttctgtgcttcctagatttgtggcataacgaacgtttgggtttctgactatacatgcatgctgaagatggccaattcttggtttcctgctggcagttcgttagtgtacctctgggttaattcggccacattttgggcctggtttacaccaatggtggaaaagaacactcatctagcggttcacatcaaagatagatcatgttgatccaacggctaacacaattttgatgatgtgccaaaccatggaggatgctttatagtaattaatactttttagaagaaagggtaagttgtttcttttttccgttcaatcaagtctttttttttatttttatgtttggaattatggttggtcgatccacaacacatctcctgaacataagcacccggagactggcatctcataaagatatttctagataacacatattggttagaacaaacatatcaggtatcataattaatttcagtcctcagctgctcgatgcagtactttttttttttgcggggaagctcgatgcagtatatgattattactgatcaatcacttgttaattgtgaacctctgtgcacctttggtggtgtgcagtttggtaagcatccctcgagtgttggatagcagagctggtccagcgaacagcaatagaacccaccacgggtttgaacgcaatgatccggtttataatcaagtcccagaaatccgtttctgccttttactcccatcagcaaatcacttctgatcttgtttgtgttttgacctattgatgtataagaagtagtatgtttatcatgccggtgcaaagaaaatgaggaaaataacacacaggtaactgaaaaagcaatccaagtttcgaaattaattacctcttatttgtgcaggaatagcagagcacaccagaagaaccaagaaaaataacataactccttggtgggtgtaagtcatacattttgccattgcgtatgacgagttactaatactatgctacttttcttgttgtgactaataagttcagtgagatgagtctgcatctcaggagccatgggtcacacatatatatagaataacaagctgttatgtatggaagaacttaatgattatttactttcatatcttgaggattttactctataagattctggtagattgtcctgagatatagctctaatagcacgtccgacaatgcactatatcttatccttgtctgatttgttattaaagccattttggatctcgtagattatcctaattaaaatctactttctatagcatggataaatatatcaggtatctattgctacttaaattgtagtacttttgatagcacagctaaacatagcaggtgtcttatcccaaagtctattatcaattactccctcattccctaaatgtttgacgttgttgactcttttaaatatgtttgaccgttcatcttatttaaaaacttttgtgaaatatttaaaactatatgtatacataaaagtatatttaacaataaatcaaatgataggaaaagaattaataattacttaaattttttgaataagacaaacggtaaaatatttttaaaaaagtcaacggcgtcaaacattttgagatggagggagtacattgcacttccaaacacgtgttttcaaaatgttccacgctggtttatgaaaatggaaacatcagtgttttattctttgtctagctagctgttaaagtacaaattcccctataatattatttggggtattaccatttactaatgtcgagttgcgtattctttggtttccttcttatgcacaacttgtcattagtgaagaaccatatgaaaaatatttccatggggaaacattgacctaacaatataaacattgaccaaaccatgatttgttcacttcagttggagatggagcgattttgtatgaattatcaaagtgttggtattatcaaagaatgtggaaaaaaggtttccataggtagtacaggcagttcatcaggacagcggcctgcattaaattattgggttattagtgctagcggctccttaaaaaaaacgcccacactactttttcaagcgattgtcatacttgctgaattatcctccgatggatattataactacgaaaattaaccaacacccactgaacataaactactcaaattttctgtcgtttagtcagaagtgatcgaaataacgaactctagttcatagatgactaggagtagtttggttgggagacgattcgagtttagaaccagcctgtgcctgcaggagtgtcttcagaattttgtagtgattcttgtatctttccaagtttgtacatttcagtcaatatatttcctagatttcatatttccatgtatctttttttgtaattactttctctgtgtatattgtgtgctgaattattcttcgatcgaaaaattggttgttcaccatgtgtattagagtaggaatctgtggtttagagtttacaagcttcttgctcattcttagttcacctagctaagtcttggagtcttctgttttgatcgttgggagtactttcgtgtatgaccaaggcatagtggcctggccatatagttccaaggaaggttaactagacaaacagacgtacgtagtcggcagggtggtgacagccccatcatcctttgtggttgtccatggtaggtcaagtacgttggcattagagatcagggatcccagctcaccgattgttggaacatgtcccctgtaataccagtcatgctgagataacttgagccaaaatacctgggagtcagaagactcctatgaaactcctgaactagatatgtacgttcgccccttataaactcatttgaaactcccgtgttatatatcatatatgtattataaaggatcgtacccccgcgtgtggatagtataaatatccttagacaagcaaggtagaaagaaggtaacattataagccatccatgggtccgtgtggagaatataaatatgataccccggaataatccgaggtaaagtgctaaatcactaattgcgtgcgcttgcggaacatttttatgaaagcagcatttctagtatcattgttgtttgtacttttaaagttgccttgataagtcgaaacttgtgtattttcttagcaagttcatgctagaaaccaggtgtccctacctatgcccacggcatcaaccatgataaaccaaggctgagtttctccttattgagaaagatagtttcttgacgcggcgtgccaacttgcattgcctaatctgacacagtcagcaacagggcaccttgacatccctgtacccgcaaggtttgcttcttccttcttcttggcctcttgggtgctcatcatttcgtagagtagtgaccaaattcattatagttaaaatagcggatatggatcttgccacggccaccaccacctaaaagcctgcataatctttgcgtggttggtcgctacaccaccctttgcatggaccatgccacgccctcgactgccttggtcacggatcccactttctgtaggagcttttttctttcaggttgatagtaagtggatgctgttcttgaagcacacctcccactgggccagagtggcagagtgaggagcacctggatgtccgcactcatgccgatggtgatactcttctcgcgtgcgttctcctcgaacatcttcaggtgctgccgatcatcaccttggtatcgaatagcttcctcactagtgaagtgtcactcagggtacccccaagatggactagcacactgacatggccgt

SEQ ID NO: 80372 - DNA, 26313 bp, Oryza sativa
aatgagaaaagtcaaactcaagttgcgaatttggcggctgcaaatgatgatggtgctccaaaatctcaatatattgatcttatccaagtaagtttactgctatattttacaatattttggtacatgttatattttataaaatacatgttagtaatcttgacagacaatccaaatggacaagtattgaaagagccacttggatgtggtattctacttattgtctgagatgtagaaatgacaaattatatcagtgctaggtctaatgcaaacaatattacaagaggatcatgcttagcattattcataaacttagtaatatagtctactaatgaccaatgagtagcaatcttagatttattttagtgtagcactaaacaatggtcatatgaactatataagagcagatgccatcatattcgtgtcagtactgttgttgaaaactacacaggatatccttataatgtttggtggtatgatcgctaacacacccttttcatttagaatgactcttacatgattggagtaacatgaatagaaagggtacaacaacctaaatattaatggggtgaaagacaatgagcttcgctctagaaagctcatgcgtttgaacgtaggctctggtttgactcgttctattctgagcaacttgtgagcctcgagtttttttgacagccctagttggactcgatccatgtgattttgagcgaagcagaaagtgcaggactctaggttgtaacaagaaggggcaggctattgttgtagccttgtaggtacagtccttattgcaacaaacatggatagtgccgggttgtcatgcagagcagctatgcatgagcatggaggtgagcttcttcggcgcataggcaataatgagaaagttcttgaaatgacttgtgataaactctgtggtggcggcaagagctggatgaagagctataatggtttcatctcatgttatgaatttgacttgcttaatgtcctaggccaaagccaaatgctaataagcataagttagctaaacgcacatactgtcaacagatgctcttatgccacaaagttggatgccataatcttatttgccgcataattgattggctttactgaaatgccacaaagttttaccacaacacgacgtgaagttccaaatttatcttgccctccgatccatctttccatgagcgtcaggtctaggccttacggctgcatgatcatgtctatgaacatgtccagacatctagtacggtgtgttgtggaatgccttgagcttctccggtctggtggcatggcactgcatcgcaggtcaatgaagcttccattgctgcttgctggcgatgagatacacggggtgccacagaacgagcttgagaaggcctcatacaactgccggtggaccttgtccttgaccacgtcgagcaccttgcccttgggcagcttgaggtcctcagaaggcatggcctagggcgtcatttggagtccaatggtgcgaatttggatagctattttatcagtttaggtttatcttctcatgtcaagtttggatagcttatttatttccttgttcctcttaactagtctctccctcccgtgcacccttccaatgcgcacttcgttcttttttgtgttctgttgcctaccatcgtaccttgctggtggctgagaggtttggggctgaggccagcaatctatcacaactacaatatttggtctttgccaggccgtgacaacttggtaccagagcaaactcctgcgtctgtagacatgtcggccgctggtggaagcgaggaaaggtttaggccagcaaatggtggtcatcctcaagaagctggagaagttggacgtcctggagtcgaagcttggtgacatcaatcaccagcaaaaagaacatcacctgatcaccttgcgatcagtcgtttgtaggccagtaaatcagcatgcaatgccgataccttctcggtgagcaaaggcatcctcctccagtcccccgactatcttcggctctgggtagaccaccagatgggcgcgttgtgctaacacaagtggtacttcccgacattcgacaggaagaccccctggcccctgacatggcttatctgctgtgagcaattcttctgtgggcagtgcacgttagaggaccatctgattgcgtaccatcgtgtctagctgaccgggaggtctgaggtttaggctggctggctatcacgactacaaatcttcggcctttgccaggctgtgacagaggttgaggaagaagaacatggcaattggtgggtgagttgaaaaggtcaaacatggtaaataagcaagtatgtggcaaatgagagtatgccatcctggcatgagggcattttttcccaacaaaagtgtcatgtacgcaagcgagccaataatttaagagcaattaagcattgtcaaataacattatttatttacagatagactttgatcctaaatgtttctttgtacatgattttagtagctgatggttaagaggaagatttagctgtgaatttaagtcttaaattattttcatatgttattgcaggttgatctgcttttaggaaaggcttattctgattggggccatatcagtgatgctgttgctgtttatgaaaatctaatcactgaacatcctgaagacttccgtggttatttggctaaggtactgatcaatcttgtgctttatatatgagctttaatgaagcctttttttggataaggcaattcattaatcactgaccttaatgatttcaatatatttggcatgctaaaccaatatatctaatttttcaataggaaaaagtccaaataaccccctagactttgattaaaatttatatggccctctaagttggtttacaaagtggtttttatttaatctgcatataagctggctgagctttgatcatgtgacatacatattggatatatatgttaaaattttcacttaaatctttcttttttatcccttgttcgctctcactaacaagaaagtactaacgtaacaatagtatgacatcactgtataaacaacctacaaatgatgatacataaatatattgtattagtaatttaaaaccgcttgtttaagatcccgaatacgcaaaaccactatccaaaacatacattgtgtattaacataattcggatttcttacataactggtaatctccatcctttttcttttatccatcttgcagggaatcatattaaaggaaaatggtaaatcaggtgaagcagagagaatgtttattcaggtattgttttgtctgtgatgtctcccatgctaaacttttaagttttaacagaagtgcaaatggactacagacctgtagggttttaaaatttgtagccttataattttttagtaaatttcataaaactgcaactttagtgacaaaactatcagcttgctgcaacattagggacatatttcagtttgttgcaacaatagcgtgggaaattatcagaaaactgcacttttacgttatatgttgctacatttgtcacctatatgtactgtaacagcatataacgtaaaagtcgcagttttgtgataatttcccaggctattattgcagcaaactgatagttttgtcactaaagttgcagttttctgaaatttactcaatttttttaagaaaaacctgaagctgtaaattctgagtaataaataaaactacagtgcttatgatattaaggatctacaaatttggttggttactctcctgctgccatcccaccagccatacatgtttatgccattttggtcttgtttggctgtgcttcaatccccgcacatccacatggataggccaagggataattaagcctatccaaacaatgtcttggacagaaaaatactctaaatgaataggggagcaatcaatagaagcaaatgttttggatcttcagacatactagcctattaagtcgcgtgtttacacgactatatataaccttcctgtctatttaatgtgtttgtatatagtttatattaattagcttaaattttaagtcaacaatgtaaatacatttttagaacatcatttgtaaggaagtttagctaaaatgttaacgaatttatcttgatttatgatttaataatactattataacacaaataatttatcatacattaccaccaccactaactttctcaatttctaaatgtgtcatacacgttttgtaataataatgtatatagccacatccattacatgttgcaaggctatcatgatctgtttgagaaatatctatatgctatttactgtaagtcttatattcctatattaaaacaactttataaactttactatgcctgtgccacatgatgtactttaggtgtagtgaagtaaccgaggccatgtgatctatagcattaggttaattagctattaaaaatactcattattattgatataatagaactactattaaataattattatatggtcaatgtgtaagggattttttttttcattctcctttctctgataccacatctcatgggatggcttgaagggttagaaacatccctattttgatagccattttttcctatgatccaatgttcctttttatccaaatcacgcatccacggttcatgtttgtttgatgatgtgcttatcctggtggtatttttggattctcttttcactacttcctccgtttcattataagtcgctttgactttatctagtcgaacttctttagttttaataaaatttatagaaagaattagcaaatccacaacacaaaattagttttatcaaatgtaacatttaatatattttgataatatgtttgctttgcgtggaaaatgttgatatatttttctataaactttgttgactaggaaaaatatcaaaacgacttataatatgaaaatgatggagtaccttatccaaatcatagatctggctgttcatgtttgtttgatgatgtggctcacctggtgacaactttggattctcttttcactaatgcagatatattgactttcctgtgcaggccaaatttttcgcacctgatgcagcgaaggcactagttgatcgatatgcacaaaggtagcgtgagacacaacagggaaattccaattcctctaatttttgtcccattattttttgtttagatagcatcgatctaagttcgtcaggaattttatcgcctgtcaattcctagattcagcacgacagaagggacacggggataatttgcttgtcaaacaatatttagatcaaggcagttatagtgtatagaaaaccttcttgtcgataatagcaaatttataggattttgagattgtgtattcttttattaatgaattgatttgaaataaaaaaaattacgaatttccgtagaactcatttaaccctacaacaaattaattttctaggctctgttttttgcaaatattcgtgcagcttatatgccgaattttttaatatataataactaatatcctatgaattaaatatatagtaaatcagatataaatttttaacaacacgatgaacgctgagggaaatagcgtccaggtctggacgtccttgtgaacagccgtacgcagacagcgtccaagcatctgtttgttgtgaaggaaggcacatgaggggagaaaagaaaaaaaacgtgactacctagttatcggcgccggcggtacgtcgtcgttgccctcgtccacgagcggggagctccacacgtcactggctggcttcgcatctcgtccaattgcccgagggcactagtcatgcgatgcgtcggccggcgcggccctccaatcacgcgcgaggctgccgcctcagctttcttcgacgcgtgcatagtatcaggtgatgcatacatgcatatatactgaactccacatgatacatacagccgtcgaatggcaaaagagatggaaccgtttgtgcatgtgggaatggaatatgtgttggattcactcatttacatgcatgcagttccgcatgatcaaccgtccaaccagcagaagtatcagcgacgacgcaggcgttcctacccacgaggtccgtctacctgcgtcatgcggtccccaaccccaaggcgcggacgaattcggcgaagcggatcgaggtagcgagtacaaactagttggtgagcaacaccagcgcttgcgagcggcagcagtcggcagagcgacgcggaagaaaattctctgcggcagtgccgcacaatgaagcccccccctcctccggatcccgggttgcgaacccaggcgtacgtgcgtcgcccagtagatcacccatactgcgataacgcagtggacaatcatcctgctccgcgtccaggttctcgtcgatgcctggtggcggtgagacgaatgtcggtgtagcgggcgttgaggccgatgccaaggtggcgggtgtcgaggcggacgacggcgtgactgcccttgacgcggaagcgcccgaagatgcagatgatggagccgaggtcgaaggcgacagtgatgtggccgttgtcaggtactcgacggtgaagtctgagcaacctccgccgccggggacggctgcagcgcccgccgcatcccagtcccacccagcgccctcgtcgaaaatcacgtcgcgcgagacctgcactcgtccagacaccggatcgaacacctcgtacgccttggctccgtcggcgtatccgatgagaaccatcggcttgctgcggtcagagagcttggggaggtgaggccgcacgtccttgacataggccaggcacccgaacgtgcgcaggtaacccaccgccggcttcttcccatgccacgcctcataaggtgtcatgttggccaagctctttgtcggcgcgcgattgagcagaaaaactgctgtcgtgacagcctccccccaatagcgtgccggcatgttcttggctttcaacaagctgcgagccatcccaaggatggtttggttgcggcgctccaccacgccattctgttggggcgagtagggcgcggagaagtggcgtgagactccctgttcggcgcagtaggtggcgaattccaccgaggtgaactcgccaccgttgtcggtgcggaggatgcgcaatttctgcttggattccgcctcggctcgcgcctgaaagcgcttgatggcatcagccgcctcgctcttgcgtcccagcagagtgatccacatgtacctgctcgcatcatcaacaagcaggaggaaatgagttttgcctccaggggttgccggcgagatgggaccacacagatcgccatgcaccagctcaaggcgatcctcagcacgaaacatggagcggcgtggaaacggggtgcgtcgctgcttagatatgacgcagctgtcgcacagctgcttgacatgatcgatgtcgggcatgccgcgcaccatgtcgcggctcgccagtcgtcgcagagcgtcgaagtggaggtggccgtagcgcgcatgccacagccaggcgcactcctgcgccttggccgcgaggcacaccggttgcccgatggtgagcttgatcaagtacaggcgattccgcgtccgccgaacgcgtgcgagcagctgggccgctgggtcccgtatcgtgcaaacaccgtggtagatacggacgtcgcacccattttcatcgagctggcccaaacttatcaagttggcgttgagtttagggatgtaatacacccccgtcaacgctcggtgctcctgattcctgcactcaaaaatgatcttgccacgaccctcaattccgacgacggagccgtcgccgaatcgcaccgagccccgcatagacaggtcgagctcagcgaaaacttcgcgaatgcccgtcatgtggtttgtggctccggtgtcgagatgccagacgccgccgttggtttgtttctccgtgagaaggtgcgcgaacacctttggctcgacgagctcgatcgtcttgtcaggctgcgatggcggcgaagaagcaggtggcgcagatgaagacgacgcagacacaggagcagcgtcgacgacatgggccatgaggagggccgactcgtcatcgtcctcatccgccagggcctggtgggcctcggcaggccgcttgggcttccggcagtccttagcccagtgccccgtgcggccgcaattgcggcacttgtcgcggtttggttcccgcccttcctgcgtgtcgcccccggcacgatctccatcgtgcgcagcagcttcagctttcttcttgccaccacgccgacgacggttgccaccgccggacttcgccttcccagaggaactttccgcggcctgtttctccttccaccgggcagtccactgctcctcagtgagaaacagtttcccaccggcagcagagctcttggcaggcagcttctcctcagcgtttcggagccggccggtgacctcctcgagcgtgagctcatcgaggtcaagcaacgtctcaatggacaaagcgatctgcgagagatgatctggaacagagttaaggaatttttcaaccacctttccttcttcaagatggactccaagcgtggcgaggttggtgacgagtccgttgaggcgcaacgagaattcctcgacggtctccccgtccttgaactccatcgcatcatactgcttctgcagcatttgcgccttcgacttgcagacacgatcgacgccaactcgcatcatcttgatcgcgtcccacgcctccttggccgagggcttgacggcgagtgaagctaacatctccggcggcaccgcccggagtatggcctccatcgccattcgatccgcctggaaatcggcgtcaccatgctcaacggcatcccacaggccgcgcgcttgcagcatgaccttcatcatgagagcccaatctccgtagttagtcttcgtcagcagtggatagttggctgagccgcccacctccttcaccacacgctggaccggaataagttcacggtcttcgccaggccgccggcgaccacgacggtgtggaggtgaacgggagatacgtcgctggtgcggttcacgggaccgcgacacacgtggcgttggagccgacatggctctgataccaaatgaagcccggcgaggtagccgccggcgagatcactggaaagcacaacacacacgcacgcgaggaagacacagttgcacacagagattgtgctgcataatacggcgcagcttttctgtttctttacttctccttttatttgcgaaatacaagagaacgtgatcgacgtgatccgcattgcccgccacacgacccagtgcgtcgtgcgccatcgcacacgatcggatcgtgcagcgggcgactcgctacattactgccacgccgtgaacatacgcacggggcttatggacgcgctcgttctaataaccgagccctgaaaacatgcaagtaaaagacaggagataaaacctaccctaacaaagcggtagaacaggtgctaacttaatcaaagtatccaacacacaaggcctctcgtgaaacaccgcgtggactggcgacgcgtgtcccgtctcttgctgtggactgactctgttctttgagccgagccgatgcccaggagtcgagttctaccgtcgctcccaaaatcctcttcgccgcctcctcccacgcctgcagcactcctcttcaccactccaaatctactcctacggcggtggcggcggcggcggcggtggctacagggctccgccctccacccatccgaacagcgccccacccaccacccagccatacgacacgctgtgagccttgaggggccccgctgccctcctcgaagcttgttcgcatcagtggtgccatctgcgttgagacagacctgaccgtggtgatgtgtttctgggcagcagaccacaacggcaaggagctaatgtcaggtttgctgaagctatactgaaggctgattcctgtgatattcaaagctgattcatggcttctctttgcaatttatcttgttggaatcggatgtggaattagtgttctttcatttgatgtgtcactaaagctctttgaaaattatagtagtaatttactgaatattactgcggacggtgacttactagacatttgctatcttaataggaaaagaaaaatgaaagctagcagtgtcaacggagaagcggagagtggagattctaatggtttgtccatggcagatagcacgacaggaccacaggagtgctgcagctaggcgcggggatgaggcggcggaaaggattttggggcggcgtcgcggcggtagaactaactctagagcctgcggcgtcggctcggctcgaaaacagactcgagttatagcaggagatgggacacgtggcaccagctcacgtggtgttgcacgagaagcattgtgcggcactgccgcatagaatttttttccaagcgacgcgcgtgtgatctggaggacgaccataggttgtttatctctcttttgctactagaacggcgtgtagacttggacgctatatacaacagcgtgcagacctggacgcttttgacaacgacgtcctaacctggacgctgcttctccccgtgtccatcctatttttgcaaatctcttctcatgtttactacttcatcccttttagcattgcccatattcatatataatgaatctagacatatatatttgcttagatttattaacatctatatgaatgtggactatgttagaaagtcttataacctaaaacggaggtagtagatattatttattatataaaatagtttgggtccagattcattgttaaacatgtggtgtgtcattctgaaataggttggccattgaccatcatgaactgtgtgtcttttgtctgttgagatcgcttctcaggaggaatggtaagaacagagtagtcgaatgccagatagaggtcttttcctttgccagaaaccaaaacaagggcattaatatagtgttacatagaccattcccatcccttaacttgcacagttcgtgagcgcaccatattaattcatgacagtcaaaatttaaattttataattgaaagatttttgaggtttttaatcatattttattttcagtattatcttttaaattaaaaagacacacatatataagttttatttataaattatttttgtccgctgataagtagtacttcctgtcttaaaataccaacatctagaaagatttatctctaagatttttctttctccgatataaaggtgtatatgccaaacgatgaggctgtcatttttgctcattatagctcacagatagatccgtttgacatgtctctgaccaatagatccgttggacatgtctttgaccaatagatccgttggacatgtctcttgctgaccacttggcacttgatagtgccatggcccatggcttttcaggtcttacggacggcaatggtgcttcaccccatcagaatgagtttccctcgtatttgctattcctataactgttaaacagaagaattagatctagttttaaagatacaaattttatctcggttttcttgcaaaagttttctatatgctttaagatattaaataaattttctaaaaatattaaaattaaaactacattagtcatgcgctagctttctcgtttagcacaacgtgtttctctctcgtccctctccttcctgcgtggcagggctagctatacgccaactcaccgcttaattaaatttgtacatataatatatatatacatagagaaattattttaggtcactgcgcactaccgaatggggagaaaaaaaaagataggaagatcgatcacatgcatgcacatctacgagaacatgagaacaaattacaacgggaaaaaaaataaaggagatggacatactgtttgatgatctcgtcgacaatttaattatagtcacatcacaatccataagcgcatgatgttgtgccgtcgctgccccaagtactgtcgtctatcgatcggcacaggacaaattcttgtgacgacgtggatccgagtaggaatttcggccgcagatgatgctcctgagtcgacaattatgcgaatacaaaattagtatgattatacatttccaaataaagatgcaataccattacatcctatacaatgtgaaggtcgagtggtctactatgcaggaatgatttggccaatcagcccctatactattatggaagtgatttttcttaacggcgaaaggtgatttttttttggcagccaaaccaattgtcgtatacttctttatatattatatacgtagtctattcttaattccacgcacagcctcttatcgtggacggcgagcaacaggatcaataagatcaatatgaatgtttttgcttgacaatgataaaggttagctcgcaccgacggatgcagacaggccacccaacagtttacaaaacaatgatcttttcaagcggacaaaactaatatttgcaaactgttgggtggcctgtcttcatcgagatgtatataaaaatctacattttttcaagtgggaggctcagccacgtgtgaaaatcactttacacgggcgatcagttatgatgcccgcctgaaaaataaaaattgctaaaaaaaagtaatccccaaaaccaaaaccctagctcccatccaccgccgtcatcgtcgacgccgtactcaacgctgctcccaatgccgacggtggcagttccaacctatcctgatgccagggacggatccgtcgtcacgcagcttgccaccaacgtcgtcgtcattgtagcccacgctgccagttatcaccacagggagcagtcatagtcatcgtcgccgaggccccgtcgttgctgaggctagcggcagtggatccatccctcctagggctaggagtggtggatcagtcgctcccgagtctgtcaccgccggttctgccctcgcgtggcttgccgctgttgtcattgcccgccctagctgcagttgtcgccgcacggcttgccatcggctggcattggatccagacgtcgcggagctagatctgatcgtcatatctaatcgttaggaggcccaatctgcctactgcaaggccaccaatgctagctcaagcccacatcgcccctcgggtgtcatcgtgaccgctcctgtcaccactgtcattgtggccgctgcggtcgctgtcaaggatgggcggtggatgagagggtgaggagaggagaggagaaggaaggagaggggcgaggagagtgtggagtgagaggagagttagattttttttaagagataagagaaaagaagatgggaggggacatggcagcttgccttgtgctaggcaggcatgttaggaggctcgtctgcaaaaattgatttttgtatcagaaaaactactctacagtattccgtgggtatggaataagtggataatgattcagtcttatccgttcccctcatgtctctttatcaactcgaaccttcgtcctcctcttccgcctcacctccttcgcccctctttttcccctcccctcctttcctcctctctgcaaagagcttctccatgtaggcatggtggcggtggagcaggtcccccaaaaatggatatctagaggcctaagctctcctcggtactggatccggcttgagtgcacgtcgacaacaaggacagtgggtggaactagtctcgtggcctcctagtacttcgtctcatgctttcgaggcatgacgacacccaatggatctagctcccatgacggaagggggcaaccaggaagaagggagactgtcgggaaggacgttgaccgatgtgggttcctcagcctcctccttcgaggcacgttgtcaatggtgatggaggggtgcgaccaatgaagcttccattggtagcgacgtgatggtgagccatcatgctccttgccggagtgtgtgcaggtaagtcgtgcgatgtatcttctacaccatgcttggtgcttgtggtatcacgcctgatacccaagtatcagacctgtcctcgcatgtacgtaccatgcttggcacttgtggtatcacagctgatactcaggtattagacccggtacccgtaggtatttgggctagtacctgtggtatgatgactgatacccacatgtatcagagttggtaccctatgtaccagggctggtacatgcaaggtatcaagtatcaagcaccaacgcttcctctcctcttatcccttcctctcgacttagccttcatacctttctactgctgccgcgacaaacatcgttgcctacgccgacacggggcgctagcttaaggcatggggaatgtgagcttgtggagtgaggttgggatgatgctagacttacgtggaggaagcagatacgtgagatgacgttagcctccataaagtatcctgttcggacggtatcccgctctctagcagccctcctttttatatacgggtcttgtccccctccctgtccaacattatcgtaggtgtacgatgttatggcctatcggcctgcctataggttagaagagggcttgtgtgagaaaattgtttttgtaatatatgcagctaccttcgctcctccactatgcttatgctttgatttttcaccatcgatgccattgccgtccttcttctcccatcaaactccaccactatctgctttttcagccgccgaatcaccggatccggtgtccacaagctcgctgctgtcagaaccggcatccttcagctcgtagtcgccggatttggccgtcccgacggcgttagtggtggcaatgctcgtcgaccataactgattctctcctttatgtgttttatttttttctcgctactttgcggtaaaaaatatctgtacaaaatttatgtagggaaattattccatgtatgtgataaatgtgcaaatcgaccgttcggtgaaagctgaaattttaatctcacccagctggtaaccacaattaaattgatctacaccacaaattaaccaaacaaaatatctttcaaacattatgtctgtgcgagcaacaaaataaaatcttatgctagccattctagataatacaaataaccaaatagttgtatgtgtatctcctaattaattcaggttaaacttggacgagagagttagatcaggttagagacgcgaacaatcaaacacaccctgtgtattccttatgcctaacatcttctttgctcaagcttttacttctttttttgttaatcgtctgttttcaccttttattttgggccgtgtattcctagctttattagatatggttttgctatttgtcagttgactgacaaatagtggttctgtcagttgattcccagaaccgtttctgatgcttgcttcaggatgcgcgcaagggtctgggctagtgggggctggagcgaggtgcatacttctaaacgtcagtcaacagacaaatgtagcactccacagtccacactatcagataatggagtttaacccagcctacatgtattcctagccagtgctaaggcagtaaattttcacctacattaaaaaaagagcctcgtgccatctgaaaatgtttggagttgcgatgatttgtacgtttaatttgaaggaggatatatgctgggctttttaattagaggatttttactatccttaaaaaggtaccaccaggtactaggtactgctaggtatcgactccatctatccatcgattcaaaaagggtatgattggaatagcgtgtttctacccctccgctcctacacctgacatcgcctccatcttcttctacctccgcatcgtgctgtccagccgtcccaaacaattccgtcccagtccgtggctccgctccaccctgccaagtgccgatgcctgaagcgctgaagcacaccgctcacgccatggctgcaaacaaagctgcgatccagctttggggcctcgtcaggacgggaatggatgagagcaggcgcgcggcgcgcacgcggtaggttcaagtgtcgcctacatctctaaggggataatctggtggcggcgaataggagagtaggagagacaacgatgattagagcttgccgacgattaggctagtggaatggaaaaggatgaagaaaagaaatagtaagtaaaaaaatgtaaaggagggctcgcatgaagtcggggaggaaaaaggaaagtttatggatccttcattgtggtgataatgtttggacgtttgggcacctagtcttgtacgtcttcaatggtgataagcataaggaggaagacaagtctgacattagggtccaacatttcagttatagcgaaaaagaaaaggatgtgagatggtacaagatcttacaaatccttaatgtgaaaaggttcatacgctttggtcagtatttgagcaaaagctaacctgatctatgcgattatgcaaatagctgctgcacaacctaacaaattcatctttgttgaaaaatctggatgggagaaacccaacatctggagttcttgacaaaataatatgtttcaattatctatactttttggtacatattattaaggtactgattagataaacttttgcttaatagactaactgttttatgatgaagctaataagcataagaccccaaatgggagatggcactgagctcgctgctgctgctggacttaattggctttgtaactgatggatgctgagccacgtccccctcctcttcactgcataactggacaactgccacggcaatggtagatggctgactttggaggtttccagagagtaaaaggaggcgacatggctcagctcggtctgaactgcggctgcagcagcgtattagcgatgtaggggagaacctggagaagcgctgaagtggagactgcgtgcgtgagagcgtgagagacagtggaagggaagacggcctgcgagagagagagagagagagagagagagctgagaggaggcgaactaggaggagggagggaacaccaaagttgtcagcgttccccaccggcccacctccctcgaggtcatcgccgcccgggaggccaccgcatcggccgcatcaagatcgtcgccgtgttttccttacccctacagctttcactcgatttgaggaggtggatagacaacactttgctctaacttgctaacttcatgcgaaagtacaaccttgccctcccaccatcaacagcatttggtacctactcttgcagacgatgtggtaccagcaggtaccgagccttcccaggccattggattgattggaatggacagctacgatatggtatctcctcccctcaagaactgctacaaaacttatagtatatgagaaattataagtaaaagattagttttggagaccgtgccaattttgaccgcgtcttatattagggatggagggagtactaaaaaaacgaacagggtaaaaaagaaaaggacatgctcatggtacatcctcaataacagaaagatgactacaccattcattttaaaaatatagcatagcatgttataaatctaaataaacacttgtttacatttatagcgaaagattattatattattatataatgtatgaagtagtatgtatatacaacagcaagttgaatttggcgtaaacaggaccatatgtacgactccaagcacgaggagggctcattccatatatatcaacaaattagtgtcatactgtcatggatctagctaggtaaacatcgtcctatctgggagaaatatgatatccatgcatcgccaattcgccataggattaggaatcgatctcgatgatcagtctccgataggccggcctgccggccccggggtagctactatacgtaccggctatagctgcggtgctatccatggatggagcagcacacacgcgcgtcagtgaatcccgggaaaccctcccggccacaagttctccggtaggcgcgcgcggggcccggccggagtttggtcgcgcgcgttcgtctctcgtcgcgtcgtcgtcgcgcgcgcccgtgaacctgctggcgtgtgtgtttgttggccgggaccgggatgatcgatcgagcgatctaccgcgcgcgccgcgctgacatgtacgcagcgacgacgatatgatcgcgcgctgctgtatgcgtgcctgctgctagcgctacccaacaagggatcttcacgggctgcccaaccttgcctcccctatatacttctctgcatctattccagctaattaaactgcagatcaattggacggatatatagagctagcgcatttcagcgcatgagttctcctgatattgcatgttgctcacggtccagattggtagtatttagttgtgtataatgtattattaggttgctgtttttttttaaacggagagagtagttatttaactaaccatgcgtacatgctggcatcaaattaattgaggttttttttttaaaaaaattatctggtcatagatattcaatgttcagcttaagatgatccatcacaattttcaattgtaatgaatataactaagtgttgtaaacgttgctacgttcttcttaactactaggtctgaattaaagaaacttgaacttgataaaatatagtacaaaacaatttataatatagaaattaatactactataagactttctagcattgcccatattcatatagatgttaatgaatctaggcacacatatatgtccagattcattaacatatatatgaatgtagataatgttagaaaatcttataatatgaaatggaggtagttaatatggaacagagggactactgcatcagaaaaaaaaaaaaaccctgcccaaatatgaacgagtgctgattgctatatttgtcctcgccaaggctggcgacaaaactgtttagcatgccaaatataatccatcaccttgttgacttctcccaagaaccaataatttgcaaactgtagggcacagttcgatcccgtaataagatagttgcaactgaaacccaaccgaaggacccattgtgaaaaaccacagactttccaggtttcaacccaaaatctcccatccgaacacgcccctataaaaacccatcccccggtcacggacaaagcatccagccatttcatactcactagagatagccaccagctagctagctccaccaggtaccaatcacctatagtcactagctagctcgatccagctcctcacctctccagcagccgacggcaatggcgaaggcggtggcgctggctgtcctcgtggtggccgtcgcggcggcgctgctggccgtggcgccggcgccggcccgcgccgtgtgcaacatgagcaacgacgagttcatgaagtgccagccggcggcggcggcgacgtcgaacccgacgacgaacccgtcggcgggctgctgctcggcgctgtcgcacgccgaccttaactgcctctgctcctacaagaactcgccgtggctcagcatctacaacatcgaccccaaccgcgccatgcagctgccagccaagtgtggcctcaccatgccggctaactgctaataagtttgctactgttttactgccaagatttgcaggcactgcaacaaaggacataacgtacgtaatatgtgtgcctcctactcctagcttgcgtttgatatagaaaattaatagcataaaatggctagaactgctacagggatagcctagctgtatgacaactgtatgttcttgtcttatgcttgtgtggaatgtgtatgtttgtctgtgagagtgttgtcatgtgtgtgtggttggccggttaatagtgcttgttgcattgatcgcatgcctaatatacttggggtttttctataatccaacgcgcgcggcatcgttgcgcgagctccctcactgtgttttcgttttcctttctttgaggcctgcttgtttttgagcttgttggatatcagcttactattcgatcggtttgcatgggattcatattttgatttgcaaattatgtatcgtcggttttcatggattttagtaattaaagggtctcgcattatgaatctctaacggattaatttgtaccctgctccgttactcgtctggtgcataatcctaatctttgggctccttttgattgaaggattttcataggaattttgaaggaatcaaatccttaggaattttttctaatttgcatgtctggaacatagtcttggaggtgagcaaattcctttgaattaattgcaatcctatatagctctaatttgcatgtctggaacatagtcttggaggtgagcaaattcctttgaattaattgcaatcctatatagctcaacacattcaaatttttgtgtattaaattcttaaaagttttaacacatggcattccaatcatgcatttttcggcctattcctatgtttttgaaatccagcattccaaaggaactactaataataataatggcgcagttaaaactataagcaaatggtaggctatatttggagaacaatcttatctattatatactaaaagtccattaaaatttctcaaaacgcttttaagtcgccatgtgacaatctagtaattagagaaaatagtagaaaatcagagaaaaaaacaaaacatctatccctaaattttcatttaaatcggtgggtccaatatataaaccgttggatatattttttttagaaaattatgagcagttatgagtctgatcgtctcaagttagcatgcgagtttttttaaaagaatttcttatacgactcttactgtattttcaaaaacgaatgaacttaaaaaccgactcaaatacggatatggattttcaaaagcgaacgaacttaaaaactgactcgtacacggatgacgtaccaaagtaccggtaaaaacatctttaatttttatttttccatgtatatagttgagacgacaattatcattacttttagtgataataatttttaaataatagttactttgcaaatattgaattatcaacatataactctttaaaaatagaaatagaagtaaataaattagtttctaatatataaaatatagtttacatcattatcttatactatataatgtacccattattttagatttttatgtaaaaatatttgtacacatattttcactaaaataggtggacctattatttagaccatcaaatctatcttttgttaaaaaaaacgaagactcggaagatgtttctccgcccctctacacaacgcacatgtgcgaaaatccacacgcgtgacaaagagtgtcgtacctaaggtacctaaaatgatcatgagttcatgacgctatagggcttctgctttgccaaggtgaagacatatcaaatcattaatggatgacgactgtttttcttaataagtgaatttttttgaagatatgatgtagagggaagaagaatcaagcaacgtaaactgaatacaactattttttctctaatgtatataaatagagcgaagctatcacatatatatcttcaacagtgtgtttctgtgtcatcatctaatatgtgttggatgattaatgtttaaaataattaagaaggttagtcatcgttccgctatatcttttataacataagtctactgattagaagtccgatggtcactagacggtccgctgaatgtgaatgaagcgaggataatgtttttagcttggttggaaaattacctaaatcgcattgtccgtggtggctgaaaatccgttgaagtgactagggatggagggaggtgtcagtgactagggacaatgacagaccgtttcctttttcagtcgagagctgggacttgggccgtgccggcatggcccatttgcccgatgggcctgttcatgccgggccagcacaagcacggcccagaacatatggagcaggggcagcccagcataggcttgctgtgtctctgccgtgttcgactcctcgccaaggatgccagccagctgccgccaccaccatggatcctcatcgaagaaatcactgcgccgccacgagttgccaccaaagcttgccaccgatccgccaccaatccgcgaggttgcaactcgcgaggaagccgtggtgtagactatcgagcatgttgagttgtgatccaaattcatttgcatttaataaaggctatcgtcatctcttttagggttccaccatatatatgcctcttgtatgccgccgtgcggcgatgtaatctcacctcagatatagtgaagatattttgctggctgacgctcgtggttttttctctctcctgttttgggagggttttccacgttaaatctcgtgtcttctgtgattgatctattgttctttatcatttgttcgcttatcgtttcacaacaagtggtatcagagcttgttcccacattagggtttcgcgatggcgtcgatgaagtatgatctaccgctgctagactacaagacgagattcttgctgtggcaagtcaagatgcgggttgttctggcgcaaacttcggatcttgatgaggcgctagaaagcttcgggaagaagaaatcgactgaatggaccgctgaggagaagcggaaagatcgtaaggctctatcgctgatccaacttcatctatctaatgatattttgcaagaagtgttgcaggaaaagattgctgcagaactttggctcaaactggaatcgatctgcatgtctaaagatctaaccagtaagatgcatatcaagatgaagttgttctcgcacaagttgtaggagagtggttctgtgttgaaccacatatcggtcttcaaggagatcgttgccgacctagtgtcgatagaggtacagtttgatgatgaagatttaggtcttttactgttatactcactgcctagttcatatgcaaattttcgtgacaccatacttttaagccgtgatgaactaaccctagcggaagtttatgaggcgctccaaaacagggaaaagatgaaagatatggttcagtctgatgcgtcgtcctctaagggcgaagcattgcaggtcagaggcagatttgagcagaaaacctacaacgacagcaatgatcgtgacaagagccagagtagaggccgttccaagtccagaggtaaaaagttctgtaagtattgcaaaaagaaaaatcacttcattgaagaatgttggaaggtgcaggataaggagaaaaggaaatctgatggtaaggcctctgttgttactagtgctgaatactctgattcaggagattgtcttgtcgtttttgctggttgtgttgctagtcatgatgaatggattcttgatactgcatattcgtttcatatctgcattaacagagattggtttagttcttacaagtctgtgcagaatggagatgttgtgcgcatgggagatgataacccacgtgagattgtgggcattggctccttacagatcaagacacatgatggcatgacacgcacgctgaaagatgtgagacacataccagggatggcaagaaatctcatctctctcagcacacttgatgtagaaggatacaaatactccggttcaggtggagttgtaaaggtatcgaaaggttctctcgtttatatgattggtgatatgaattctgtaaacttatatgtccttagaggaagtacattacatggttctgttaccgctgctgctgtttctaaagatgaacctagtaagactaacctgtggcatatgcgtcttggacatatgagtgaacgtggtatagcagaattgatgaagaggaacctgttggatggctgcactcagggtaacatgaagttctgtgagcactgtgtttttggtaagcacaagagggtaaaattcaatacctcagttcatcgcactaaaggtatacttgattatgtacatgctgatttgtgggggccttctcgtaagccctctcttggtggtgctcgttatatgcttaccattattgatgattactctagaaaagtgtggccttatttcctgaaacataaagatgatacatttgctgcttttaaagagtggaaagtcatgatagaaaggcaaactgaaaaggaggtaaaagtacttcgcactgacaatggtggtgaattctgttcggatgcttttgatgattattgcaggaaggaaggcatcgttaggcatcacaccatcccgtacactccacagcagaatggtgtggctgagcgcatgaacagaaccatcatctccaaggctcattgtatgctgtccaacgctcgcatgaacaagcgtttttgggcagaggctgctaacaccgcctgctacttgatcaacaggtcgccttctatcccacttaataagaaaactcccattgaggtatggtctggtatgcctgctgattattcacaattgagagtttttggatgtactgcttatgctcacgttgataatggaaaattagagcctagagctattaagtgtctgtttcttggttatggttcaggagtaaaaggatataaattatggaatcctgaaactaataagaccttcatgagcaggagtgttgttttcaatgaatctgttatgtttaatgatagcttgcccacagatatcataccaggtggttctgatgaggagcagcaatatgttagcgtgcaggtggagcacgtggatgatcaggaaactgaaattgttggtaatgatgttaatgatattattcagcactcacctcttgttttgcagccacaagatgaacctattgcacatcgcagaacaaagaggagttgtggagctccagtctgccttattgaggaatgtgatatggtttattatgcttttagttgtgctgaacaggtggagatttctcttgagccagccacatatactgaagctgttgtgtcacgccccgaactagtaccgaccggaactagcccttgacgctccaaattaacctgttgatcgataccagtcccaggaaacagtactggtatcacaggaagacggattatcacagcaacagaggtctctttattatagagtagaggtacagtcatgttgggctgcggacagatcccgagctcacaactgcattacataagggaaacggaagccaggacttggaccaaacaacacaggcgcgacttgggaactaggccgaaaccctaaaactcatcgtaaccggcttgctcctggaaaaactcctcatcagcaggatctgcttcatcttcatcagcaactggggggatatttatatagagcaagggtgagtacgggagtactcagcaagccaggggaaataagtgtttaatgcaggcttcaaggaaaggctgttgttttcgtaattgattttatttgaactcttttctaaaaacatctaggtgagtgcttctcaaacgacacggttgagatagtgcgtcccgaccggtcggagtatgtgcaatgtatcaatctttagatcttaaaacaaggttggcacccggccaacagcttttcaaacggccacccaggccaacaacttttcaaacggccacccgggcctagctgatcccgtcagctgctgatttttcaaacatcgaaccccttttcacaacagtaatttcacaagcagttgtcaaacaaaactacgctaggaatcacctcacatccgcccatgaccgtgggcatggctgttcgaacagtttgttaacctctgcagaggggtacactttacccacacgacattactaacccggatcacccagcccgtggggatcagccacgtcgggagacctccaagctttcatgacaaggcatttccaaagccgacacaggcttaccatatgccgacgagaggggtcccagaccaacaacaggttaggtcccagaccatactgtgccaggaagcccaggggggtcctctccgacaccaccccggcgaatccacatgtccctcggcatcatggctcccctgataagctagttactcagccaggggtgtcccattccacccatgtggtcgtacttgtcctatgttcggatgaaattccaaggaatcggtccttaagtgcgggagcgggaaaaccgtacacccggtacgttccccggtccgcggttttagaagttcatttagttcgcaagcaccgacccaggtgtcgggttttctaagtcttttgtaaaacccaagttttacccaagttgtttttcagattttaagttttgaagacgaccgtcgatactcgcacagagtgcacgaatatcgaggcgcaactgggtggttacaaggggacatggtataacaattaacaaaggaaggatcaaatgcaacaaattaggcagatccgccaatctgccttgcagacgggacaacagattaagtgcgatcctatcaatgcataatattttgcaagcaatataattaaatttcaaatataggctcaagatgttcaaaggtggcttgccttgctcgagatctggagcttgatcctcgaaatcctcgcactgtgggtcttcgggctccggaactacacgcgaaacgggacaactcaacaaacggcgaaaagtaaagccctattaatgacctctaagcgtgccatagatagatctcgagatttggggaattttggaagttgaat

SEQ ID NO: 80373 - DNA, 9759 bp, Oryza sativa
ggttaggttgtgttctgatgcaagatgggaaggtggtttcctatgcatcttgtcagttacgtccgcatgagaactaccctactcatgatcttgagttagctgcagtggttcatgcgttgaagatttggcgtcattatcttttcggtactcgtacagaggtgtacacggatcacaagagtttgaagtatatctttacccagccgaatctgaacatgagacaacggagatggttggaattgattaaggattatgacatgggaattcataatcaccacggaaaggctaatgttgtagcagatgctctcagcaggaaaggctattgcaatgctacggaaggacaacagttgccatgggaattatgcaaggaatttgaaagactgaatttgggaattgtcagtagaggttttgttgcaactttagaagcgaagcccactctcattgaccaggttagagaagctcaaatcaatgatcctgatattcaagagatcaagaagaatatgagaagaggaaaggctatcgggtatttggaagatgagcaaggaaccgtatggttgggtgagagaatctgtgtcccagagaacaaggagttgaaagatgcaattctgaaggaagctcacgacactttatactccatttaccctggtagtaccaagatgtaccaagatctcaaggaaaaattttggtgggcaagtatgaagtatgaagtgtgagatagcagagtatgtagctgtgtgtgatgtttgtcagcgagtcaaggcagaacatcagaaacccgcaggtttgttgcagcctttgaagataccagaatggaagtgggaggaaatcggtatggatttcatcactggtctacccagaacgtcatcgggccatgactctatttgggtgatagtcgacagacttaccaaagtggctcatttcatcccggtgaggacaacatatttcggaagccgtttggcagaattgtatatggcaaggattgtgtgtttgcatggcgttcctaagaaaatagtatccgatcgaggtagccagtttacttcaaagttttggaagaagcttcaggaagagatgggttccaagttgaacttcagtaccgcttatcatccgcagatagacggacaaaccgaaagggtaaatcagattttggaagacatgttaagagcttgtgctttagacttcggtggaagttgggataagaatctgccttatgcggaattctcgtacaacaacagttatcaagctagtcttcagatggctccttacgaagcactgtatggtcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtatcttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttattaaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctctctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggttgccgtcgcgtcgccgtcctcgtctgccacttcaccgtcgctgaagaccgccggagcaccgccgtcgtcgtcaagccgaagaccgtcgccgcttcttcctcgtcgtcgccgccgtccgttgtttctccgccgcttctttggtcaccggtgagttcgccgcgtcgcgctctacgtcctggtgccttccgttcgtgccgaagcgccgtcgttagctggtgagtgtgcgccgtccgagctgccgagccgccgccgatggtgacgtcatcgccgacgtcatcggggccgtctgccgtgagccgccgtagacccgatcgatctcggccgtccgttttggatggattgatctcggccgttcgttcccgtgaaccgttgccgtgcacccggtccaccgcaaaccctagccgctgacgcaataattcccttttccttttcaaaaataattcattattgcgtcataattcaattaaaatccatataagtgttttaatccggtttaatctttaaaaattcataactaattcatcttagctcggatttagttggttcaagtttctaaatttttctaaaattgagatctacatgttaaaaatatccacatgtactattcatgcttgtttatgtgctgttttggtgtttttgctcttttctgtttagattccgacgtttccggagagtccgttttcgcaggagaagaatttgaagagttccaaggccagcaaggcaagtcacacagatcccaaataaccctttgagcatgttgatcctatttaaagctactgtttctattcaactattgcatttattttcgaatgtcattgggtggaattaacctattgtttgttatagcccttttgttcttgattactttattccttgatactttgggttattataacttgactagttgggctttatatattggttcaactagatgtattagatataattgcttagccatgcttagaaacattagcacacttttgggataacttatgattcactattaattaattaatgatggcttaacgatagttcacgatggtcaatcgtgattggttaattaattacttgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggatgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaatggttgggcctatgcaacagggtatgttctgtagcgttggattaatactgtttaattaatacttaactgttttatcaatttctgaaatatttgttaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtgaagctgttggtgtggaggattaggtgtaaccctggtcaagctgcctgtggagtggagtcgtctgtgccgtttatcttatttttccgctacttagatctttattgattgagaggaactatctacctctgtaatgacattttattcgcttattatttagagtaataattgaactctattatcaatttgttattgtgtgcctcggctgattcctggacgagggttcacacacatgtaagcgtttggaattttggatagaaattccgggcgtgacaagggaataagaaaagaaaaagaaagaattgaatttccagagattaaataatgcttgtgctcatttttagttggttaaaattatttctagagctctgaaaattccactaaaaatcttgttagcatatttcgacatgtagaactcaagaaaaattccacatgccaatcccaattattatttgcattaatttattagggtttctctcttacttttacaccgatatttcctctaggtaatttataaattcaatttaggcttgggaaagaacttcagggtttgacaaacctacctcccttaaacggaatctcgaccccgagattcggaagagctggcgaagaggtgcggatgggcggcctttaactcatcttccctttcccaggttgcttttttttctgagtgatggctccactgaaccctgtagaacctggtgaccttgtttctagtccttctttcactggtctcaaggatacgaactggcttttccacataagtcagatcttcttggatgtcaatgtgctccgaatcggcttgttcttcgggtaccctcaagcacttctttaactgggacacatggaacacgtcatgaatgccgatcatgttggatggaagttctagctgataggcaacttctcctcttcgttccaagattttgtacggtcccacgaagcgtggtgccaacttgcctttcgtctggaaacgatgcactccccggagcagagtaacacggaggtacacataatcccctgcttcaaaagtgagctcccttcggcggttgtccgcgtagcttttctgtcgagactgggcaattctcagtctctctctgacggttctgactttctcttctgcttccgttagcacttccgttccgaacatttgatgttcgcctgtttgatcccagaagagaggcgtgcggcacttccggccatacaacgcttcgaacggtgccatttgtagactggcctgatagctgttgttgtacgagaattcagcataaggcagacttttatcccatgccccaccaaatcgagcgcacacgctcgcaacatgtcttccaagatctgattgaccctctcggtttggccatctgtctgcggatggtaagctgtactgaaattcaaacgggtccccaattcttcctgcagtttttgccaaaattttgaggtgaactgattccctcgatcggatacaatcttcttgggtactccatgcaaacacatgattcttgagagatagaactctgccaaccttttgcctgtataagtagtgtgcactggtatgaaatgagcaaccttcgctgtcggagatttagatcaggttgggtgaagatatatttcaaactcttgtgatccgtatatacttcgcagcggttgccaatcagataatgcctccagattttcaaagcatgaaccaccgctaccaattccaagtcatgtgttggatagtttccttcatgtgggcgcaactgcctcgaggcataagcgaccactctgccctcttgcattagaacacatccaagcctgtgacgggacgcgtcgcaattgacttggaagtccttcatctgatcaggcagaatcagaactggagcagacactaatttcttcttgagctcctcaaaactcttgtcacactcggccgtccacttgaacttttcttctttcttaagcaactgagtcataggtctggcaatcctagagaaattttcaatgaaccgacggtaataacccgcaagtccaaggaaactccgaatctgtgacattgccttaggcggggtccacttggtaactgactccacattcgacggatcgactgccacgccctgagctgtaatgacgtgacccaagaatttgacctccgataaccaaaagtcgcatttactgaacttggcatataactggtgctccttcaacttctcgagtaccagacgaagatgttgctcatgttcttcttcagactttgaatagatgagtatgtcatcaatttataccacaacaaacttatccagaaattccatgaacaccttgttcatcaggttcatgaagaatgcaggtgcattggtaagtccaaaagacatgacagtgcactcatacaacccataccgagtggtgaaggctgtcttggaaatatcctcttcccgaattctcaactggtgatagcctgatcgcaggtctatcttagaaaacactttagctcctttcagctgatcaaacagatcatcaatccacggtaaagggtatttgttcttgattgtgacctcattgagcgcgcgataatcaacacacattctcttcgtcttgtccttcttctccacaaaaatgaccggagcaccccaaggtgaagtacttggtcgaatgtaccctttctgcagttgctcatcaacctgcttcttgacctctgctagctctttggctgccatcctgtacggtctcttgtaaattggagcagtccccggtgccaaatcaatccggaattcaatctctctcttgggtggcatggtagtgaggtcttcggggaacacctctggatactcgcagactatggggatatcttccaatttcctcgaactcttctcctcggtggccacagggttttccacctcaatctgatttaaggagattccctgcttcggtgagactggtgacttgtacaccacggtttctcccttctcattggtcaaggtgactatgcaattcgcacaatcaatgactcccttgaacttggtcagccaatccatcccaagaatgacatctaggtctttggattcaagaaggatgaggttggctagaaattatgatcggtgtattcctattagcactgaagggctataactgaccgaggttgaactatttcccggggtatgaaccctcattggtgtactaagctcttcttttcttaacccatgcatcccaacaaacttctttgaaatgaacgaatgcgttgcaccagaatcgaaaagtactgttgcagggattgagttaacaggaaacgtacccagtatggcctctggtgctgcttgcgcctcttctgtggacgcgtggttaacacgggcttaagcaaaccttggcccggcacgccttggcttcggacacttgtcaacaaagtggccatgctcgccacagttgtaataggaccctggctttgttccaatctccttcttggcttgggctaatggagctgactgtgctggtgccattggtgggcgcggagctgcactgcggttgggctgacctccctggtggctctggctgccacttgcgccctggtggaaactgcttgagtttaacgggcgatgctggcggacaatcatggtggtaggtccaccctgctgtccgggtgtgaagcgcggtcgctgatggcttccttggttggaccggaactgagctacctttctcttcctgtccattttgttacattgatcctcctgacggattgcgttgtctaccagcttctcgaagtctgcgtaatccctggagatcaactggatggtcagttcgtcatccaggcctgctaggaacttctcctgcttctctgcgtcagtgcgaacattctctggtgcataccgcgctaggcgattgaactcatgcaggtactcagtcactgtcctgttgccctagtggagtgctcggaattccctcttcttctatgccacaaccccgtctggcacctgagccttcctaaagctgcgatagaattctgcccaagtgacctccatacctggcggacgggtagccatgtggttgtcccaccaagctgacgcgggaccctggagctgatgtgtggcgaaggcgactttctcctgatcattgcactgcagaaggttgagcttcttctctatggcatggagctagtcatttgcctccatgaggttgttggtgctggagaaggtgggtggcctgacgcgtagaaactccggcaacttggatagagggggagggggaccaaactgctgctgctgctacttggtttgctgctacatcctctggtgcatctgctggtgctgctgctgcatctgctgcatcatggctgccatcatctgagtctgatgagccattacttgggccagagtcggattctcggggagcggtggcggaccattgacggagtcgctgttgggatgcccaccgtcggtgcgttcttcgccgttgctgccctcacctgctgcacggctgccattcctggtgttgaccatctgaaggaagagcagacggagggggtggaaaagaagaaaaacagatgctcaggaactaagctttattttataggaatttaaactgcaattgttctgatcagaattaaaacacttaaaacagcaagcaaaatacttattaggatagccatatcataggcacatgatatcgaccgtcgactgacccacaagcgaacaaacctaaacacacaaactaacagacaaaaactaaacagtcgataaactaagggaaaacgtgcctaatgctcggaacggctcctgcggtcggtggagtcaaaggcatcctcctgctcgtcaccaggtccctctgagcggctcctggagtctggcagatacgtctcgccggtgcccggctctgtgccactagaactgctgctgctgtggtcgcggctgccactgggagtagcaggcaaccaacctccgttgccactggctggacccctagcggctgacgctggagcaaaggagagagcagacgcaggagctgacactgggactggagctggggctggagctggagctgcgggcactgcaagaactgctggaggtactggaggagctgcgggaggaggtgggttcctaggcgcaagctgaatgcgcatgggtacagtcgtcaacttgaggggcgtggtgcggatccggactcctcctgg

SEQ ID NO: 80374 - DNA, 2705 bp, Oryza sativa
ttttgttcttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctttctctctatctcgatctcgatctctctctctctctccacggccgacgaccggcttcgacgcggcggccgctgccgacaacgccatcgccactgccacgaacgccgcccccgcctcgagctcgccacgccgccgcgccacgccgccgggccactacgccacgccgccgcgacgccacgccgtcgccactgcgactccgccgccaccgcctcgagctcgctatgccacgccgccgccgccgcgcgccgccgccgcgccccacgccgccgggccccgacgccgccgccgcgcccgcacgccgccgggccccacgccgccgcgcccccacaccgccgcgccagcacgccgccgggccggcccacggcgccccgacgccgccgccacaccgccacgccactgccgcgcgcgcccaacattgccgaacgtgattgaaacgtgaccgaacgtgaacgaacgtgaacgatacgtggacgacctttgaacgaacgctgaacgaacgtgaacgaaacgttaacgaacgcgaacgaacgtaacgaaacgttaacgaacgcgaatgaacgtggacgaaacgttaacgaacgcgaacgaacgtgaacgaaatgttaacgaacgcgaacgagcgtgaacgaaacgcttacgaacgtgaatgaaacgcttacgaatgcgaacgagagcgtgaacgaaatgattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgact

SEQ ID NO: 80375 - DNA, 8280 bp, Oryza sativa
cctcgtccacccttccgtttcggtcgccgaccgccggaacgccgtcgaccccgtcgacccgatccgcgctgtcgccttccctcgctccgaccgccttttttgtcgtcgccgtcgacctagggtgagccatggaccgccgcctcttttcccccttcccttcccctctctcggccgccgctccgccgtgcctatggccgccgccggcgaccataggggcgcgggcgctgcctcccgccggctgcgccggccttggccgccctcgggcgcgtcgagtggctgccgcgtggggcccggccgtcagccgcccgcgcccttaggtgcggctgacgcgtgggacccacggcgccggccggtgtgagcccgggtgcacccggtccaccgtggaccgtgaggctgccgcgtggggtggacccggtccgctcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgggctttgttcctgcttgttatatggagtttattagagtaaaagccttttcttttccgttggtcgtgtagacgctgcagcttcggaagatccgctcttcgtggaagttgaagccgacgtttgggaaagggagcaaggcaagtcacatcatccttgaacatattgaatcccagtttataaagttattttgatttaaattactgcattatcgctttatttaaattcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaaggaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacatgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctaggttggcttgggacgagctgggacccagggtcgggttgccagttcggtctgaatcatcgtaggccttgggttaaggcaggttcgtgtgggttcatggccttgtttaataatattgtatagctctaggatcgtatttacaaaatagctttgagcaactaaatgtcttttaatgttgtttgctgcaaaccctaaccctttatattataacccccttgtactcccttgcatttatcctgcacttgtgggtgtgtcttgttgagtacggtggttgtactcagtcttgctcaatttttcccaaacccagaagaggagcccctggatgaggaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttaaactctgaactgtgtcaacttttggtgtaccttacctcccgggacaaggaataatgcacacacgtaaggaacgcccgttgggttaattctggtcgtgacaatgcccatgcacaagtgtcacacttcaggttgtgtgcggccaaaaatcctttcttatttgtaaaaatcctttagtctctctctgtcctgctgcttcatttatcgtcaaaatctgatctttaaaatgttgcttttctcttttgtttgaagatggccggcagcatcaaccgtcgtggtctggacctgaccggcttcgttttggagctgcggggcatgtgcgttgtcttagggtattcgcatggagtggactaccagggcaagcagctcccggagcaggagggtgacgatgcagagccccacgctgcttgggaggttactgtagtgatcctcactggctcacccgagaggacttcgttggcagtcaccgtgggtggagattctttctccgccgcttgccagaacgccgctctccttgccatcggcactcttcaccagctctacccggacgagttgcagcactcgccctaccgctaccaccctcgccgcggaggagcccgcgactacgccaccttccgggatgctagctcggaggatgacgctaccatcaggcacctggcacgcatggtggaggcgtacgacgcggcccgtatcgacttccatcagatggtgcgtcgcgggttggtcgagaacaacatgaagatcctggagctgcgtcaggagaatctgcagctgaagaaggacctagacgcagtggaggcgcagctgcgtcagctcaagatcgcccagggagaggtcggtcgccccaagtgtcgccgcgtctgccgcagcctgaagatcactgcccgcaagagtacctccaggcccgagcttgttcgtcagtccctggcgtggacctgcttcgtcgagaccccttgtgccgagcccgcgcccgtggttcctcaggaggatggagcctccggcgttggcagcacggaggatgcgctgctgctcaccttccgccctggcccgtcgcagcagtagacgagcagttagtaggcttgcgtgtgtgttcttctcgtttgtttttctgctagagtcgtatggggcatggttatgccggtgtgtggtataactgtgtcggagcctgtctttattttatttgcttaagcaacttgaactttaatggaccaatttaatagcagtaataaattcaagaattatggtagtcgtgggtggttagttttaattgtcagctctctctgtttgctggttctgggtggggttttcagatggtgacaaccaggagaagtgctgctaccggtgaaggcagtcaccccgaaggcagcaaccacaacaaccatggcagcccacctccacctcctccccctcctccaccaccaccaccagacaccaacgccatcctcacccaaatcctcgcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcgttggattggttgcatgccgtggggaaaaagttagacaccgtgcagtgcagtgatgaggagaaagtcatcttcgccgcccaccaactgcaggggcccgcatctctatgttgggaccatttccaggctacgcagccaaaggggcagcctattacttgggcccgcttcaccgccgctttccggagaacccatgtgcccgccggagtcatggcccttaagaaaagggaattccgagagttgaagcaaggcaaccgctccatgatggagtatttgcatgagtttaacaacctggcccggtacgccctggaggatattcgtgaagatgaggagaagcaagagaagttcttggcaggaatggaccctgagctgtccgtgcgtcttgtctccggggactatccggatttccaacgtctggtggacaagagcatccgcttggaagccaagcacaaggaactggagtcgcacaagcgtcgcttggcgaatttccgcaaccaacagggggctaaccaaagggtccgctacaccaatccctatccagggggatcctccttgcagcagcaacagcagcaacaacctcgctccgcgccccgacctcaattcgtggtgcgtgtcccacagccgcagcaacagcagagtcagcaagggactcgtgcgccccgtcctcctacgccagctgtgcagcctggtcaaggccgccgggacgctcaaggtcagcagcgtctgtgcttcaactgcttcgagcctgggcactttgcggataaatgcccaaagccgaggcgccagcaaggccaagcgcctccccgctccaacaacggtggtaaggatgtcattcggggtcgtgtgaaccacgtgatggccgaggacgtgctgacaactccagacgtcatctttggtacgttccccattcattccatccctgctaccattttgttcgactctggagcttcccactcgtttatgtctgtgccattcgtggggagaaatcagttgggggtagaaaggcttaggaaccctctgctcatcaccacccctggaggggttatgacagcaaagtattatagccatgccgttcctatagaaattcagggaattccttttctctcggatctgattcttctagacaccaagaacttggatgtgatccttgggatgaattggttggctcaattccaaggagtagtggattgtgcaagacgcactatcactctgtaccgagggccggaacaaccggttgttttctttgcacccccaacctctgtcggcagttcagaacttcatcagataaaactgtcggaaatccccatcgtcagggagttcggagacgtgtttccggaagaactacccggtatgccgcccaagcgagagattgagttccggatagatcttgctccaggaaccgctcctctgtacaagcgaccctaccgtatggcagcaaatgaactggccgaagtcaagaaacagttggaagagttgaaagaaaaggggtatatacggccgagtatttccccctggggtgctcctgtgatttttgtggagaagaaagacaagacgaaagaggatgtgcgttgactacagagctctcaatgaagttactatcaaaaacaagtaccctcttccccggatcgatgatctgttcgatcagcttaaaggtgccacggtattctccaagattgatcttcgttccggatatcaccagttgcgcatccgtgaagaagacatcccgaagaccgcattcaccacgcgatacggactgtatgaattcacagtgatgtcgtttggtttaaccaatgctcctgccttcttcatgaacttaatgaacaaagtgttcatggaatacttggataagtttgttgtggttttcattgacgacattctggtgtactcacaattagaggaagaccatcagcaccatctccgtctggtgttgggaaagttgcgggaacatcaattgtatgccaaacttagcaagtgtgagttttggttgtccgaagtcaaattcttaggacacgtgatatctgctaaaggagttgctgtggaccccgaaacagcgaccgccgtcactgattggaagcaacccaagacagtcactcaaattcgcagttttttgggtttggcaggatactaccggaggttcatcgagaacttctccaaaatcgctcgacccatgacacagttgttgaagaaagaagagaaatttgtgtggagcccgcaatacgagaaggcattccaaactctcaaggaaaggctggtttcctcgccggttttaatcttaccggatactcgcaaggacttcatggtgtactgtgacgcttcgcgccaaggattggggtgcgtgctcatgcaggaaggtcatctggtagcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggttgccgacgctctatgtcgaaaaagccattgcaacactcttaacgtccgtggcattccagccaaacttaatcaacagatggaagccctgaacctaagcatagttggtcgtggattcttggctacgctggaagccaagcctaccttgctcgatcaaatccgcgaggcccagaagaatgatccggatatgcgtggactcctcaagaatatgaaatagggtaaagccgctggtttcacagaggatgaacacggaaccctatggaacggaaatcgggtgtgcgttccagacgacaaagaacttagacagctgatacttcaggaagctcacgaaagtccttattccatccaccctagcagtacgaagatgtacttagacttgaaagggaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccagggcggttatgattctatatgggtagtcgtggatcgactaaccaaggtggctcggtttattcctgtgaagaccacctatggagggaacaaactagctgagctctacttcgctaggatcgtgagtctccatggcgttcctaagaaaattgtatctgataggggaagccaattcacctctcacttttggaagaagctccaagaagagctgggtacccaattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccctatgaagcgttgtatggacgcaaatgccggacaccgctattgtgggaccaagttggggaaaacaagtgttcggggctgatatcctgagagaagctgaagctaaagtcagaaccattcgggataatctaaaggtggcacagtcccggcaaaagagttatgcagataaccgacgccgtaatctggaattcgtagtggatgattttgtgtaccttcgggtcacgccattgcgaggtgtacataggtttcagacgaaagggaagctcgcacctcggtttgtgggtcctttccgtatcattgctcgacgcggggaagtcgcttaccagttggagctgcccgtttccttgggcaacgtgcatgatgtgttccatgtgtcgcaactcaagaaatgccttcgagtgccgtccgagcaggccgactcagagcagattgtagtttgcgaagacttgacctacgtgtagagactagtgaaaatcctggacaccatggagcgcaggaccaggaaccgggtaatccgtttttgcaagatccaatggagcaaccacgctgaggaagaacctacttgggagcgtgaagacgagatgaaggcagcccatcccaatctcttcgccagttcttccgaatctcggggtcgagattccgtttaaggggggtaggtttgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctatccct

SEQ ID NO: 80376 - DNA, 653 bp, Oryza sativa
ttatccaattattagaaggttgtaccagatgaagatgagcatctgaacgaactcctccaggtatggtggtgtttattctgcaacattttgtttcttttcaattttgtgaggattgtgcagcatttttttgatacgagattatctgaattacatattgaatctgaataattgcttcaggaagaggaagatttggtgtctgctcatcggaagcaggtggaagagaccctagacatgatcaaagaggttagatccctgaaatggtaaattgtcaagtggtttctattatcgtttttttccataacaactgagattactgtcttgaactcttgattaggagatgaatttattagttgaagcggatcaacctggcaaccaactagacgactacatcacaagactaagcggtatactctctcagaaagctgccggaattgtcgacttacaggcacgtcttgcgcagttccagaggcgcttaaacgagaataatgtgctgctatatgcccaatgcccttgatcaaaggaagtacctatttgtgatgagaataacgtgcagtatatctgtataccagagcccttgatcagaggagttgcctatttgtcttcactacgaggctaatcagaaaagtggctgtgccactgtttgctggtatgct

SEQ ID NO: 80377 - DNA, 5775 bp, Oryza sativa
tcggaggtcgaccacatgccgccgcctccgccacggggtccaccaatgcccccacgccacaggagcagaggtggagggcaagggacgccaagctgtccgtgctcgcgtcggccacccgccctgtgaccgcccgagccgccgtgttctaggggccgtcggacgtgtcgtcggcggcggggtgcggcgttgtgttcttgcccacgtgcgagctgcgactcggtggcaaccggctcgcaggcctcctcttccccctctcccgccagcgcagcctgccgccttgaggggcttcatcaacatcctcatcttgccgccgcactcgcggcacccatgcttccccgaccatgatgccaccacctccgccacggcgttcgccgaggcccctgcgccataggagcagaggcggagggcgagtcctcggacgcgtcatcggcggcggagggctgtgactcggcggcaaaaggcttgccgtcctcctctttcgccctctcccgctggcatggccgggcgctgtggtctcctcctccgcggcagcggcgggggcctcctcccccgtggcaactgcaggaggactccgcctcccccatccgcgcgccggccgagaacagaagcaaggagagaagaaaaggagaagaaagaaaaaaaaaagaatagacttggggcccacatcattttctctcacttacatgtgagtcccacatacttttttttttctgactaggatgccacatcagcgaaaccagacatctagacctaaattgcatggttttgtatagtttagtggtgaagatttctcatattgtgaattagggatatcaaactaactcggtgtaaaattgagggacggcaagtgaacttattcagtgcacgcaactgtataaaagcccataagttgcatcttttcgttgggctattatttttgctcactgctgcaaagtgccactattttggtgtggtagcaacaagttttaccactccacaagtccacagttcaaaacggtaactctgattgttcagtagtgttctttgctctaacatctttctttttccaaccagtctaccgatagcggattttaagctctcaaagtaacgtttttcgttgtttgtatatcacttaaatagttataaaaaaatttaaaaataaattagagtaaattgcacccacggtgtatcaattgtcaggtgggtgtgcaatttgatgcaataacttgagaaataagcgttctaatgtaataacttggcacgtatgtgcaatttagtataagagtttttataagtgatcgcataaaatacagcaacttgcaagatatgtgcaaatttgatataataaattaagaagttatgcgacaacttaattatttggagcacttttttttatacatattcaatttttaagtacttattttgacgatatacttgtggatttgtataagcacattcatattttttatcctcataactaatgactaaaagtgaattaaacatctaattattatagttcggttgagatttagaaaggtgaaggaaacagaaattcttaaaggtaattagatgtgcggtataattcttaaagattaaattcaatatgataaagtaatatccgtaggattgctatgtaatggcatattgacatcgtaaagaaaactcacatagcatatgtttagccaagttgatgcacaaaaatactaaattgtcaagtttttgtactagaacgcatccatttgtcaagttgttgcactcggacgttcaagtctcaagttcttgcactttatcgcacccacatgccaagttgttatatggtgggtgtaatttacacaataaattaagatgtattaacatgtgatatattactataccaacatctaacttaaaattcaatttctacatattaaaaaaataaatttgactattaatatacgttaactaattgttatttaatttatttttttcgttacaacatgtagaagttgaattttaagttgcatgtttgtgaagatatatcacatatcagtacgcctacttaatgttttttcaaattttttcataattgtttaagtgatatacaaacaacaagcgaatatcccctcgagaatttagaataatttcccccagtctaccctcaatcccatctcccctatattcttccccaatccgggcgactgagctcagaggcagttgcacatcactacgtcacctcccaaaatgatcctagtaatttcctaatccatttggctattggtgcggccgcctagtcctgcagttttattaggaatagcaattccgtttattaaactcccccgcacgagtgacgagatgccgctgcgccttgcttctccgtgaaacaacccccggcatgactccccagcgatacgtccacacacacataccacaagtagagttccaaacttgccatatttcccggttgctgatcatcaatcatcacttcatcagcgcatacgtccggaacgtggatgggaatttgaagcttcgctacattccaccctgtttctcgcctcttgtcccctgcatcaacgcgacgacacgcccaaatctctatctgctaacgcgatgctactcctcccgttctcctgaactcatcaggccagggccagccacgcatgtgagttgcagccgccagtcaagcccaggtttcggctgcactgcatggatcgagcccgactgccgcaagcaatctcctgaccaacactaccacatgccgacttcgccgcaaaccgccccggctagctagtagtaacatggtgtcacgttcgcgatgggagctagtggctgcgactttggacttcgttactgcaatctcgccaggattctggggaaatccgttacgtgacagttgacacgcaccgcaacctagcacgcacagttcacattcagttgcacctcgagctctataaatggcgtgatgcagcgaagcgaaatatgtcagtagctagcagcgatccgataagtgataatttagtggtgttttcacgcatggctcggtgcagcgtctcccgtgttgtcttgttgctcttgtgttgcatgcatctgtcggctgcagctgcaggagcagcagtgtacaacgtcgagagttacgacgcgagacctgacggccggacggacgcgtccagggcattggcgtccgcctggtccgccgcatgccggtcgccggagccggccaccgtgtacgtgccagacggcgagttctttgtcagccactcggccttcgctggcccgtgttccggcggcaggatgacggtccagatcgacggcacgctggtcgcaccgtccggttacaccggcagtgccagctctggcggggagtggattgtgttcgaccacgtcgacggcctcaccgtgtccggcggcaccctcgacggccgcggtgagtcgctgtgggcgtgcaaggcggccggccacggcggctgcccggacggcgcaacagtacgtacatactacagcgcacagtgtactgatgagcttaattgcagggaaacttaaaaaacatttttgtgttaaaccgacgtgtgttgatgtcgacgtggtgcgtggcgtgcagtcgatgaaggtgctgaactcgagggacgtggtgataagcggggtcaagtcggtgaacagcgagctgtaccacgtcgtgatcgacgggtgcgagggcgtggcggtgcaggacgcccggatcgtggcgcccgggagcagccccaacacggacggcatccacgtgcagtcgtcgtccgcggtcaccatcaccggcgccagcatccagaccggcgacgactgcatctccgtcggccccggcacctccaacctccgcgtcgagcacgtcagctgcggccccggccacggcataagcatcgggagcctggggaaggagagcgaggagggcggggtggagaacgtgacggtgagcggcgcggcgttcgtgggcacggagaacgggctgcggatcaagacgtgggggcgggcggcgcgctcgggggcgtacgtgcgcggcgtcgtcttcgagcacgcgctcatgcgcgacgtgagcaaccccatcatcatcgaccagagctactgccccaacgacggcggccaaggctgcccccatcaggtaccgtacgcgccgccgccaacacatcgtatcccatcgccgtcgtgtctaatgaggaggtgtttagataggggtgtaaagttttaatgtgtcacatcaggtattatatagaatgtcacatctgagtagtaccccaaggtcctgggttcaaatctcttatggagcgaatttcagattgggttgtttgcggggctaagttccctatttcaatggccgtatatatcagttgaatgtagaggccgggtaaaaaatactcttctctaaaaaaaatataaaaaaaattatatagaatgtcacataggatgtttgggctagtataaaagaactaattacagaatccaacagtaaaccgtgaaacgaatttatttagcctaattaatttatcattagcaaatgttaattgtagcaccatattatcaaatcatagagcaattaggtttaaaagaatcgtctcgtaaattaatcgcaatctgtgcaattagttattttttagcatatatttaatatttcatgcaggtgttcaaacgttcgttgtgacataatataaaatttttgtgtgggaactaatcaagggcatgagttgttttttttcttgcagagctccgacgtgcagatcagcggggtgacgtacacagacatccagggttcgtcggcgtcgcaggtggcggtcaagttcgactgcagcgcgagcaaaccctgcagcgggctcggcctgcaggacatcaagctcacgttcgacggcggcaagccggcggaggcgacctgccaacacgccgacggcacggcctccggtgtcctcatgcctcccagttgcctgtaacgctttaccgccaaattggagaaacaattcttgtaaaccgagtactcactatttacacatggacgaagatacaacggatagtatagtgaattagtgatattaacaagatatttgattcggtccaacaaaaaacggatagtatagtgaattagtgatattaacaagatatttgattcggtccaataaaaagtacctcgacgtaccggtagtccggtaactcacagtactagatccaacgatcggaaataatttggtaccgtgaggtcctgtacctcgaggtactttttgttggaccggagcaaatctctattaagaaacttcaacgattccagctctaatcagtaatcgaccaattgtattcccgaatcaagaaggttcagcattattattcaataaatcaactagggaatgacaatcaaattatcgggtctgacgactactactcctaaatgcctcttttttccctatgttcttctctgcttcagtacatccagtcatccgggggccagatgccaaccacaaacactacaaatgtatatacaagtaatgaattcttcactacaagaagtatgtcagttgctcccgcttcctcgacccgcctttgccgtagagctcattccattccttgatctgattcatcacaacgccttcgctagcgaagctagcggcgacctgcatagtgttcaatgcgcaacagcttagcaatatgttcttgctgtgaaaaggatagctaagataagtacattgcgtgtgtatcatgaagaatccgtcagtgacttacttcatcctttgcctttctcaagtcctccatgtttagcggtctcagggtagtctctccagcatcgcctttgtctgatttatctttcttgtc

SEQ ID NO: 80378 - DNA, 12305 bp, Oryza sativa
acgttccggtgggaggagttcagcctcaacttccacgccgacgagcggtgccggagcggcagcaccgggtgggtgatgcacgagttcgccgtcgtgccccccgccggctcccgcgtcgccgccacccacaccgcctgccgcatcgccttcaccggccacggccagaagcgcaagcgcgtgcccgacggctacgtcttcgtcgacgtccatgtccagaccgccgccgccgccgccgccgtcgctcctccgttgccgatgttgtcctcgtacggtgaaccaccgcacgaacacttctctgacgatcatccgccgccgcattcttacacttattacacccaagaataccagcagttcttgccgccgtcggagcagagcgatcaagaacaggaatactgtgcaccggagcagcagaatttccaagattatcacgtcgcggcggcggagcagaccgaccaagattacttctatacggaaatgatcaaccaagaacaggattacgcataccagcagcagcaacagcatctcttccatggagatttcctcgcgacttcgcagcagtttcttggtcaggatcacgaggtgatgttcactggcctcggtggtggtctcgtcgtctccgacaacggcgagcacgcctccgccgccgcgccggctacagagccgccggtgcacgacgtgttcttggaaactttggtgcctgagccacctgaaaatgcatatgttgacggagcaggggagtccgccatggcatcggctagctccgctggtggcgcgccattattggaacaaccctttgcgacgccgccgcagcagtttcttgatcaggagccggcgccggctggcctcaacgacggcggcgcgatgatctataacaacaacggtgacggcgagcacgacgccgcgccggctgcgcagccgccggcccggtactacagcgggccagttccggcagtggacagcgtgttcttggacaagatgcgggaatatttgatggctgatgcgaagggattatgccgaattgatgcgcccatcaacaatggcgaacacgccgccgccccagcgccggctgcggatgatccgttggctgctcagcacggccacggcgacgcgccgccgctgccggtgccgcccgacgcggcggagctagagcgggtggtcggacatttgttgagagaagtggaggatataatcaaggttgcggcggccggtggctatggaggctcgtcggacaagccgctctccgaatttgacaaagcacaaaaccaaattctggccaagttgatggcagtatttaatcaagtagccgaaagttaatctatgtttacttgttgttaatctctgatgtgacctgacatgatgagaggcgtcatacatctgaaagaacagctctcaccacgttcttttgcttgctggaggcctggagcgatgagatcagtgtgtacccgttctctgtttgtaactggtaggctagaacacgagaacaatcattgagagtgtaaaagatttctctattcttggcagcgtcgacttgtaaacaatgtatttcttttcttgtaaataatctcctgattcactccgagttggctgcaactccaccagttggatttgcacaaatttgtcgtggacacagatttgaggccgatccggcttagttgcgtccctttcctctcctagatctggctaaaggggatcaaggccgctagcagtggcagtagcagagtgagcagcggtgtcggcttccccactcccatccctctcctagatctggtcggaggggaggaggccaccagcggcggtagcaacaaagagggctaacgaccaccactagatctagcggaggatggctcggtgacaatgacggttactgcagtgaggtcgggacggcaacagctactgtggcgagagttgcgaacaagcttgggtgaggcaaatcttccttcaatgaggttgggagaggcggatccatcgctaccaagctcaggagtgtcggatccgtcattaccaatctcaggagtggtggatccaccgtcgatgggctcaggatctaggcggtgacggcggttgaggagacgcgtgcctggggcttgatagcctgccgcaaaggggcagttagcgatggtggatgaggcatgcgcctcggcctcatcctctgttgcagggttgggagaggtggatttggacctcggcaacgacgataggcgttgcgacaacgatgacttctgtgatttgggattgtggattttagggggggttttttttttaagaatgtggatttgggtttctaaggtagattttggagatgggggcatgaatttgtatattttttgtgcaattcttttccctgaaaatccttatcacaggcggtcagctcaatctctctgtgagtgaagtttcttttttactggcagccatcaagatgttgccggtaaagaatggatttcatatgcagataggcacccgccaatgaaaagtttgtatttgcactgaccttcggttactggcgatgccgccggccgccaacaaaaatccattttaggtgtcaatgtaaacccattttgtagtagtgtagtcctcgaagcccggggggaggtgccttcaaccccatcgcatgtagtgagcaacaaccaagcagagggaagggacgtcgaggaggtgttggcgatagagggatgcaaggcagggaggccggaggtatgcggatacggtggcccttagcctccaagtggccggatatggcaacccaatggggaggcaacctttagtgggctcctaggcctcaccaccaaggggaaggccgctaccgtcggtgcccgcgaggctagccattgccgtggtgcccgcaagcctggccattgatacctgtgaggtcagccgcatctgcaacacttgacaggctagccaccggagcccgcgatatcaacgtaggtgtttgtgaggttggccattgcccgtcagccgcctaaacgaagagtgagaggtcggacgaatagtagagagcgagagagcagagaatggggaatagaagagaaagagagcgaagagatcgagggataaggcttgggctgttctcgttttttaaaaaactgaaatcacgtcggcttagagtttagaagtaccggcactgatgttatcagtgttgtttagggcctatttggttctctaccataccaattaattagtagtaccaaaatctaggcaaattttggcactaccaattttttggtagggcaaagttagctagtctatgtttggtttaataccaatataaaaccaaaatttagtatgagagtgaagaagattttagaatgtagccaaattgagcgtggacactaccaattgtttggcttcaatccaaactagcatatttactattaaagttactaaaattttgataaggtcacgttttggcttcaatccaaaacggccctaattgttttaatgaatcgatattgatgtgggtctcatggatatgccatatatttcggtactaattgggagcatgcgagtcaaagagtagcaaaacttatcagggttgggttttgtccaactggtactgataaagggtatcgatatactccctccgtcctataatataatagattttgattttttccttgtactgtttaaccattcgtcttatttaaaaaaattaaaattattatttattttatttgtgacttaatttattatctaaagtacttaagcacaacttttcgttttttatatttgcacaaaattttttaataagacgagtggttaaacagtacaagaaaaagtcaaaatcccttatattatgggatggagagtagtagtgaaagcatcaatcctattcatacaaaacctccttcatcctcaaatattacaacacagttaacaaaaatggcaatatagttgcttacatgaaaataagcacatcgatcgttcgtcttaggccgtgtttagatttttttttttgccaaaaacatcgcatcgaatgttttgacacatacatgaagcattaaatgtggacgaaaaaaaccaattgcacagtttgcatgtaaattgcgagacgaatctttcgagcataattacgccatgatttgataatgtgatgctacagtaaacatttgttaatgacggattaattaggcttaataaattcatctcatagtttacaagcggaatctataatttgttttgttattagtctacgtttaatactttaaatgtgtgtctatatacttcaaaaaatattttggccaagaaactaaacacagccttagactataaatcacgagataagaatagacaaaaatatcctttatacatattcagtggtactctctctatgccataatataggcacggtcaaacttagcacgatctccaaaataacttctatataaaattataaccatataaaactaaattgaaatatcaatgatattattttcagaaaataaaataaaatttatattatactaattattgattaaatattataaaaattaaattttaaaatacgtgcacgtcctatagagcggagggagtataattccagcagtcttaggaattctctcgtcgtaagaaaacaccttcgcatatgtgccgttccccgtgtatttggcccaatccctccctgcccagtaacggccctaaacatacagcaaggccgaatcggactcggagacccaatcccgcagcccgcgagcgcgtttatatagacaccgacaccgggcccccgccttctcaaacacatccttcctgcccgcaaactaaatcccaccggccaccgcctctctcccaaaaaccctagctagggctaatcgcgagggcgagcgagcgagcgagctgcgagcgatcaagaaaggagccccatggcggcggcggcgaggtcgcagggtctctcgccggggttcaagttcaatccgagcgaccagatgctcgtggagctcttcctcctgccgtacctgatcgacggcgagctccccgtccgcggcctcgtcttcgtggaggacgaccacctggggggcctgccgctgccgccgtggatcctcctcgaccgccacggccgcggcgacgaggacgaggcctacttcgtcgccccgatgggtgccggcgatggggcccggcaggtgcgctccgtcgccggcggcggcaagtgggtgaagcagaggtcggaggggaaaggtgaggtggtggtggcccccggcggcgaggcgttcctgtgggagaatttcagcctcaacttccaccgcgacgatcgccggagcggcagcaccgggtgggtgatgcacgagtacatcgtctccccacccgccggctccgccgtcgccgcctcccaccgggccacccacatcgccttcaccggccacggccagaaccgcaagcgcgtccccgacggctacgtcctcgtcctcgacgacgccgtcccccccgccgccgccgctgcagcacctcctccggaatccgagcagagcaatcaagaggagcaagaatacgctgcttacaccgaccaaatccagcagcagtgcttcgtcccggagcagcagatgagcaaccaggaatacttcccggaggcggcggcggagcagagcaaccaacagttcttcgtgccggcggaggagcagagcagccatcagttattcttgccggcagaggagcagagcaaccaacagttcttcatgccggcggaggagcagagcagccatcagttcttgccggcggaggagcagagcagccatcagttcttgccggcggaggagcagagcaactaccaacagttcttgccggcgttggagcagatgacgcagagcaaccaagaatttgcttacggcgagcaaagccagtgctacattgtgccggagcagcagcagctgagcaaccaagaatacgcttacagcgaacaaagccagtgctacatcttgccggagcagcagcagctgagcgaccaagaatacgcttacagcgagcaaagccagtgctacatcttgccggagcagcaggagctgagcaaccaagaagcagaatatgctttcgtctgctacgacgagcagcagcagcagcagcaacagagcaatcaagaagcagaatacgctttcgcctgctacgacgagcagcagcagcagcagcagcagcaatacttacatggagatctcacatcgtggcaagaaccctttgtgacgtcgtcgtcctcgtcatcacagcagtttcttggtcaggaacagctgctgcctgatggcctcctcctcgacggctttggcgagatctcacagcagcagggcgaccaagaatacgcgtactgcgaggaaagccagtgctacatcatgcctgaacagcagcagcagagcaaccaagaagcagaattcgctttcgcctgctacgactagcaacagcagcagcagcactacttccatggagatctcacatcgtggcaagaaccctcggagacgacgacgtcgttgtcgtctcagcagtttcttggtcaggagcagctgctgccggatggcctcctcgatggcttcgatgaggtcgagatgcagaatatcatggctggtttggtcgcaaatcaatctccatagctctggagggggaagaggctgcaatccatgaagatcaacattgtttgttgccgaagcaggggcaaggttgctgacaaggaatcaaagcagcagctgccatgaattagtttatgctttagttgttgtaattaaattactgatgaacggcggcgtctgaaaccgctggctctcgccatgttttaactgagctctgatctgttgtagctgagctcgtaagtatataggttagaactctgcaatcagaagagtagagaattctttattagtttgacaatgtcaaattgtacacaagagcattcagtaaagtaatatatgtaatccattaattggttgtaaagatcattgcaaggagtatagttgcatgaatcttgtatatatggtatctatgtggcctacaaacatgtaacacagctgatatcgctgtgaaagaatatgtatctgcagcctagaatactacccaaagcttctctgtccaatgaggaatccagataataatttggcaacttataatcattgcaaaattgagtaatcttatatctgagtctgctcttgcaaagcaaagcagctccaaaaaattgcaggatgcttgagtaacctccactgcattatcggtttttcttcgaaactttcgggttcttgcacatgcggatgcttgcaggagtaacctccactagctcatcttcttgaataaactctatgcagtcgtccagactgtagcttaacgcttcatcgagaaccactgcagcataccaaaacggatggaaattaatcgtctttctatcaaaagttgggagtttgacagttgatgtgaaacttatgtaacaaatcaatggaaagccagctaggcaggctcacagatgtggaaaggcccaggaagatataggttaacagcatggagtacagagcacagggctcctctgcttgcttcccatgttgcctcctaagctttggtcaggcagatcacaggtgcaagaggattgctagcaagaagcaatgcatagaaggatttctgtgaattcaaaggtgaacgaaggcagcttatccaatgggataagggagaagcatgtcaatatttaggctgttccgagagcccaagtcagaaggcatgaagaaaatggtgactgtgatcgcagtggtaatgtaatgcactaatactagtgtttgttggactctattcacgggaatatgattccacagaggtggaaccagatcggctcacctgggctatggcccagagcctaggccttaagttcaataggctcaaattaaatttcaccatgctaagcccagtatgggccgaaacatgctaggcttggctggcccaggccttggcccaaggctggctccacccctgcgctgccacgagcctgtgcatacatgggttacagttttgcttacatggcttcgaactcactcagggaaagtagagcctgtttatgatgttttggttgcatcaatcaggtcaataggcagtaaagcactaaagcccctccagccagacctgcccagcctcaagatgcaagggtttacttatcaggaaccccaacctaggaactttttggagatatcaactgtaggtttcaagaaaggcatggattatgtgagttggaccaagctagctatggtttagttgaacagctattcacaagagaaaacaaccagtacctaattttcttcaataaaaagatatttctaccaaataatataatcgcagtaacgaatagtggttgcagatgaaaattttacctgtagtttccttgttggagcggacatttgttgcagcctttttcttgcacacattaattgctaaatcacctggtcgctgatggataccaactatttggcccttgtaaacatcctgtcctggactcacaaatagtatacctctttcttgagcattaagaagtgcatacgatgtagtacttccatcctcaaatgcaacctataccatgttatccaatttagatgttgatgaaaacggaagaaaaaaaacttgttgcttgaaacttgaaagtaatgtgtaccaaggagccttgatcacgtgaactaagatctccagcccatgggccatagctgtcaaaaattgtgttgagtattgctgtgcccctagatgctgtcaaaactgcattcctgagtccaatgaggcctctagtaggaatcttgtattttagtaatgttgttccctctggcctgccatttgaaaatgacacttgttatggcaacaactcctctatctcaggaataagcattatgcaacagaaaattttcaaagccatattgtattcattacatccattactgcatgatttcttcatagagtaagatatttgcttcaaaccatacaaataatccatccaaaaattcaatctcaaccaccatctgaaaatacataaaccactcccaacaattgttcttgcatttaattgatataagagggtcagaagttactccgagacacgacagcttagtacactcttgtataaaatgttgaggaaagtcatgcagttctcagagtaatgagacagactcgatgcataaacttttacactctaacttcaatatggtgtttgttggttgcttgattaattcaataggaaatttatacttttttgcgaagatagtattaaaaagttccaacataactctcctccaaaaaaaagttccaacataacttgcaagcatatgaaggaattagagtgtggtacgaacccactaggttgcatgtcaaccatttgtccacgccttttccccaaaagctcaacaactgaacccatatattcctctggaacttccacagcagctatctggaacacagtagcaagaataagttggttacatgaaaactgagggattaggagttgtaggatagtaaaatcaatagcaatactagtgccaaagacaatatttgttgagaaatctctactattctaaaggggagttttgtccgttcgacgatccctaccatccccactagtgcaacaaaaaaaaaactccatctaaaataaaccggtggatgcatcatgcacctgaaaactgctcaccaagaaaaaccgaaacagaaaaaactaaacgtgaactacgctgaagcatggaggggaacattcggcccgtccttcaagatctcgttgcaattgcaacatgcaggcaccttgctacttggtgaaatatacaagtgaatactggcattaaaagaaacatacctcataaggctcttgcagctttccatcaactgtcttgttaatgacctttggaggtccaatcataaactcaaatccttctctccgcctgttagcaattgaggttctttcaagaaaatgccagaagtacatgtcattctggaatcactgaatatgataataaatgcttacatgttttctatcaatatagtgaggtgcagtgtgcctctgccactaacaagaaatgtatcagcagtttccccgtcttctactttcatagctaagttcctttcaagctcacgatataacctatcacggagattacggcttgtgacatatttcccctgtgataaatccagtgagaacggacaaatatttcagcattccagaaaaggaagaaaactagcaacattatatttacaaacatggcattggtaccattacagcaaatgtggtggaaaagtgccactatggataatcttaatttaaataacttgcaagaaggcaagacattcaatcgattttagattaaacaagttcaatttgacaaaagagatttgaatataatttgacagcattcacttttttttgagacagcattcactttgtggcactttaatttgactccaatttgacagcattcacttcatgccactttaaagcacaatagagcaaaatctgcattctgtgaactacaatcatgatttgatactttctaagcatccagcaatggcagatcatttcaattgtcaaaataaaataatatttagtctaacaacttggaatgaccacatagttgcaatttagacatcgattttttttatcatttgaattcaaagcattatatcaacatctagcttaggcatttttcaactctctttttcaagcaggccatgctagactgctagacagtagagatacaatggagtttatccatacctctttaccgacaaaaggtgaagtgttgatggaaaaagacattctgactgtcggttcctctattttgatggtgggcaagggtgttccagaaactttatctgctatggtttccccaatctgcagagttcaaagaataacagattttataattatcgtgctcttaagataaatgtaaaccagaaagcttgaataaattgttaaaaaacaccaaccatgatatcattgattccacatactgcacaaatgtcaccagcactaacattatcaactggaactcggctgaagttctgataaacgaaaagctcacttattttgctaattctacaagcatcatctggtgtacaaacctgcaaaatatcttgaaatcagtagaagctatattgctgtcataagaaaagatattttttccctttgtcttgcaaacaaaaaaaaggtgacagatgtgcctagatgtaatttgaaaaaaagatcaaatctaaagaaacttcaaaagtgaaccattaaccaagactgcaatggttgctcatgcaaagagtatgagagatttaaatctaaattttggaaaggttgcacatatctttgatgctaccctgttgttctttttaatctttgttggaatattggcatttgcactacatgcacaaaaagaacaaatttgtaccttcacttccatgcctcgctgcagttctcctgcatgcagtcgcccaatcgctatccgtcctttatgttcatcatattcagtattagacacctatacatcagtcagcattgtggaattagtacacaggactacaaataatgaaagagaagttctgataatctattatcagaaaaatagatttgtcaaagtcagaaaggcagctccgcagaaatttgctcacaagaagacaaatcaaactttctaacaaacaataaagtgatgtagagaagaacaaaatagctaacgtactcatattatgtgcctggtaagtgtctagacttcaacactagttgatgtaactttgcatggaaaataatcttagaaatttgaacatatgttcatttacgaatgtggcagttattgcaaattgatcggtgaatattaatcatgtaggagtttccttagctgtccaagtacacaagatactgattgctgatcttggctagttagctatcagatttcagtcatttccaactataattacataacctagtatccatggcatggctttcagcatcttgggagtaattactcccaactgtatggagttaagcatcccaaagttcaagctttaccatagttgaaaataacagtaagaaacaaacagaagaaaaaaatgtagtgatacagtgtgtaagttgccattttgagagaaaatccgaaattacagatgcatccaagaaaacaatcacgatggctgcatataaagtattatgcaaagtcatagccacaagttaagtacatgacaatataatccccaagtttattactcacaagcaattgcagtgcaccgtctttctcaatacgtggctctggtatgcatctaaggattgcctcaaaaaggggtccaagatcgtcacccaaattttctggagataacccagccttccctttaatagggtaccgagctcgaattcgccctatagtagt

SEQ ID NO: 80379 - DNA, 11354 bp, Oryza sativa
tacgtagctaatacagcccgatatatggcgttatatgtaactatatctgtacgcccgaagaaagaagtaacaaattaagctatatacctctcaagatacaatgtaattaaggacctagctagaagatatatatatatatatgctgcctatatatatatacctcctatatacggacatatataattcaatttagtccacgacgttgttgctgaagagcttaaactgtccagcgtcgagcacgagcttccgtatggaggcgaatgcgccgatggccccgacgccggagaagacgaccatgatggccgtgttggcgaggaacatcggcgaccgcctgggcggcgcgagcgcgatgttgtacatgacgacggggaggacgaagtcgagcgggatgaaccccacggcgccgaccacgccgacgatgtcgccgaagaagggcagcatggccgccatgaacgcgcagaaggcgaggtagagcgtccgcaggagcagccggggcaccacgttccgccgcgagaacttcccccgcgtcgcgtccgcggagctcttctccatgatctcgtacgccacctgggagtagacgaggccgatggcgaggagctggaggaggacgaagaggacggcgaggccgagcagccacgtcggggcgagggccgggccggtgtccggcatgaggctcttgaggacgttggactggacgtggctgccgaacgcccagtagccggtgatcgaagggatgtagaaggcgaaggctatgacggagtagcacagcacaagcgccttcatcatcttcccggccgccggtggcgccaacgtggcctgcaaacgccgatttgaaaacggcccaccataaatcttctaaataggcccgcataacacttcatatgggctttttaacaattgatatgggcttaattttaggagcccaataagcccagcctgtcgcgtcagttggaccatattgcggcgattttgctatatatttgtcgacaaatttttcccccaaaatttgacagatgtaattacagtacaatcgtagtgtaattacactgtaacttgcatgtaattacactgtaactatagtgtaacttgtatgtaactttcaaaaatctctccgttacatgttatttcggtaaaatggaggtcgtgggaacaaattctttcacatatgtgtgtgctatgatttgttttctttctcaccaaaacaaatcttgtaatagatccaacgattcaaaattatgtgaaacttacatataagttacactgtagttacatgcaagttacagtgtaattacatataagttacagtgtaattacactacgattgtactataattacatctatcaaatttttggagaaaaatttgtcgacaaatgtataggtagtccctattgcggtggcttacagttttcggtgttttcctttataatttccagaggaacagatagtctaaaaagggctagcatgtaatttcagagtactagcgaatctaccaatatggccatagaactcttgttggattccactaagggatttttctgataagtgtttaacatatctagatctaggtacgttaagtcagatttttttttcttgatcaaaagtcagaagacgcaatgatgaatacctggatttcaggcagtatgccgttgccgtaaacagaagccaggatagaaatagagaggaaggcattgaaggtctgttctgatttggacgagctaagcgtgtaatccttccccggagcatcttttgacagacctgttaagaatgatggttaacatctaggacaatgagagttagacacttaaactaccagtgcaaactgcagccctcagttgtacaattttgttttctgatatagcgtagctgaagaactagtaatcatgaatttgttaagtctggttctggccaaaccaatcaaatagcttgtgttgtgcctaaattagaattacaggtacaaaatggcataaaagttaaaattcctaatggtttttactggaatctgaaacgtctaataagtaacgacagtaatgcgttttgtggacatatcatacctagttgagtttgttccgttatcatgcatcaaaaaacaactgaaaagaattggctgcaaagcgcagtaatcacgttcattccatttgtattttgtcttgtgtttatataaacaatggagcagaatttactgtatatttatgaagaatactactgatagatatagggcatctgattcccgatctaattcccaaccttttgtggaatctaattcctccatctgctgcagcataagtttctctgaaatcttaacagaaaagttctgggaacacagagaggaatgaacatgtgacgcgagagttcaggcgatatacctgcaccaatgcaagcagcagatacaaggatggtgtagcccaagctcaagagcagagaggcaaagttaatgtgccgcagggaatggaatgatggtagctgggagaggaaggccagcgccacagctactatgatgatgaagtggtacagtttcaggggaccattgggagaaaggctcgtatacatgatctgtttgggcacaacaaaagaccagtttatccaattttgcaactgataatttgagctgtgaacactgaacagaaagaagttattaattagttgttttttcatgccaatagacgaaatctgttatgcaatttcactaactgtaaatgactttacagttttagaagattgtaattactagcaggccgactacagtactgactcctttctgacagaaaaaatatgggattgccagttctgttctatcattctgcccccttattgttttcttgtctgaacttagtatagaagtacttaggttgcaggcaagagactatgcaaggattggaatatcttcttcctccatacaattttaagctctaaaaaaaatgatgtatgttgacagctatgcagacatgctacgaataaaatcatgtaattttagagttagccttcaatagccatatgttcaatccttccaaggtcagaagtacaagcacatgaaaattgcacagcagcatagggtttatttcctttgcttttacaatcagtgatcaggttttgttccaaaaataagtttagcttttattgtggatatttgcaatcaaatgaacaggaaacaacctatacctgtttcaaattagaactactagagcgatgcatagccatcaatatccattgcaggacttcgttattacttactacctccatcccaaagtaagtgcagccataggtatccgtatccaacgtttgaccgtccgtcttatttgaaaaatttatgaattttttattaaaaaaagtcacacgtaaagtactattcaggttctatcatctaataacaataaaaatactaatcataatttttttttcaaataagacaaacggtcaaacgttaaatatgaaccgtgcaaaactaaacttatttttggacggaggtagtattacttattggttgcatgattatgacttgcttgcatattacaaacccacaagcaaagccaataaaatattaataaccatagtatgaatcctcccacacgcattagcaaaattagcatgccagcatatcgtctgggaccagctttcttactagtttgaatttctgtcgttgcgtcagtggatactggataacagaaagcaaccctcctatcctgaagcagctcgagtcaaattcatcagagccaaccatttagatcacaacaaacatggatggccaaatatttattgatctatgcaatacgatatcttattcatattctacattcacattaagagcatgatagcttcttgattttgtacggcaactatgtccaggcattcccaatttgttggatatactacagcttgtccaaacacaaacgacatgaaaactttgttccgaacaataaaccaatcatagacaacagcaattggcaatagtatgagcttaaacttatatgcatatcagacagagagttcaagggggttatgggaagcaacgatttgcacctcgaggcaatcggcggcgagcaggatggtgccgatgctaacgccggtgttgatggccgtctgcacgatgaccacgaagtaaaacatccacccggaccctgcgtgcaggagcagacgaacaaaagaaaaagcgatactatcatgtcgataattaattttgtgtctttgcgttggcgagctcaccaacgcgcgccatcctaattaatgggagcatggcggcgagtcggcaacagcacggcagctagtgtgactgtgtcgctggctgctccaccgccgcccgtgcacaaaggcgcgcgcgcggcgccgcgctgcgtccaaacgagcattgatgcgggtagctaaagctgtctgcttcgcttgtgggcattgcaccgaacgcacatggggcaatacacgggaatgtcatgtgcgtgtggtgatggggtgcagtggaaaggaatggatcaggggagttaatagtaataccgaggacgtcggcggcgagctcgcggaagcggatgtggcggcggccgcgggcctcgcagtgctcgaggacgcgggacatgagggagtactcgtagaaggtgacggcgccgacggcggtgagcacggtgagtcccagcgcccaccccatcccgcgcagcgcgtacggcagcgtcagcaccgtcggccccacgatcgccgtcgtcaggtggaacccggcgtgccaccacgtccctgcaaggtcgccccgcgacgggacccaaccacagatcacagcagaatcagccctcgcattgcgcgcggaaggcgggcggggggtggaggggtgtgacctacctttggactcgagcacgaaggcggcgccggcgtcggcggcgggcggcttggcggccgcgccggcctcggcgtcgaacgccgcgtgcgccatcgccttcgtctccagtcgtcccgtgccgcgccacgccacgccacggtatttatacgcggcaaaggcgacgcgaagaggagaggattcgctcggccactctctctctctctctgtggatgcgtgtaaatcccaagcccctaatctgatgaaccaacttaatcggtgcgttaattgagcggtaacgaggagattaaatgttgtaatctcgcgattactgctccaactgcgagtgccagaggctttgcggggatccgctttgatcagttgatcgtctactagtaggagtagctgtttggttctcgttgggcgcccggcccccgtatttatgctgcgtggccggatcggcggtgaggtgaggacgtgaggaggttaattaaaagggctctgttccaagtggacgtcgtcgtcttcggattagagtaaaacaaatcaaattggccaatctgactagattcattagactcacttctattgagtggtagcggttaacttttcacttgcatgcaaaagatgagcacataataattaagtatcaattattataaacttaaaaataagtttatttgatttttaagaaaacttctatatatttagtataaaaacattactccctccgtttcaggttatacgatgtttggacttcgatcaaagtcaaactgcttcaagtttgaccaaggttatagaaaaaaatagtaatattttcgactcaagataaattgattataaaaatatatttaattattaatttaataaaactaatttggtaatgtaaacttagtctaacttgaattagtttgactttgaccaaagtcaaaacatcttataacctgaaacagagaggagtatttaatagtttaggaagcgtgtgctaattaaaaaacgaggaatttgtaacatcaaaacgcccaaaccaagcgtgctaatgaaaaattgtgcttgttggcttataggctatcgtcggaatttgaattttagaagttattttttgttgattttagtgtgtgttttttctttctatttttttatttttttagttgattttatatcttttggataaatagaactatactataagttttaccctaaacacccttggatgctttctagaattgttgattgtttggatcgatggcaatcattattgtctcattttgccaaatttttgtgatgttcacgtggctttacatttcccatttttggacagaaagttttgttttatcccattttaagcccttctatttggccccctgtttcatttcgttgggaatgtttggctaaactactggatactaattacacgaccaaatggtagcaaagcgagatgagcgtgtttaagttggtgaccaaagttaccacaaccaaaccttaccaaaatttagtcacgatgacgatgagtgtgttttagtgtttggctcggtgaacaaaactgcctcaactaaactttatcaaattcccctaatacaactttaaatataatagaactcatgaaaattagtgcaaattatgttgtccgctctcatttactcgtttatgaacagttgattgatggagaacaaaggtaaacttgttgagagagaggtgataacaccctaggctctagcctacaacttattgaaggttgtcactactcggaagcccctctttctcctttttcagagttattgctggcattgagtaacctattcttttccattagttatctaggatattttattctttttcttgtgttttccctagatctttgataaatgttcttttcactcgttaaatctttatattctatttaactggaactcgcttaccgtaactattgctataaaagagccataaaaatcacatcatcacttatctttgacactctcggatgatgctttagcattccaattatcacataatctttctagcttccatgatttctttttggttgttggatagaatcatttttttggtgagatttatagcatttggttcatatttgcatttttacaactgtactatagcaccatcctacggtaacacacaggatgtcatctagtactacaacatttatttacttgtaatggcttttgcatgaccactttgacaagaaaggtgagaaaggtagtccgtgctaaatatcgccaccttatttaattggttataaatatctcctctagctttgtcaacaacaaaaaaaatataggttttggtcacaaggcagctgtgggcgactgcagtcgtagccgcagaaccacctaacaaacagccccctaaaaactagataccaaggtgcacactctaagggcacctttgattcagagaaaaacataaaaattctatagtaaaaaattctatgaatgcctttgaagtaaatgattgattcctatcatatcttttaaaaatcctatggaatggacaatcctatagagattttggagaaaatttagcatgagcttcaacctattgaaaaatttcctttgagtctatctctctcattcgattcctatgtttttcatgtgatccaatcaaacggtcattcctatgttttgcaatcttctattttgcactttcattcctatcagtattctttttttttctaatcctacgttttttcattcctacgattcaaaggggccctaatttatctacagaaatcaatggatttacataatcatcaataatcatatcgttgtaaaaacaaaaaatgacgaactcataggcagaatctttgttgagttttgttgtagcaattagtttggtttattcgctattttatttatgtcgatttacctaaaaattgtattaaccaagctacacttttttttcgttttattacaattgtttcacctttttcagtccaagaacaaagtaaacataggaactgttggatacgagttaataagagtggtaaactaagtaacttcacttgataaataggtagtccatttttcaattttgatttctaaaaattcttggtagcgtttgaatgtagatttaaggacaccaccctgttgtttttggatgaagagccgatggatgatggatttgtttatatggatgaaaaataaatatgatctaagcagtactgacgtaaaagagttttagataaatcatgtattttttaaagcacgggacaaataatctgtaaaagtaaccaattatcctaggcctccgtagatcaatttataccagtaaataggatatgccataccggcgtactttctccgttcctaaaaagtcaatttgtagatatgaatatgatatacatctatctagttcatcctggaagttagtccttttttctaagacaaccaactaggtacgaatatggataaaaatatggataaacatctgtctaggtttgtttctagaagttgttttttagatggagggtgtaccctaaaggtttgtctctctctctgagatggtgtaccccgaccattattttctcgatattaggaggaacgaaaagtgaaaaaccaagttggtaagataccgccagattacagctgatgcacctgtggaaaaccttgggtaactttcctgcggttcgggatgtttcagaattcagattgaaaacgttgtcttggacggacgttccaggaagattgcctctgcaaccacggatcatacatttccgcgacactgaatcatacacactttgtgctcctttttgctaccaacttacttgattattgcagttctttatttcactcgcaatgtacgatcgcagtgtaacatctgtagcggaggcaaaatcgaggattcggacctccgagtcgaaccgcactacacgcagtgcggctgtggaaaacggctagccccccatctttctacgtgtaatgttttgttttaacatggaaaaggggagctcattggatctatctaatctttttttaccactgtcttgatctggcaacaatgtactgacctgtcttgtctggtgtagtagaaatcagtgttagtggatgacttgtgaggcgcggcgagccaattgccgcgcggcaacacagaccacttaaggtagctcgagttctagcccaggggcaataacaatgacagaaatattcgtaggagacacaagaggggcagaggcttatcaggtatataacgaattgattcggattgatcagcgcatgaagaaacagccggctccaatcatccaaccggaagtcaattttagcatgcttgaatgcttatgtgtgcttcagtacttgagttgttgtctgaaagaaaatactatgttagtagcataaggggaacaaacgtaatcaatgaactggttaacacaaacgccacaagccggcaaatacggtttagttacagtacagttcatgtgcaagaaacttcagtaaggaaattactttggtctgaaaggatataagtacttaccaaaaattttggagcatgagtgccgcaaagtgtggaacaacaaccatgctgggcttccggactagttttttagcaccatggtgtcacaaaaggtgattcagggggaggcgaccgtgagactgcaaatatacaaatctgggaggcggcgaccgtgatacccgcaagaggtgattcaccagtatatatttacaaatatatattagaaaaatgtatagctctaccaatatattacaagccgacaattgcacatatacctaatgcttcccatggtgaggcaacataccaacatggtgatagcacagataagaaacatatacaggcagagcagagaagttagagctgcctggtagatcgaatcgtttcagtaaaaggcatggaggtttggaattagtaggaggaagattattaatagtaaaatcatgggaacatgtgatctaccagcttcttggacaccacaacttgctgcgtagtccaggcttgaggtacacttaaaaagcttcaatctcactattagtagatatcacaaacttgcctccaatttgcagctacgaggggtaggagtaataatagacccactatccagctatctaaactcttcagggacatgcatgccaaaaccacgcttcagcttctcaatcctattcaaggaaaatttgataactgtaagtcgatcgggatagtgataatagaagcaaatttgtcaagatgcctgggtgagagctaagaaattgacttgcatcagtgccagtacagttttgtattgtttgtaacaaaaaaatatctacatccaaatatgaacaaaatgatcgacagaaactattgtcattactaatgggtgccacgagctactgcaggaacaaagacaattttttagaaggaaccatgaaaaggtgcatttttccttaaattccttgactgacaaaaaatattaatttagacagagcatcaaactagataaggtctttaggtttggtgcgatgactgtgtgtagatttagtggaattcctatagtaaccgtggtgctactttttatattttgatctgaaatagttagtagtaatgactattgaaataaaataaattgtggcaacctgtatgggattattttccatcgtgttgagttttccagtagatggtcctaagaaattcacatgtttcacttagtaaagctaagtgatctagccagtagccatgtatacctacttctaagaatgagccaggaaacattgctctagcatgcaacatgacacaccattaccgcaaacacgactgatgataatgcatgtacacagccatacagctataatgccaaattgcaagtgctcagcccaaattcaaatcatttcaaattacaagcaacatggatgatcatggccaagcaacatgaagttcatggccttggtgattttatgatggaagttggaaaacaaagtaagcttgcaatgcttggatggaagattatatatacatcagcactacggattgttaacaaataaagaatagacaatggtaagatcaaaatggtgaaatatctttgatatcaattgtattcacagacattatgcttttgagatatatcagatgtttaatctcagaaaaagcatgattgtgatcatgagccaaatgaattctggaaaagaaaagcagaatacattactaagttcctgcttttatactaaagcagtttgagcaaaatccaatggacaaagtaattaatattcaaaaaaatgcaatatatgttgagaaaaagaaggtacgccttatataagataaagcagtcgactgtttggacaaaaaaaatgtacaaaatgtaaaaaaactcacgtgggagcaagtttgccaagactgcgtagcttcttgccagtttcttcatcagtaatatttccagaaatctctacagaatatgatttgccagagatgcgtggaagccctcttcctacaagcaaatctagatctctctgatgaagttctctgccattcacgaaaacaccactatccccactagcacagttactggccatcgggtaattgaattctcttatgaatggctgcgcattttaaaaaatcatcagaagttta

SEQ ID NO: 80380 - DNA, 9978 bp, Oryza sativa
gtgtcaggcgagtgatgacgctgggcctcactcaaagacaagctgtgatttagcttctaggcgagggcgcaagccagttttttttttggaagatagggtgagtccccacccaaaagaagagtaggtagaagtggtgcatgtggtatccccttagatataaaaggaggatcttgcccacttaagaaaggggggcgaaaagagagagaagagaagggaagacgggagctcggagagaagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccctggccgaaccggcaaaggggggcccgcgcggtctcccggtgaggagccccacgctccgtcatctagcgcgccaggtagggggcgcgtgtgtttttctaagccctcgtcctctttcgtgtgcgccaagcttctcccgctcagcccaatggctgaacgggcagtggcgcacaacctctctccgagcgctagcggtgacgacggggagcagaacccgcgtcgtcgagctcgtactccaccgcccccctcttgccaaagtcttaggcgggaggaggcgctcgagggggtcgaaagatcagcgacttcgccgcccacgagcgatgaagaaggacggcgagacggggagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcacagcagcgcctaggcgccggcgggcggtcctccgctaccgaggcctctggcgctgccgccgccggctccatgtcgtcgaggcggaaggcgcggcgagcggcggccgttgcccgccgttcatccgccattccctcatcaacgcctccgacccaagaagatgtgcgtggggggccagatgcccgcctcgatatcgagtgccggcgcgacgctcgtcgcgccgcccatgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccaactacttggaagaacgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatatgggagggtccgtatcgagtgatcggcgtcccccggccgggctccgttcggctggccacggccgacggcacagagctgcctaacccgtggaacatcgaacaccttcgtcgcttctacccctagtgggggtcgggtgtcatgtctcgggctcgggccaaccccgcacccccccccccccgggcgtgtagagttggccgggggctaccacatgcatatccttatcttttttctcttccttatttcaataaaagcattttcgatttcctgaggattgtgtctgtgccatcgtttccttttgaagaatcttggtttgaattaacacgctcgtgctcgaccctgccctcggtggcccgggccggctaaaatcgccaaacggggcccagaaccgagccgtgccccggggcgtggtgaactccgggggggaatcggcaaaggcccacaattgggtcatccataaccctcggtcaccgcgctcccggcctggccagtctcgacacgtggatctccccaggcactagccctgacccgcgccgtttgaggctggggcctgggcacgagcccttgttcaagccaagacacagaaggaccgcggcacagaccatcctcgtctcatacacacaataaacagagctgacgcaaaaatttcatctttacttgattacagattaaatcagtctatacaagaagggggcccgaaggcctcggaagaagaaggaaaagctattaagattggcgggggcctgggggctcactccgacgcgcccgggttgtcggcctcgtcgtcgctgtcgtccgcaccgtcgtcaccgccctcctcgtcggagtcgagcgcgaacgcgagccgaggggccgtaccctcgaagctgtggacgatttggtcggcggcgtcccggacctgcgcgcgcgcgccatcctgggttccaggagggaactcgtccagcgctgcccacggggagaagtcagggtccctggcctggtagcttgccagtacgagctccaccgccccccgggtgaggtccctcgaggatgacttgatcgtctcctcgagctcctcggggagccgctggagggccccggccatctctgagaggcgctgggcgaggccagcgcgccctgcaactcggcgatggcgtgttcggcggctgcgaggcgggcggctaggtcgccgtggcccgcggccgccccgccgctgtgcgccctcgcgtccagctccttcgcccgcgcctcgagctcagcggcccgctgatccagtgcggccctctcggcgcgggcgccttccagattgcggcgcgcctgctcctcccacgctgcctcacggaggaacaggctgtccgccagccgctgcgccgtggcctcggcctcctcgagagctcgcccccgctcgatgagcgcgtcctcgcggaagcggagtgcggactcctcttcggcgcaggcggcctcgtgctcacgatccgggaaggcggcaacacgctaccctcgagcggtgcggagccccgtgccatgacgccggcggaggaggagcttgagagcgagcgagtatggcaagggtagggcgcaggaaacgagaagttagagcgcaagcggcgaaggcaaggggaataatggcgagaggaaggaaacgagtctcttcctcggcgtctttatacccttgccaacgctatgcccggctcctcgcttcccgcgcccactatctcgccccctcgtttctcgcgcccactcctccactaatcccgctcgcccgtttgcggcgcacgaggtggatgtgcggccgtggcagtcgagatgggacagatcgtgcgcgcgttaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgtgcaccactggattcctgcccgcctgtagagaccggccccgcctgtcaccaggcctaaggagtggcgtcatgcccgagcactttcctcgaggagggcgatcgccctggcataacgccaggggctactgtcggtgacatgggaccgggggtatcttgactagaggtttggggcagccgcggtcacccacgtggcctgaccccctcggggggagtcgggcccgagggtgatgtggccgcccctccctctgtctccccgaggggttgggccgctcccgtttcggccccgagggctggggcgccctgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgttaactcctggagttagcacgtcagtcccagctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtaacagggagatctccggtgtcaggcgagtgatgacgctgggcctcactcaaagacaagctatgatttagcttctaggcgaggacgcaagccagttttttttttgaagatagggtgagtccccactcaaaagaagagtaggtagaagtggtgcatgtggtatccccttgagatataaaaggaggaccttgcccacttaagaaaagggggcgaaaagagagagaagagaagggaagacgggagctcagagagaagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccctggccgaaccggcaaaggggggcccgcgcggtctcccggtgaggagccccacgctccgtcagggtgtatattttaagataggtataatatcatgggaaaaaagggcggaaactacggactcatttgttttggagggaaaatggaaggaaaatgtagaaacaagattcatgtactattcatccattagttttgtaggatttgagcatgaaattttccttgggctatgattcttaagaaatttcataggaaaatttgcatccacttagagctcttttttctattcctacgaataggatcgaggtaaattactcattgtttgatgtatttgacctcaagttacatggttaaagcattccaaccttgatcatattaacttaatactaagcattcatatattttccctaccaaccatccaaaagatcaatcctatacttttttctatcatttgttttgcacatgtgttcctatgttttcctattcttatgatttggaaatcttgtaaatcaactgagccttacatatgtaatgcagtaatggaaacctaaaaaaaaatcgttggatcgaaaaatagacgtttaaagttcgtccacatcatcacgagtaaaaattttacttcatgagtaaatattttattgatttactcacagtgatttagatgtatctcatatgtctatttttcgatccaaccgtaatttctaggtttttaatatatatgtgatttgatattttagctagtagtattggttaggaaactaggcagctcgcgcgtgttgcacaagcttcgtcatgcactactgattggtgggtggcaatgatttttcccatttaagggattgtgtggacctagtaataaattatctgataaatatgttatatgtatagtggcacttggaagttggaattgattcaaatcgtcacgatgctcaactcgataagtttgcaatttaataaccgatgtcgactccctagtcctcctaatatcttggcaattatggaaggaacaaaacttcagagttttcgactttgctctctcttcggtctcagtggttctagagtccattctcattgagggtcacctatagtcgttagctgccgttgcttctttcagggttttcttgtgagggtagtgtggctctgctcccttcctgcaaattggagttgcgtttagtcttcgttccttagtttttcttgtttttgtcttttctcccttcccatggcataagctggtctggctgattgtgctgtgtaaacaaacactctttccctctaatatattgacgcgcaatctttttgcgtgttcgtaatcgtaaaaatatgtacgccaagtcactacttaattagttgacttgttacaagcaaatgtatatgttttttttcatctacttacgaaaatggttgtgtgctcttataagaggcctaaaattccattacataattcactctagaagaaattaattacctcccttaattactttcatatgtaacggctcactaccggttatttcttacgtcggttcaggaatgttgaaccgttagtggtacctagggctggacaaatagctcgggctcgtgaactcggctcaagctcggctcgggctcgcctggctcggctcggctcgaatcctgaacgagccgagcccgagcctgggttttagctcgtttgtgaaccgagccgagcccgagccagctcgcgagcagctcacgagcttagtaggctcggtttgaatagaaagacttctggccgaaaaccaaaaaagcccatcaatttgttatatgttggctgcatacaatatacctaattatctttgtagggacttgagagttattatctgaataactaagtcattgcaaagcaacacaactgctgctggcaatacaactgctgctattgcaaagctcacgagccagctcgagccggctcgagccagaccacgagccgagccgagcctaatgtacagctcggttggagaaccgagccgagccaagccgagcctggcatttcgcgagcttccacgagccgagccgagctggctcggctcgtttccacccctagtggtacccccaaaaaaaataatcatccacaccatatactaatcgccatcattgtgctgaggatgccttgcctgtaatcgtggttgtcgtcattgtcaatgtagccactattacaccatcgccatcgctgcgcacgaagatgagagaaggatatctttcataaagtctattaatatccgaagtcactgctttgtccctggacccataaacaatgggtcttaattcaggagaaagaaccagcaataagtacaaaatccattctggttctacatttgtttgaataaaatatttcaccaatttcatgcgtctaataaaaaaaacttttcttattcttttttctatcttctcattcatcttcactatacccctcgtcttctaattccttccattcaagtggctggcatgagggtcccacagcttgtcgacccacatgttagtgaccccacgcgaagggcagtatttcagaggagctcatctgaaaagagagcaaaagaggtggccgcgttatatctaggcatcagcccccatcacaagttggccctccttcttgttatgactattgatatggtgccactgccagcatgtcgtcatcatacctgtcaccaagacccatagacatggcaacgttggatggggcagagcttgggaagatgggtgattgggccagttggatctagccacctagaagtcggagatgttttgatccgatgaccctttatcttagggaggttggtttgagctcccacaacaattggatctggcgacattgacgttcgggagagatgtggaggtggcggtggcacttggcactaggatggaggagaagacgatgaccgaagcagtgcttgagagaagaaagaggagagcaacggccatggttggaagcgaagggaaatgtgaagtagctaggcgaaaggtgaaaacgacgactacgctcaggagggaaggggagtgatcgagtggatggcagcagcagtgctcggctcttaagagagagctgggagtcaacggtgatagctacgctcgacactcgggacttaggagggagctaggagcagtggtggtgtttctagatcgagactcgaggaagagagaattatagtattactagctatatatggatctaggtggctgtttctcgagatctatagcggttggtggtttgtaaccgtttaagatgacaacaatgcatctattcataaaagatgattcgttagaggggaacatatcctatgcacacaagcttctcatacacactccatatacaccaactagcaaatgtcacgaaaaatcctacaaaaaattggacatttactcctattaatattacacatatctataaagtttcatattcaaattcattatattttagtcgtaataaaaaagtgcaaaatctgacagttttaaaggtaaaaatttgtcagaattttgtccttttttttgttacgactaaaatataatgaatttgaagaaaaaatttcacatgtacatgcaatactattcaaagtaagtgtatattttttgtagaatttttcgtgacatttgctagttggtatgcacagagtgtgcacgggaagcttgtgtgcataggatatgtttccttgttatacatgtctagtcaagtcatatgttattataaagaattatagatgttaagcaccatatttataagggttaattggatatgccactacaaatatgccaaattagaaaaataacactactattcacaatatcggccgggtgccactaaaattttgggaaattagatcatctcactccatcgcgttttccatccactccccgtccacggcgccaacttcgccaatgccttcccttccccgtgtgtggacgccgccgccactccactcgacggagatgatcaggggcagggaagggtgctgctacccggggggagctcatctctgctgtggacatttaccacaggagcgcggtcatcgtctcccgtgtcgtcaagacctacatgccgtcctcatggttcctcacctcgctgttcaccgtcgtcgacgccgtggaatgcaagaacccggtgccggcctcggtagagtcaacggcggagctggagctgagctggaggcgaagggaggcactaggggcggctaccacacgaaacagaaagggggagacgacgcacagggcttcgtctcgacggcctgcgacggcaacttccctccgggacgatgcatggatccaacgatatcggaatagtagtggtatttttttaatttggtctatttatagtggcatggatccaattaaccctatttataacggcccttagttccaagttccaaccactatatacgacggtcctacttgactcgttacagcctgacagatagatagctggttctgtagcagtgtgaaatgtccagtctaatcgacttaagcttccttgatgagtgaggaattgaggatcaccacgacagcatgaaggaatcgacatttcttctttaattcattcaagtttattgtttgattctatccattgttctctcattaactcttgctatacatgttttttttaaaaaaaaatgatcaaaagaggatagggccgggatcgtctgttttcgtttaacagtaagagacttggcatagtgtttaagaaaatccgaaccaaaaatctcacaaacacactactccctccgtactctaatataatattttaacattttaattgcactatttaactactttaagaacaattttttgtctttatatttgtacaattttttaaaataagacgagtgatcaaacgctacaacaaaatagtaaataatattatattaagagacggatgtattaattaggaaaacccggctaagaagccacacgaataaaaaaaataaacacttacggcgatatgactggagctcaaagcatgtgtcatcgttgtgtagctcaaaaaagcagccccgacgatttctatattgcaaatgcacatttgctcgtacaaactacatgcatttaacttcaccagtgaaatattatatatactactacctccatttcagattataagattttctatcattgtccatattcatatagatgttaatgaatgtagtcacatatatgtatatatatatatatgtatatatgtatacacgtatacacgtatatacacatatatatatatgtgtgtgtgtgtgt

SEQ ID NO: 80381 - DNA, 14242 bp, Oryza sativa
caaaaggcttgttatacatatcagtgctataggcagcatcaaacataatgagatctccgaaaatatcatactcgatcctcaatcttgcatcagtccagaagatgcttgtaactgtgttgtcctcatctttttgcattacgtacagaaattctgggttttgaatctgcaattctgtgaagtgcttcaatgcgctttcaacatctgagtttgcttttctatgttctgtctgtgctatgttgtgctcatctttattttcaaatggtatgtctccgaaacaaactcttagtttcctgaaaatcttcataattttcttaggaggtaccctattttgttgcagaactcttaaaaatgacttctctccagttgacatttgtttgtggtctactatgaatcttgcaagcaaagggcttgggcataacggatgattgtgctcatggcgaactgctgtgaactcccattctcccttatcgagtttcactatcacccttgccttgcattgtgtcttctctacaagattgcttctcctcttcttcattgggttttcagatgacttcgttaacttcattttgccactcttgttgcattctaagtgaaacttctttctcttgtagttggttcccctctttcctacaaaaccagtaaggagagcatgtgcgtaatagaatctttgtgcggcttgaagggatggaaatttcattccgggttctggtggtcttgaattcttcagttcgtcgaaactaggatagaagtacttcccaagctccttatccgactcatcacctgagctgctgtctgaattgctttcactgcttgtatcctcgcttggcgcttcactgctttccacattatcatgtgatctgttatgctcttcagtatgctgaagtgaatggtctatcgagcttgtttggtctcccaatttatctacaattggtcgttctgtatttttgtctatgccatttgaagattgctcctgcatgcaagagaataacttacgttaagctactatttgataccttattattggtactcttgttagatttcaccttttcatacctgataatcaccagctcgctgtagtttgtcaacaggttccttctctacagtagatatactaatctctgcatgtctaggcatccttttgttgtttacctgaggtacaaccaggataacagatcattaaaaaatcacttccatcacatgtatacaaaacaaaaatatctggggaacctttgttagcaagcttacttcatttgaatcagctgaaataagaggttgcgacaaccgttcctcaagattatctgcctgtgtcagttggtcactatttctctgaacatccagctgtttctggcttggaggatttcgcctgcgtttgcgctttgagaatctaagcgaatagctaggacacaatggatggttgtgttcattccggactgctgcatactcccattgtcccttattgagcttcactaccacctttgcctggcattgagtcctctctataatatttttcttcctcttcctctgtgggttcggagttagctttgatgtgccagtcttgtggcactctatggtaaacttttttctcctgtagttcgtcccccgctttgcaacaaagccagttttaagagcatgtgtctcatagaatctctgtgcatcttcaagtgttgcaaatttcattccaagttctggtggtcttgcattatccaattccattaaactaggactatagtgtgctccaagccctttatctgattcatttcctaggcttctgtcagaatcgccatcactgtttctatcatcgcttgacacttcattgctttccatattatcatgtgattggttttgtccatcagtatgctgcagtgattggtccattgagttggtttgtctccctaattgatccacgtatagttgttctgcagttttgtctatgccatttgaagatagcagctgcacgcatgcaattgaatatttcttgttaaggtagctattcactgccatattcaaatgtccatattaaacctctccataagcattgtctggttttcatacctgatagccatcaccagcgagctgcagtcttccttctgttatcacttgcttctcaacaggtttctgcatttcgtttcgcagttaatgccaggcacaaagtgattctaaaaagtcaaagtgattctaaataccttgatcaactcgactggagttatcaccgtttgcccatcattgttactggtctgtaatacatgtatgtgagacaaagcaattagccaagtctttgttactacctatagctgcattttgccaaatttatgtatgtcattgtctgatggatgaacgcggtaggtaaacagataatgttcaagttaaaccttttcgccgcgcagctctggttggcaccaggcttgtacaggagaaatttcattccccagattgtttacacgagcaaaaacctggagaacagatctcttaaaaaggtcaatttcaccgaaagcacttaaccgattccaattctctgcaattctctgcaaaagatgcaatggcgagggtacatacattggctatatatatgtgatagcgatctcacctgttcggaatcaactggaaggatgtgcatcagcacgtcctccatgggaggagggccggcccgtgccagcagctcatcatctccaccatgaacaagtgcctgtttctggattggatttgggaggagacgaaatcaatcaaaaacccccctcacagcacagcatctactacctcgcacgggaagttgcggagaacagagtggaaatcgcgagttgcgcgcgtcttcgaccgtacctcatacatgtcgggaggagaagaaggcatcatcactccatagcccgcacggcgttcgttcgtggacaccccacctcccgccgccgccgccgccgccggtgacggagattgcgccgccgcgtgaggaggcagcagcgggtagggagggcggagatgaatcgattcccttcccggagaagggcggaggagagggctagggttcgcggttcccggcggcgaggatgctagggcatcgagaagggaacagcggccgcggctgccggggggacaggagagttttttcttttttcttttttcctttctcttcttttgtttttttcgtgagaaacaagcccatacatctggcttggtcggtggatgggccgggccgcttgtgcttcgtgggccgttgccatctgcggccgaaataagtccaccggcctttcctcaactttacgtcgagtccgcatgcgagaatgctattgggcgatcagtcgcgcgcctccctccccgcgcgactggagatgagagggggcggcgacgcgccgcgagcgagtttttcgttttttccttttttttcgtttctgtttgttttgtttttttctccggtttttatttttctgtttggatttttttctctggttttttctggtcggtttgttttttcccagtttatcttcttttggttttttctttttttaagatgtataaatataaagtttgtattcgtatatataccaagtttgtattcgtacgtatagaactttctatacgcgcatacaaactttctatacgcatatacaaactttctatatgcgcatataaactttttatacacgcatataaactttctataggtgtatacaaactttctataggcgtatacaaactttctatacatgtatacaaactttttatacgtgtatacaaagtttatatacgcgtatacaaactttctatacgttatgtattttctattttttttattttttagtacgtatacaaactttgtgtatgtgtgtatatattctttatgcattaaaatatattcgtatatatatatatatatatatatatattatatatatatatatagtatatacatacgtatatacataagacgtatatacataagatgtatacagtagctggggggggggggggtgactgaccgcgcgcgcggctgatcgcgtatcagcaccccccgtatgcatggcgttcttaatccccgttaccagacatgtcaactccttaagtgttcaccatgcttaatagtttaaaccatattttctccggttttcgctgacggcgggtctatttcggcctgttaggaatgatgatggccaacccttgggccaggttggacggccgtgatcgcttcaagatccgtgcaggttgttgctcgtattaaaaatccagctcttttttattaaaaaaaatattcaggaacaactttggttattcagaaacagagtacatgatggatgatatagattgcagtagagaaataatatctaagatttcttgcatgacaacttctattaggataagtgatgtgagatatgttgtgtcgatcatgaagaggtatgggcggctgataagattttacttaactagcttgtctgccaccctattgatctcccttggaatccacatgacctccatggaaccttctagaatatttgtttgactccaatggcctggatcctcatcaaatgggcctgtttagttcgctaaaagagaatttttaggtgtcacatcagacgtttgaccagatgtcggaagggattttcggacatgaatgaaaaaactaatttcataactcgcctggaaaccgcgagacgaatcttttgagcctaattaatctgtcattagtacatgtgggttactatagcacttacggctaatcatgaattaattagactcaaaagattcgtctcgtgatttccccactaactgtgtaattagttttcaaatttatctatatttaatactccatgcatgtgttcaaagattcgatgtgatgtttttggaaaaaagttttgggaacgaaacaggaccaaagtttctcttcttggctgtgtctgcattcactactacatgatagattttcctgtacgccaccccttttgtttccaagcggttcgtaagtggaacagcacggaaaaataaggggaccggcgcggggctgtcacccgcacaggaaaatcgattttctcaggcgggcctcctaatctgaccgcacgggataatcatcattatctcatgcggtcgatttaagtggaccgcacgacaaaatcgatttttccgtacaagctttttaagtggaccgcacaggaaaatacctccctccttcccacccatccacttcaaaattttcacatcctctctctcttactttatcccctattatctctaaactaccccctctctctctactttatctcttcctttctctaccttatctcttccccagtcaactccctccacaccttccactcctcctccccctctcctcctccccttcccctctgtcaggccggcgaggcgacaaacggagctaggcggcagaccggtgcggcgagcgggcgaggcggcggctggtcgcggcgacagctgggcgcggcggcgagcgggcgaggcggtggccgggtgaggcgacggccgggcgaggcgacaaagaagcggatccatagagtcaatggcctcgacgataccgcccaccaccaccgcaagccatccccgccgttcgtcgctgctacctcgagaggcgcggcggtagcttggctcagcggctgctcgccctcgccgctgcctcgggaggcccgcctcgatgacgacgacctcgacgtatggctgacctcggcgagctcgcgacaacgttgacgggctcgggggagacggatccgttgacggtgggcgtagtagaagcggatccgtcgccgatgagcttgcggtggcgacggccggatgcgggtgggcggcgattttcgattttttttttatttttggtatttttggttccgtgcgggcggcattatttgactgcacgtgataatcgattatcccgtgcggtccacttaacccgaccgcacagaaaaataattatcccgtgcgggtgggtcgtccgcacgcgaaaatatttatttttccagatgcatggctctagacgggggaaacctccgtatggaaaaatcaatttgaccgcatggaaaaatagttttttaagtagtgattcgccccgctgtcagggaggaaaataatccctgcaaatggcaaaattcaaaaatttggccgcctccttagctaactggaccgccaccaattctgcctgcaaagagcattgtgagtagctggcgaatgaaaaaaaattccaatcctgtcgttccatttttccactccgcatcaaacctaccagcaactggaattttttttatttttaattttttttattaaaagttttacaaaaataattttccattttgaaaattgacggaagtagtcgcctaccgctctctgggagggcgatttttaaaaatcgccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgctgccctgggggagggcgattttacactgtgcggggggccacctgcaaatgggcggcgagggggcctggaattttgcaggcggcccccttgccgccctgggggagggcgatttttgcctctctcctatataaccccgtcccccctctctaaaatttcattataatctgtaaaaatccaaaaaaaaaggaaagagagagaggggatggcagcagaaggggagcggcgaagccctactggtttgctcacttcatcacaggtttgctcccatacttcttttgcatttgtactaatatattatgtttgagtactatatgttgcgttttagttttagttccatatattttagcatatctgtagcacacagcacatatgtgtagatctagagcacagaatataatagtatgaattgagacatagacagtagtgttaattgtaagatgtactttagtttgatctggaaaacgtaacctacttttagaattttggagaacaatattgtagagaatgtaacttagtgcgtagtacagaaatgcgaggttaacgtagttattgttttcatcaggcacaatatcaaataaggtcacatttcatatagttcacggtgaaggaaatcttagatttggtccagatggtgctgatctgtcggattttgtaatgacatctaagggcatcgataggcctgcggagagaacatttcagtcaatttatagttggttgttgagaggatttagaatagaccaagaagtctacacaatgtcagtatctctattgtagtgagtcgtgcaacagaaggttatttttgggaactaatgccgatggacagcactgctgcttggagacggtatgtggaaatggcttttgaatggtcatggcccctcgttatatttgtgtcggtacaagagaaagatacaaatgtttcaatgcaaaccgaagatgtggagggttctagcaatgcaggggatgttgttggaccatcgatgcaaaatgaggaaaatcaaacaagggaggagcaggccatgggcatggcggatgagggggagatagtcggtataattgttgatgaaatggagagggaagattcagataatgagcaagcggacgacgacgcatcatccgatgaggaaggtgatgtaatggccactgattgggcaaatgaggacttctctggacttgttatatcagagggtgatcatgtaccctgggagtataaggagaatgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcataagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggctgatgatcgaacaaagagtgtgctgcaagagcctttttctcattgggtgcctgcatcaatgcttttgtgcattgtcgatctgttctatgcatagatagaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtgatgcgtatgaggcccaacgtttgccttatacatgatcgtcatgcgggtatgttgcgggctattgactacttgcagaacggttgggatgagaagggacttccagctaagtggcttgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgatcctaaggagaagtggtctctattgttcgacactgatggatctcggtatggcataatgacaaccaatttggcgggggtgtacaactgggtaatgcgaggagttcgggtacttccattggttgctattgttgaattcatccttcacggcacgcaagcctactttagggatcgacacaagaaaattggtccgtccatggccgataacaacatagtgtttggcaacgtagtgacaaagtacatggaagataaaatcaaaaaggcacggagacatagagttgttgctcaaggcacacaagtgcataagtatgaaataatgtgtgttgataggagcaggcgtggtatctatcgcaagcaagccgtgcaggaatgtgtcttgaaggcggatggtggatgtacctgcagttgtatgaagccgaagcttcgtcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctaagtgccaaagttttttatattccagatccatctaagttaagggtgaaaaagggtcgacgccaaactagacgcatcagaaatgatatggatgagtcagaagcaggtgggaggactttatgctgcagcaagtgtgatctgcgcggccatacttacaagaaatgcccgaagaatgcagaagttccaagtggcgcagatgctggtccatctggacaggcatgtgatggaaggcgaccacatggtgaaggaacaacaagcaggcgcgcaaggccaagcgtcgtcgtgcagcaggcaattccatggtgtaacaatgctatcgatttaggaaataaaacgctgttgtgatgtgatgtgtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagctattgttgtaatcagaaatattctgtattgtgacccttttgtttgtttttactcttgtttaatatgtgttagtaattcacttatgaacatttgttagttatgttgaactaattatttttatgtttctgatcaatctattggatacaggtatgttgtacgacacaccggcgctgttcaaccgtgggattgacaggaaccaccgctcgttcctgtcagtagtctagggtgcacagctcggcactttccgtccacgcacgtcacgcgagtggttgcgtgtcgacccccgtcacgttccttagtacgcgtatgttcaattttacgtaagcacatttcaactcaactgtgctttgtcttgtacttatgtttaaagtttgctctatgcaggttgcgtgcggcaggccttctaccactttgtaggcttgttgaggcggcggcggacgaccgtgacccatcgaagcagtgggatgcagaccggtcactccttgccgctctggtagaccgctggagacctgagatgcacacgttccaccttccctgtggagagatggctccgacactgcaggacgtgtcgtacctgctcgggctaccactggcaagagccccagttggtcccatggacggtgtttttggctggaaggaggatatcaccgcgtgcttcgagcacgtgatgcgccttccacacctaggaccgcccaacacccttcccccgtactctaccatcgggcctagcaaggcttggttgcttcagttcactataagtaaataacttgttattatcatacatgcttagtttgtgatcaacaaattgttttgtagtaacatttcattattaattgtaggcggaccatctccaccctgacgctgatgattactcggtccgacgctcccttgagacgtacctgctgtggttgttcgggtgggtgatgttcactagcacccacgggcacgctatggactgctggctggtccactacgcacggtccatcgcggatgctcagccacaggacgtgccgcagtggagctggggttctgccgtgctaacagccacgtaccgtgccctctgtgaggcatgcacgaagaccgacgcgggagcgatcttcgctggttgtcctatgttgcttcagctttgggtagccaagaggtttgccataggtcgaccagtggtggacagcgcaccctacggggttggtcgcagcgcgaagtggctagaggacggtcccacaatggggacttactggtgtcgacgtggggttagtggaactttgctgcgttataagtttatcagtcgtcttctttttttatcatcacataacatgtctaattccgatcatgtttattccaacgtcgttacgctcacgtccaggtgagacgagattacccggacttcgtgtttgagtttacgcagcgccgtggacgtcgtacctccagctggtctggtacaaccacggcctcgcgcgcctaccgtcggagtaggacctcgacctacggcaccggtttcgcacggtactgctcagaccagaggtttcttaagttttgtttctgtttttgtacgaaaacctcaccccgtcgtaacttgacgttccatcctcgcaggacctcgtttgccttcgagcgcccctagcatcggagcagtgcgacctacagcaccggtttcgcatggtactgctcagcttagaggttagttcatttttgtttcagtttttgcacgaaaacgtcaccacgttttaactgcacgttccatcatcgcaggacctcgtctgccttcgagcgcgtttgcaagcacgaccgacgctttcgcgagctcttcaggggcgttcgccagcacttccggcgcgttcgccacctcttcctctcacggagcgtcgatccctcgcccacacggtactttaatttttgttactactattaaatacctgtatgaaactgatggtccttgtccagcaggatttccagctgggatcttcggtacaggtgcctcttcctctcacgccggtggtctggtcctactagccagttctacgacgatgacttgcacgatgcgcacgaccacgacatactaggctcctctcagcttggaggagctccagaggcgcacactcaggagcagccaaaggtcacacctatacaggcaggacgggttggccgtgccataccaccggaccgactcacgtactcctaggggcacgttagggcacagggtaggagggacaggggtaagaggcctcgtcagtagtgttctacaccttcagtgcttatgtgaccctttcttttggcttacaaatatgtaaagcagtactacttttgcttttactactgcagtactacttgtgtttctctcgcctatatagttgttttcattcatatggtgctagaacaacttatgctcacgaaaacacactttcggcgcttcacggtagtgtcagatccactagctgcacagtccaccacagcacacatgaaaagcgccagctcgagtagtcactatcaactttcggtgctgcctgctgacataaagtgaatcacgcccgcgcgtgctcgtcttgtcacatctaatgaataatgtatatcattaagtgcacaaatattgcactgaaaacaagctgaaggcaacctcttcatatcttctttccaactagcacacacctaacgagaatggaagcgccattacttgagcgtctcaactggcgaagcgatcctttcgctggttggtttctaccatggtgtgaccgtcctttgtgcgattgtggagatggatgcatactcaagtcttccctcatgatacaaactcggggcaagagattcttccaatgcacgaactttgatcaggtatgattcatctattcgaagttcaaatggataaaaactaacttcttcgtacacaatcgtaacatcttacgcagacatatcgtccaatgtgcaacttcatcgagtgggtagacatggagaacccacaaaacgacggaacacgtgcatacccatgtagtgaaacaagatcggactacctaaggcggaaggatgagcatgaacgccgaattgctgctgaggctttagaatggcaggtaaatcccctaggactccccacgtagcgtgagtgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctctgtactatcattaacttaactatccccacaatggatgtacataggaggatgtaaggaaatgtcaattcgtacaatggattgacacagtcagagttacttccagtggcgggccgataacgtaacctgaaccgaccacacagttcattcatgcttggatggagtacgaacgtcgggtgaaaattgcaagcttagactggaggaacaatccattagggttacctagctggtccgagcgtccaaagtgtgggtgcagagatcgctgccaagtggctaccacatttgcagaacagacatttggaaggagatattttgtctgccccaatgtagacaacaatttcgttgtatgtctaaccgtttccaaaatctgctatgatttgcacaaaatttctacccaaactgaataacattactattttttcatggcaatccaaggatgtgtggatttactcggtggatcgacaatgtcactccatcatatcatggccaaaagatagcagagtcagaaacacaagtagagtatcaacgattgaaggaccacgagaatgcaatgcatattgaccaacctagaaggggctgataggttaccacaggctagattcgtcgggaccgacaaatttgtatcgtgtatcgatggcacttcttacctatcttatcattacaatgtttaattatgatggtgtatttttgtatgcgtaagactaaaaaataataaaattggattttaccaatctttgagattttaatcttgtattgagttttcaatataaaagattggataactattgataattataaaaatatctatttctcaaataaagggttgcacagtgtaaaatcgccctcccccagggcggaaagggggccgcctgcaaaattccaggccccctcgccgcccatttgcaggcggccccccgcacaatgtaaaatcgccctcccccagggcggaaagggggccgcctgcaaatttccatgcccccctcgccgcccatttgcaggcggccc

SEQ ID NO: 80382 - DNA, 11529 bp, Oryza sativa
ccttttgcgccgccgtttctctctccacctcaacttcggcgtccgcctctcgtcgccgtgcgccatctccacgccgtcccggagctcggtgctgtgccaccgcgttggcctcgacctcctctgcctccgccgctgttttccgtagccgccgtgcaccttcgccgacgaacgccgccgacgccgccgcgctggagccgccatggcgccatggccagagcacgcccaggcctgtggtggagcagctactcctcctcttccctgtgacactgacgtgtgggacctgccatccaaaaactcaaaataatcacagccgtccaaatccctagatcaaatcccaaccgttggatctacataatccctaacatatgccaccttagccctagatccaaccatgtcagtaccaccgcatcgccttgtgtcgccacgtgtcattccacgtcatcgagtccacatacaccgagtccacccatacactctatgccactgacagtgggcccacatatattttcctatccaaaattaattcaatttccgaaattaaatatccagagaatattctcgaaatattcctttttcttttaccttcggattttccctgaattcaaaattccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgtaatcgtgtagacgttggagctgaagagcatttcgcttcagaacacgctgtgcaaggacagtactgggatcaaggcaagtgcactctttgaacatattgaacccatttgtgaaatgttttgttttgaatacatgcattgttttgtttataaactatcgaagggtagcgtgacctaattgttattattatcctacctttggtaattattgattgcccatgataccttgtcaccctagtctttgtgagttgaacattaggctcaactcaaggtagagtagttatgcttagccgctcaaggttgttctacaagcaaaatataattttgattaatcatatacttataatcacttttatatgaactgtgtggctatgtgctatcttttcggtagtatgtgttgcaccatgtaaaacaacgggcggataaaacatttttgaccggggtgatgggtggttctgtgtgaacctggttaggtggtaatgtatctgtgtgatcgttcccgggtatggtctctgtgtgagtctactgttgagctgtgtgctattgtagtttggcaagagttcttggtcaattaaggacttcacttcataagtcatggatctgagcctaacgtgcaagcacatgttctcatgggaagaacctggcccagtaggattccgagtcttggcactatcggcccaggtggctagatgataggagtttaggttcgccatggggactttcttgtctgtgtgagggaaaggtgtctcatgggggaaggcagtgttgggacggagtttctaaaaagccttgttacagtctccttggccacacacaacctgaagtgtgacacttgcgcatggccgttaaaaggacgatgtatcttgtgggtcaagctgtacaacctctgcagagtgttaattaatctattcgaatagccgcgtccacggtcatggacatgcacggtgatatctcacgaggggtcgtttgtgaaaactagaaatgaactgtgtgcaggttaatgaatatagctatgtggtcctgtgtggatggatagttggtaatacccattatttataactattattttaaacctgtttataaattgattataactacaaattgctgtgttatgcaaaatagccattgcctttgttgtcagctttgcatatgcatatttctgtgtgcttgctgagtattccatgtactcaccttgcaattcccctaattctagaagaatggttcccgctgtttcctgagtcccagtttgctgctgaagacgaggaataggtcatgagtcccagttgactgcctatggcaagttgaatggagctactacgcatttattatatttccgctgctactttaatattgtccttaggccctttgtggcagaataaatgtaaactttagccataaggcttaacacagtcattattattgttaaatattaggattccttcatgatgttggctgtgatattatctttgagtctgtgtgtgctagcttgatcctggactagcacttatacacaggaggtcctattttgggtcctcacagagttggtatcagagctgcgtcgactgtaggccgcaaccttagttagcctggtcttatttcaaaactgttttcaagaaacgcaaaacaatataatgtgttcttcctttccttgctctttcttgtcttcctcctttcggaatatcttcttatctgttttaatctctaccgtcagccatgggaggatgttctacatcagtgctgctttggagtcttgatgaagttttgtcggaaaccaggtttagttgtagaagtggtttttgtcgtaggaccactttgcctctagttagtagttcacgttagtaagacgttaagcttgggtgttagaagcgttgcttgtttttaatttttggttcttccggtttgttgtacggtatgtttgaagctcccggctttcaaacaatcgtacgtgtgtttcgttaggatgtgtagttctacccccttaggttgccttcttcttagagttgtttttttcttcttagtacctttctaaccagccatatgttgtatagatggtgaacactaggaccggaggacatggttcagagcatgagaacactgatgcccgcactactagtcagcaaccgcctcaagcaccccaggtgaaccaacagaactttgaagtcttcatgcaagcccagattgagctcatgaggatgatgatgcaacaacttcggaaccagcagcaacagcagccgcagcaacaaccccaaggcggtccacctccacaaagcaagatgtttgagtttctacgtaccaagccaccaaccttcaagggaatgggtactccactagaagcagaagattggatgcgtaccatggaatgaaagctggacatcactcagtgctccgatggagagaaagttcgtttcacagtccaacagttggaaggagctgccttagactggtatgagaatctcaggggaggcttggatgacccggaagccttgacctttgaggagttccatatggcttttcgtgattactatgtcctggcatcaaggagctgaagaaggaagaattccgtactcttcaataggataacaagtctttgcagcaatatctgactcagttcactactcttgctcgctatgcaccagaggatgttactagagatgcagatcgccagaggcatttcctgaaaggtctcaactctggtctcaaggtgggacttgtggcacatgattttagtagtttccagagcctggtgaacaagacccttttgttagaagaggaacgcaggaagcttggtgaagaccgcaagcgcaagatgaaccagcaagcaagtggtccgagccagaggccacgtggagcattccagcagaacaataactgtcagctagctgctccacagttcaggactattccacagacactagtcctagcagctcagacccctcgtcaggctactccaactcaatctgtgcgaggtcaaggaagctaatcattcattcgtcgttgctacaattgcaaagaagtaggccatgtcaccaaaaattgtcctcatcccaagaacattattactccagtgaagttcaacttgggaaataccccagccaaggcgccagcaccaggagtagcacaacaaactgcaccagccactcagcagactatcgtcaggggtcgtgtgaatcatgtcactgctgaggaagctcagacctctacggatgttgttctaggtaagttcctagtaaactcagtacctgcaacagttttattggattctggagcttcgcattcgtttgtttctcggtcttgtgcttctcaacatcagtttcctactatccctcttaagtgttccttacttattcaaacaccggggtcagagatgagaactcaaactggatgtcctagagtaaagattgaaatagagggtgtagagttctttgccaatctgattatgttagatactcctcagcttgatgtcatcctagggatggattggttgcacagcagtaaagcagtgttagattgtggaagtaggtctatcaccttggaaaactctaaaggagaaagagtaaatttcaaagccatagttaatccaccttggaaaggagccctagtgcacaacatggaagtttctgagctacagaaagtacctattgttagagaatatccagatgtcttcccagaagagttgccaggcatgccaccacatagagatattgagttcgtcattgatctagttcctggaatatcacctatattcaagcgaccttaccgcatggcagcaaatgagttagctgaaatgaagaagcatatataagagttgaaagagaaaggttatgtcagacctagttcgtcaccatggggagcaccagttatctttgttgagaagaaagatggaactaagagaatgtgtattgattatagaagcttaaatgatgtgaccatcaagaacaagtatcctttaccgcggattgatgatctatttgaccagatgaaaggagcaggagttttctccaagattgatcttaggtctgggtatcatcagctcagaatcagaacagaggatatcccgaagactgcattttctactagatatgggctctatgagtttacagttatgtcttttggattgacaaatgcccctgcttatttcatgaacatgatgaataaggtattcatggagtatttggataagtttgttgttgttttcattgacaacatactcatctactccaaggatgaaaaagagcatgagaatcatttaaggcttgtgctagaaaagctaagggagcatcagttatatgctaagttcagtaagtgtgagttttggatgaaagaagttgaattccttggacatgttgtgaccgccgctaaagttgtagtcgatccaaagaaagtaagtacagttatcaactggcagccgcccaagaccgtgacacaagttcgtagtttcctaggtatggcaggatattacagaaggttcatagaaggtttctccaaagttgctcgtcctttgacacagttgttgaaaaaagagaagaagtttatgtggacatcagagtgccagcgtagttttgaagccttgaagaagagtttgacgtcagcaccagtgttggttttgccagatatccacaaagggtttgatatctattgtgacgcctctcgtacaggacttggatgtgttctgatgcaagaaggcaaggttgttgcttatgctttgagacaactacgtccacatgaggagaattatccaactcatgatttggagcttgccgcagtagtacacgcattgaaaatatggagacattacctgataggcaatcgatgcgaggtctacactgatcacaagagtctgaaatatattttcactcaacatgatttgaacttgagacaaagaagatggttagaggtgaccaaggattatgacatggggatccactaccatccaggcaaggctaacattgtcgccgacgccttgggcaggaaagcatactgcaacaatgtggagatcaaggagagccagttgtcactctaccgggagtttgaaaggctgaatttagagatagtacctaaagggtttgtggctaatcttgaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaacttgccggacttctacaaccattgaaggtaccagaatggaagtggtatgagattggtatggatttcatcaccggtttgcccaagactcagttagggtatgattccatttgggttatagttgatcatctcaccaaggtagctcactttattccagtcaagataacttattcaggtgacaagcttgccgaattttatgtgaaccggatagtatgtttgcatggagtaccacggaagatagtctcagatcgaggaactcagtttacctcacgtttctagcaggctcttcatgaggcaatgggaactcatcttaatttcagtacagcatatcatccacagacggatggtcagaccaaaaaagttgatcaaattttggaggatatgcttcgagcttgtgctttagcttatacttctaattgggacaagaatttaccctatgtcgagttctcctacaacaatagttaccaagcaagtttgcagatgtcgccgttcgaagctttgtatggacgaccttctagaacaccgttgaattggaatgagactggtgaaagaatggtttttggaccagatgtaattcgtgaagccgaagaaagagttgctctaatcagggatagattaaaggtagctcaatctcgtcagaagagttatgcagataatcgccgaagggatttaacttttgagaaggaagattatgtgtatttaaaggtaaccccaatgagaggaaccaagaggtttcaggtgaaaggaaagctagcccccagatatgttggtccattccggatcattgctcgtcgaggagaagtcgcatatcagttggagttgccgtcttcaatgtccggtattcatgatgtgttccacatatctcaattgaagaaatgtcttcgtgtgccagaagaggaaacaccgctgcagtcagtggagttgcaaccagacttgacctatcgagaggttccaatcaaaattcttgagacagcagagcggactacaaggagtaagaccattcgtttatgcaaagttcagtggagtcatcacaccgaagctgaagccacatgggagcatgaggatgatttgaaggcagagttcccagagttgtttccaagccagtccgaatctcggggtcgagattctgtttaaggggggaaggtttgtcacgtcctgattcacatttgcgaaaattcacatttggtttattcgtctaaaatagcttaatgaaaaattcgttaaatcaaaaggctttaaagtgattaattagttaatttcgttgttcgctttgtgattcttaattggagttagttggatttaatttgtatttcggaagtggagctcaatccctaattcaaattccatccaaatccaatattccttttcaaatcctaaatccttcccaaaaattccaaatactttatatttggaattttccagagaagtccctgtctttttccctttttccttcctctctttttctctattctacccttttgcagtttagcccttattcttctttcttttttctttttcccccaccttcttctacctccagctctctctctccttcttgagttgcaggcccggggaggccaagccccgagcccacgtgccgcctcggcccggcctcctcctcctctctgcatcgccggcccaagccgccaccgaccgagcccgcgccggccgcgccacaagcccaatcgggcgccgccaaatcccgcaagccgcgccgccaaattcggagccgctgcctttccaaagtttgtgccgtgcgccctaaccctagctactctcctctataaatagcgctggccaccgcccctttttccccctttttccaaagccgccgccatctccaccgtgagcagccaccgccgccgttgctccgtgccgccgccgggagccacgccgtcgtcgtcaccatctccttcccgtgccgccgccgctggtaaagccccgaggctgagccctctctccctttcgcgctgccgtttctctctccacctcaactccggcgtccgcctctcgtcgccgtgcgccatctccacgccgtcccggagctcggtgctgcgccaccgcgttggcctcgacctcctctgcctccaccgctgtttgccacagccgccgtgcgccgtcaccgacgaacgccgccgacgccgccgcgctggagccgccatggtgccatggccagagcacgcccaggcctgtggtggagcagctgctccttgtcctcttccctatgacactaacgtgtgggacctgccatccaaaaactcaaaataatcacagccgtccaaatccctagatcaaatcccaaccgttggatctacataatccctaacatatgccaccttagccctagatccatgcatgtcagtgccacctcatcgccttgtgtcgccatgtgttgttccacgtcatcgagtccacatacaccgagtccacccatacactctatgccactgacagtgggcccacatattttcctatccaaaattaattcaatttcagaaattaaatatccagagaatattctcggaatattccttgttcttttaccttcggattttccctgaattcaaacttccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgcaatcgtgtagatgttggagctgaaaagcatttcgcttcagaagacgctgtgcaaggacagtactgggatcaaggcaagtgcactctttgaacatattgaacccatttgtgaaatgttttgttttgaatacatgcattgttttgtttataaactatcgaagggtagcgtgacctaattgttattattatcctacctttggtaattattgattgcccatgataccttgtcaccctagtctttgtgagttgaacattaggctcaactcaaggtagagtagttatgcttagccgctcaaggttattctacaagcaaaatataattttgattaatcatatacttataatcacttttatatgaactgtgtggctatgtgctatcttttcggtagcatgtgttgcaccgtgtaaaacaacgggcggataaaacatttttgaccggggtgatgggtggttctgtgtgaacctggttaggtggtaatgtatctgtgtgatcgttgccgggtatggtctctgtgtgagcctactgttgagctgtgtgctattgtagtttggcaagttgccttggtcaattaaggacttcacttcataagtcatggatctgagcctaacgtgcaaccacatgttctcatgggaagaacctggcccagtaggattccgagtcttggcactatcggcccaggtggctagatgataggagtttaggttcgccatggggactttcttgtctgtgagggaaaggtgtctcatgggggaaggcagtgttaggacggagtttctaaaaagccttgttacagactccttggccgcacacaacttgaagtgtgacacttgcgcatgggcattgtcacgaccggaattaacccaacgggcgttccttacgtgcgtgcattattccttgtcccaggaggcaaggtacaccaaaagttgacacagttcagagtttaacaagcggaagcgtaaatagttaatttattacatgggcggcgaaggcccagcatacacaaagacaaacgggaaacagcggaagactcgggcgacgaccacaggcgcttgacggcaggcacgagctagacaccaaagccttcctcatccaggggctcctcttctgggtttgggaaaaattgagcaagactgagtacaaccaccgtactcaacaagacacacccacaagtgcaggataaatgcaagggactacaagggggttataatataatgggttagagtttgcagcaaacaacattaaaagacatttagttgctcaaagctattttgtaaatacgatcctagagctatacattattattaaacaaggccatgaacccacacgaacctgccttaacccaaggcctacgatgattcagaccgaactggcaacccgaccctgggtcccagctcgtcccaagccaacctaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcctttgccctagagatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactaacaaaaccatgcaccccgagcccagcctaaaaccattttgaggattttgaatagagggggaggtgtgaatccaattctacaataatccaaccattccatagtgtccaggtgatatgaatatcccaaagtctagagttgtaaaaccacctaatgttgcctaattaaccagtgaagcatctacctaaaatcatactagtggtaccatgagtagagtgtccactagttggggttttgtttattctagggtgaacaaggtaataataacaataacaataataaggtcataacaaaggtacataggcatggctagataaaacagtgataacgcgggccattcaaataaagcgataatgcaatattttaaatcaaaataactttataaactaggattcaatatgttcaaggatgatgtgacttgccttgctcgctttcccaaacgtcggcttcaacttccacgaagagcgtatcttccgaagctgcagcatctacacgaccaacggaaaagaaaaggattttactctaattttaaaagggtttattgcgtcagccgagggaagggggcgcgcggaccgggtccaccccacgcggcagcctcacggtccacggtggactgggtgcacccgggctcaccggccgacgccgtgggtcccacgcgtcagccgcacctaagg

SEQ ID NO: 80383 - DNA, 8825 bp, Oryza sativa
tgtcgccgcctgccggatccgccgcccgcgcgctctagtcaccagggaggggagaggagagggaggaggggaggagccgcggccggatccgtggcagggggagggcggccggccgccggatccttgcggggacggccgtcgccgccagatccgtgcggggacggccgacgcccaccggatctcgtgcctccaccgccgcgccgccaccgccgccgccattgatgccgccgcttccgcctcccttaccgacggcgccggcatcgccgaggagggagagggagatgggaggatggggaggaggagagggagagggagagggaggatgaatggagaggtggtggggagggtgcgcccgtgacgggagaggataagggtgggcgcgtggggtgggctattttcgtgtgcgggacacttaacaagcccgcacgcgacgtccggatgcccttttttatttttctgtgcggttgcacttatgggccgcctggaaacaaactagtctggtgtccaaaaaaatatttagtgtagtagtgctactacacgctcggcatggggatggccagggaggggcgagcactagatcggtccacctcgatcaagttgataatttgcgctatatttactattgtttttgttaaatttgaaaatgttggtattattaattattgactcctccaacagctattggcactcgatcgtaaaaaaaaaactaaagttaaattaaactaataacccgaggaaaaaattacaaatatacttatttttttaataatatatgtttatatacatgcgggacagcgacggttccgtagattcaaaacacaggatcgatggccctgcgcgcggaaccgtcatggtcccgcagctccaaaatgcggaaccacgacggtcccgcggttccaaaacgcggaaccgcagtggccagcgacttcagcactgtgcagcatagtttatacactgttttgactctgtgcagcactgttcacacactgttcatgctcggtgtccctccattgtgcggaactgacacgggaacagtgtaaaacagtactggaaacagtgtcaaacagtattaaacacggcgccacgcagtaaaaaaatgttgcgccgcggttccgcacactggcgctgcgggagcgtactggctccgcgttaccggcatgcgggactggctcggtcccgctgccccattccgcgcgaacgccttggccgtccactccgcgccgtcacgccatacttttgttgcgctccggcggaaccgatatgcggattagttatattttcacaaattctttatactagtgtatataaacgtaaatctttttcaaaaatggatattttcaaaaatattttctatcggtttgatccccttcctttgtgattgtgtagctcggccttccacaatcccttcccatgtcgttaatttgcaccaacctatgaagccacgatcgcccaaggaaaaaaaaatggaagaatgaaaacaaccccctacttttagggcagttgagccacctccaatcacatcttaaatttgctacaatacaactttagtggtttgtagtataagtttaaatccaatccaagagaacagaaagagctggcactctcgtaattggtttttgctatttcggtctcttcgtgcgtggattaaatttgattatatatataactaactgggtggcccgcacaattgcgcggtagcactcatacaaaatcatttttttaatatgattttacttaaaatttattaaatagctatctcgttgacttaaggatttgattgaccaaaccttatcatccttgtgtttctactttcgtagtctttaaaagacacaccagttgctactctttacttctgtcacctcttctttcttttcttttttttttgcttgtttggtctaccattcatctctttgtaacatttaaaaattagaccttatggtttgtagagtttattttcttgttaggttttgtttttataattcttagaagtcccgtcaaacgttgtcattatactcatctacggtctatccgatgcctcatctatttattgtcattgggattttaaaaattgaatataattatcatttgggtttatttttttactttctagaagtcccgccaaacagtcagcggctttgtcactgtatttccctacggctcacccattgcctcctctctgtattgtcattgagatttttaaatcgggcattattattattattattattattattattattattattattattattattattattattattattattattatttactttgtagaagtcccgatactttaaaaattggaccttatagttattatagtttgttgtcccgtcaaacgctatcactatactcgtctattgtacgaccgctgcctcctctttttattgttattgggttcattttttactttctagaagtcctgccaaatcattagtggctgtcattgtactcctctacgactcgcccgatgtctcactctttaatgtcattgagatttcaaaatcaaacatggttatcattagtgtttatttaattaatctcgtgttgtaccatatatgaactattctttcaatatacttcattttaattttgaattttaattatttctaaattattcctattagaaatctttattattattgcgattttaaaaatcgaacctgatcattatttggttttgttttttaaatagtttgtagaagtttctctagccgtcattgtccatctcctttgccactctagtcttgtcgtcttaataatacaatacaattcattttatcttttattctatatggtagttttctatcaatattttttatttctgattttagttatttttaattgtatttgtacttgaacttttatttttttctattttgaattttcttttatttttatttcgaatttaatttatctcatgttattctctagattgacagttaattatttaaatattttcttcttttaattttaattttagttatttttaaattttattcccacttaaactctattttctctcgctgattaatgtgataacttttatttcagattccagttatttataaatttattcctatttgaaatttttttttatttttctaatttagttatttatgttttttattataaatttcagttatttatatattatattcatacttgaatgcaattaatgtggattttttaaaaataactaaatactatttaaaaatgagcttgccttttggcagtccttgtccgatggggaattcaaatagatggattcttgttttgttttcgagtatttttatatttttctagtatttttacatcttgtgcataggatttgtccggtacttatttctgggcaatcaatctcaaccattataacatctcatgtccagattcatagctagagtttgcccccctttttaggggggatagagggagtatgtccaccatgaattggtgcagatttttttctttacttattattaatttggtaatttctagatatccttatataatatttggatatattattaattgtatgagccattgctgtaacgggcagactaccaagcaagaggattgattttccatttttactgagcttctctgatttttttttttttgaaaaaagaacttgttagctgtccttgtcagccttgcccgattggaatttgatagtccgaatagaacttggactttttaatttttgctgcgtagtttcttttaaaaagtttgaggactcttacttttttatatttgtacaatcaatctcaatggttaaattatagatctatcataattcaatggtgtagattttctctttttcttcgattaatgtggtaatttctagccactacagcgaacatgtagtctcctttcaaggctgttttaaatagatatatgtaacataataatttatattttctatttttgaaaaggttctatgaatgatatttaaatcgcatagaagaaatgatatctcatagcctaggacatgggacatatccgggataaacttatacctaatttgttttttaaaaaaacatttaaatttgctatgtataatacatgtgcatatgatttgtggattaagaacagctatatttgattccagaattggaaagtagcaaaaaaaaccctccagatcaacgtctatatttgatcataaaatattttactttgtagtttgtaataatttttccttgataaagaacttttttttaatgtattgatgcttcttttctagtttgtaccccacctttcaaattccacgtccgccaataatattattacagcttaaaatccatttctccattcctcccttaaaaaaacgctagatataagaaatagctcttatatcaaaatttattaagagatggctgagaccatatttgtggtgctaaacgaaaaggggaatatatatattgaactaccattgaattgaaaatttgacatatgagatttgtctacgtcatcacgagtaaaaattttattgatagatttactcacgggagtaaattttttactcataatgacatggacaaatctcatacattcattttttatcgaacgataattttcgagtttccacgatatgtggtttgcccgatatatatatatatatatatatatatatatatatatatatatatatatacccacgtgaggacgtaaggtcactatctttccacctctatataagcacgtagcattagtataggtcggtattaagcaagcggcaatacacaaacacacgggtagctaagcaagctagcctcctgaatactgtcatggcaatagagtcagctccggcgcgaaatgagcggcgcggtcagcacgtcgtgctgctggcgagccccggcgccggccaccttctgccggtggccgagctcgcccggcgcatcgtcgagtacgacggcttcacggccacgatcgtcacccacaccaacttctcctcggcggagcactcctccaccttctcctccctcccgccgtccatctccatcgccgcgctccccgaggtgtccgtcgacgacctccccgccgacgcgcgcgtcgagacccgcatcctcaccgtcgtccgccgcgcgctcccgcacctccgcgacctcctccgctccctcctcgactcccccgcgggcgtcgccgtcttcctctccgacctcctcagcccgcgggcgctcgccgtggccgccgagctcggcatcccgcgatacgtcttctgcacctccaacctcatgtgcctcacctccttcctccacaacccggtgctcgaccggacgaccacctgcgagttccgcgacctcccgggccccgtcctcctcccggggtgcgtgccgctgcacggctccgacctcgtcgaccccgtgcaggaccgggccaaccccgtgtaccggctcgtgatcgagatggggctcgactacctccgcgccgacggcttcctcgtcaacaccttcgacgccatggagcacgacaccgctgtggcgttcaaggagctctccgacaaaggcgtgtaccctccggcctacgcggttggcccgttcgtccggtcgccctccggcaaggcggcgaacgacgcctgcatacggtggctcgacgaccagccggacgggtctgtgctgtacgtgtgtctgggcagcggcggcacgctgtccaccgagcagacggccgaggtggcggcggggctggaggcgagcgggcagaggttcctatgggtggtgcgctaccccagcgacaaggacaagacggccagctacttcagcgttagcggcgacggcgacggcgaggacagcccgacgaactacctgccggaggggttcctcgagaggaccaaaggcaccgggctcgccgtgccgatgtgggcgccgcaggtgtagatcctgaaccaccgcgccgtcggcgggttcgtgtcgcactgcgggtggaactcgacgctggagaccgtggcggcgggcgtgccgatggtggcgtggccgctctacgccgagcagaggatgaacgccgtgatgctgtcgtcgtcgcgcgcggggctggcgctgcggccgagcaacgcccgggaggacggggtggtgacgcgggacgaggtggcggcggtggcgagggagctcatcacgggggagaagggcgccgcggcgcggaggaaggcgcgggagctgcgggaggcggcggccaaggccacgcgggcgccgggcggcccgtcgcgccaggcgttcgaggccgtcgtcggtggcgcgtggaagaaggccgccgccgctgcacgtggcggtcgtgccggcgagcccgacgacaacggaacagcagtgacggcccaatgatttgtgtcggtgtcggcagatcgatctggttcgttccctcgcgcgcgcgcggcgttgtgggctcgtgcggttcccttcttccccccggttgcaaacacgtttgtctgcttggttggtggtggtctgatgtgtgtcagtgtcacgcctagctaggcctagcttgtccaaccggagctttggtgtttgtacgtaccatacgtgttgtgctcggtaattgtacattaagggtgtttagttcacgttaaaattgaaagtttggttgaaattgaaatgattgatgtgacgaaaaagttagaagtttatgtgtataagaaaatttgatgtgatgaaaaagttgaaagtttgaagataaagttgataactatacaagggcatactctctctatcaaaaagatataataatatagaatttgatttgatataatatagtagtataatgaatcataaattattggttgttttatttaaaaacgaaaagagtacgtgatgtgctatagtgatcgagatgtgtacatgtgataatgtaagggatttttttaagtagtaccactactataataccatttttccgggcagttagatttattatcccgtgcggtcactcggcccgccgcagctcctcgtctaagaaaatcggtactttcgcgtgcgggccggctgaccgcacgggataatcgattatcccttgtggtcgacttaacacgaccgcacgggaaaatcgattatcccgtgcggtcgtattaagtcgaccgcgtgcggtcagtttcaccacccgcaagaaaaaaaaacgaacaaaaaaaaataaaatcgaaacaatcccgtcgtcgtcgctgtggtaatcgacaccaaccctggcagtgccatgtgtggaacagcaacaggcttaacacaagaacgatgatggatgggtcagtggatgcagcagcaaatcggcataattaatggtcccttcattttcgcaaattacaacggaaaattctaaaaaaactgaaattatagatagaaatcacgtggttcactgatcattaaacagtgggcgatggcactggccttgttcatgccatcgaagctctcactgacactctccatggtcgtcgtcgccgtcgtcgcgccgccgctcccgtcgtcgtcgtcgtcgccgtcgccaacagccgcgtcgccgcagccgccgctccgcctccgccagcattcgccgtcgccgccgctcccgtcgtcgcgcagccgctgctcatcgtcgcctccggcctatgctgagcgcagcaagccggccggcgatgtcacctccggcgggggcaccctcctgcctcgccacgcgcagcccggcgagcctgtccgcgaggccgtcaccgtggagatggcgccggagacggtggtgcaggcggccttgtcgaggaagaaaagcgcgaactcgtcgccgcactccggctccgcccaggagagcgtctcgccgtccatcctctcgaaggcgtcgccgggaagggaaggggaggggaggaaagaggaaagaggcagatgtttacagagagagagagaggaaagaggcgtgtagcagtgagaataaaaaggaaaaagaaagagagagggtgtgaaaaatttgaagtgggtgagaaggaaaaaaaggggaaagagaatgtaaaaaatttgaagtgggtgggaggaaaaggagggaggtatttttatgtgcggtccactaataaaagtccgcacgtgaaaaacgattttcccgtgcggttcttttaagtcgaccgcacgggataatgaggattatcccgtgcggttggattaagacgcccgtacgggaaaatgcatttttccgtgtgggcgacagtctggcaccggtccctctattttctcatacagttccacttacgggccgtatagaaacaaaagaagatggcgtccagaaaaatttatcttggagtagtgtacggtcacatcaatcaactctagttcatttttttctatcttattccaactacctaatccacatacagccaagaaacacttattagaggcattttagtcatttatctccttactcctatatccttaatttctcttactcccccgttccaaaatataacaacggattatatgggatacatatctctgtttaaattcgttgtattaagatgtattccatccaatcttagtttactatattttaagatggggtgtgtcggtgacatgggaccgggggtatcttgactagaggtttggggcagccgcggtcacccacgtggcctgaccccctcggggggggggggggtcgggcccgagggtgatgtggccgcccctccctctgtctccccgaggggttgggccgctcccgtttcggccccgagggctggggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtaaaaacgggctgca

SEQ ID NO: 80384 - DNA, 17452 bp, Oryza sativa
aaatcgccctcccccggggcggaaagggggccgcctgcaaaattctagggcccctcgccgcccatttgcaggcggccccccgcacaatgtaaaatcgccctcccccagggcggaaagggggccgcctgcaaatttccatgcccccctcgccgcccatttgcaggcggccccccgcacagtgtaaaatcgccctagcggagggcggcaagggggccgcctgcaaatttcattgacggtcgtcgcccgagagtgaacggacgtctgccacgtcacatttgccgccctctgggagggcgatttgcctcccagagggcagcggacgactacttctgtcaatttttgaaatacaaaattatttttgtaaatcttttaataaaaaaaattaaaaataaaaaaattcccggtttttctgggccaattggtgggcttccaagcaggccaattggtgagcccctcatacttgtcaatctggtcgtcgtcaccaacgacctgccggccacccggccgcgcgcgtttgatgacggacatgacatccaccaccaaccaaccgatcaatcgtgtcgcgccgcctcaactccgccagttcgccccctccacgtcgacccattcttgtagtggcggccacgacgacgcgcccagccatggcgatccatacaatatcccctcccgatcgaacttgctgccggccggctgcattgtctccggccttaaaactccagcaacacgtacgacgaacaccccgtcgacggcatggagcgaaactgatcggagagatcgagcagcggcggccggcggtatatatatggaggaggcggggagcttcgacgccgccggcgtgtacccgatgacgctgccaagcccgaggatggtcgtaccggcgaaggatcagtcgccggacaagccgtcgggcttcaggaagagcatcaacccgatctacgccgacgccgtcgtcgtcgacatggccgccgccgccgcccgtccgtccaggacggcggcggcggccgccgtcgaagacgacgacgatggcggcgctgctccggcgctggtgcggcggcacacgggcggcgccggggacgggaggtgggaggcgatccgggcggcgagcgcgcgcgagtcgccgctcagcctgggacacttccgccttctgcggcggctcgggtacggcgacatcggcagcgtgtacctcgtcgagctccgcggcggagggagcggcgcgctgttcgccatgaaggtgatggacaagagctcgctggtgagccgcaacaagctcgcccgcgcgcagacggagcgcgagatcctcggcctcctcgaccaccccttcctccccaccctctactcccacttcgagaccgacaagttctactgcctcctcatggagttctgctccggcggcaacctccattccctccgccagaagcagcccaacaagtgcttctccgagcacgccgccaggtaaaaatttcttgttcgatcgatcgccggagttggagaagaagaggaggtgaaattctgaaatcatggcgatcttcttaggttctacgcgtcggaggtgttgctggcgctggagtacctgcacatgctgggggtggtgtaccgcgacctcaagccggagaacgtgctcgtcagggaggaaggccacatcatgctctccgacttcgacctctcgctccgctgctccgtcagcccggcgctggtccgctcgccgtcgggccgtgtcggtgccggcgccggactggtgcacggctgcgtgctcccgcggattctcccgagaaggagcggcaagaagaagaagaagcagaaggggaatgaccaggaggtgacgtcagcgaccggcgacggcaacggcaagaacaggccgccgccggcgacgtcgctggagttcaccgcggagccgacgggggcgaggtcgatgtcgttcgtgggcacgcacgagtacctggcgccggagatcatccgcggcgaggggcacggcagcgccgtcgactggtggacgttcggcgtgttcctgtacgagctgctgcacgggacgacgccgttcaagggctccggcaaccgcgccacgctgttcaacgtcgtcggccagccgctccggttcccggacgcgccggcggccagcgccgccgccagggacctcatccgcggcctgctcgtcaaggagccccagtccaggctcgcctaccgccgcggcgccaccgaggtcaagcagcacccgttcttcgacggcgtcaactgggcgctggtcaggagcgccatgccaccctacatcccggaggcggacgtcgccgccgccgccgtggactgccgctcgccgctcgcgcgcgcgacgcagggcggcggaacgccgaagaagagcgccgccggtgggaaggccagctcgccacgggatgatccgtcctacgttgaattcgagtacttctaggagaaaagatcgattattatcgcgttaattgttttttcgttggatttttgtatttcatatatttgctcggatctttcatgtgaaatatgccaaagttaaggcatgctgtgcttaattatgtagattgtcctctttcttaaactgagatttttttgccgattcctgcagaaattataacactgtaaaattccaatgaaatcatgcactccaaaggacgaaaaggatatttagcgagagatcatgtgtgggatcggattgtgatcagatcggaatttcagtttttgacaaccactgcttaagaccctgtttagatggaattaaaattgtttggacacgaattataaatattaaacttagagtgttaataaaacccatccataatcttggactaattcgcgagacgaatctattgagcctaattaatccatgatttacatatatgatgctacagtaaacattctctaattatggattaattaggcttaaaaaatttgtctcacaaattagctttcatttatgtaattagttttggaaggagtctatatttaatactctaaattagtgtctaaatacagagactaaagttaagtccctggatccaaacaccaccttatcctaatttctttttcgagtttccgcaaggtctccatttttttcttcaaactttccccacgctgtcctattttgtgtgatttttataggttggacctttgaaactagtaaggccgaccctatttgatttgttttttacttttgaattaccagaaaaaagcccgtgtattgcaacgggtaaaatccattttaatcttattattgttatatggtttagttaagatgaaatttatggaaattcacttggatatatatttttagaaaataatgagctgcaattaggagtccgttcgtctaaagttaccatgcgagttttcttatacgactccttctgtatttccaaaagcgaacgaacttaaaaaccgattcaaatacgtatatgtatttctaacagcaaacgaacttaaaaactgactcaaatacggatatgtatttccaaaagcgaacgaactaacaaccgacttatacatggatgacgtaccaaagtatcggtaaaaacatcttcaatttttataatagtagatattataatttatttatttacttttatgatgaccaacaaacatataataatatcatatttaaaataaaattttatatgtataaaattgtatgcataaagtttacatgttcaaagtatcaacgaataaagtttatataccaaatattttattataaagtttttttgtcaatttttttaagtataaagtttatatacctaatgtttctattttgtatgtataaactttttatatagagctttgatgtataatatttttgggccaatgtaaatacaaataaatgtgtgggtatttttcctagtttacacgtgggccacaagggagagggggggagtgggcagagcggtcaaccgcataatagacccttcaaagaaggctatttagtgtcccaaaatgttagcattgtggttgatttttttttccactggaccggcaaaagccagccaaaactttattgagatgcaaggaataaaaggtaacaaagtaacaagcaaggctattgaagaaaaaaatcgagaaaacacagtaaaccccctcccaacgctagaagtgaacactaaaaaaaaaaatttacaccgccatcctgatcaacatagcttcgtgtcaactccacaactcttccatgatcttatccacaacagtactaggcgaggaagatattgcccgaaaatcctttcgcttcactcttttcaaatgaaccaagtgaccaagattactatcgagttgaaaaaacttctgggttagtttggttagtggcctaaattgactttactaattttcttgtcaatgctaaattttagaaaatttagcatggctaattttaacaaagcatagctctgttaggattgaagtcaattttttgtttttttcaccttcatgttgatattctatacatcagtttaagattcagatcaccaagacatgcaaaagccaacatcttaattctttgataattctatgttttgcaactaataagcaattggttggctatcggcaaatgtggttctataaaataccatagcataaagtattttcttacctcattttgccattgtagttagtcttctgtcaatagcgctctattaacacagttgcaaaatggccattttacccccaacaagtgtatctcagtccaagaagtgctttatgttttctaggtgtaacatggactattaaatggtcatggaaattccggatagtccaagcaccgtttccgtataaaaggcactgttattacccttttcgttatatataaattttattctttctaacttctttctacatctgagtagtttaaatgataatcatggtcaattaccgattgatcgagcgttgtttccaaagaaatgctaccaattccgactgtttcacccctctatttgcataagattaattaacgagagactgacgtagatgacaaaagaagaaaagaaaaggcttatacactggcatttttcataaaaccttagttagatgatggcaaaacatagaacttactgttcaatggcaattgacaaaaacaaaattcttagagattcttccttatgcgtttgaaaagttacagtgatctgagtagtacccaaaggtcctgagttcaaatctcctatggagcgaatttcaaattgggttgtttgcggggctaagttccctatctcaatggccgtatatatccggttggatatggaggccgggtagaaaatacccttctctaaaaaaaattataaaaaaaatgcgtttgaaaagttagtgccctgaatggtcttaagtccagttgatctggcccaagatggggaaatatagtcatgcctaaacagcagcaatcaggaagcttcagcccagctgatacaactggggcttttcatctttttaatgatgagctgggcttttggtttcgtccaaacgcaatagaaaaaatacaacataatttgattacatttgctccattttttctgtcctggggacagttaactctttttaaacgttttcctcattatcctaactgaaacattaatactataataatttacatatatatagttaatcattcaaaaacacacatataattaatctataccatttttatagacctataaaacaagtgtgatgagaacgactgaacaacgtcctagatcctctgcattacagcataaaatgatcactgtagcaatagggaaaatacgtctgctacagtaatctaacgcgtgagtaagcagcgtcgttgtactgtatgcccccggaaataatgtacctctgttccagaatataataagttttagagatagatatgattattaagagaataggtaaaattaagtatggagggatgttgtgatcggttgagaaatagagctagacagaaaaattaaatggtggaggattgtgattggtttggaagatatattggtaaaaaggtgaacactagtacagaatggattttttttcctggcggccaatttgcgttttctatagtggccgacgttgccaccaatgactaaagaccaatgaaaatcaaccatcttcacaaacggttaggttaagctgactgtcagggttacgggtaaggtataccctctacccttcgatatatgtcacatatcgatatggtatacttgcacgtatacggacgttttcggcataagttaaggaaattcattatggagttcacagatgtaaggagtcctactcggatagaactgggtcgtcattgtatcatattgggtccgatgtctccgagtcttacttgaagaccagttgacctgcggtataaaagggaccccccggaggacctaaggcatcgaatcttaccgccaacatatccaccacagcctacgaagccggagcttacaggagccaagtcgccgggtgatctagtcgaatcaactcgactacgatctcgtcggtatcgtcgagttccactattccctttgtaatctgtggtttccatcatataatcccatatcaactggattagggctattacctatcaaggggcctgaaccagtataatctttgttttttgcctgcttgatgtcgtattacgtagatccttgtaccagcgtaccccaataccctctatatccggtctacgggtatcccccattgacactgaccatcaaggaaaaaagattttcgagtacaaaatgaatttcccaaatctgctgcccatgctcaagctccgccatcggatgcgctacccatgccccaagccatcgccgaatttgctgcctgcctccagcgaccgagctccaccgcctgtggcaaccccaccaccttgagcctccagatccaccacccaggccctgagccaccacctgtccctctgcttgatctgggagaggggaggggattggaggtgctgccggaaccttctcaaggcctagctgtcgtcatggtagccgccgccggatccacctcctccaccgtcacctgcccttctccttcaccaccggggcgacggatctagcagttccgagcaccaccgccgccgttgccgacggatccatcccctccactgtcactgtcgctggctagatgcgggagagggaggggaggcgggtatgccaaatccggatctatgtccttgcttgtcacttaagagctccgcttgcaaaaagaactctatttttgcaagtagatctcttaattgacaaccaacgaaaattaatttgggttggcggttggttaccgaaatccccatcaagtatttttgggttggcggttggttaccgaaatccccatcaagtattttttaaaaccgtgtgctcattaaacctgctagtaaaactaaaagggcgatgctatggaaaatgattttttaagtactgtaagggtgttttcaatttactatcattttcaacctgcaaaacatttttacagccaatggtattgcaacaaacaaaatatgaaaaacccaatactatcgtaccaaaatttagtaatttaagagggtttcgcccttagaaactctgcaaaactttaataagggttcgaacaaaataaaaccaccaaaattaccaaaatttgacattttagtgtgattaaaaatgacagcataaactaaaccggatctagtatgcaactcaggccctgtttagttcccaaacaaaaatttttcaccctgtcacatcaaatgtttggacacatttatgtaatagacaaaaaaataattacacagattacgtgtaaattgcgtgacaaatcttttaagcctaattacgtcatgttgacactgtggtgctacaataaacatctgctaatgacagattaattaggtttaataaattcgtctcgtagtttacaggcggaatctgtaatttatttattattagactacgtttaatactttaaatatgtatccgtatccaatataacacgctaaaattttttgtcacgcgaactaaatagggcctcactttccattttcttctccgtttgaaacaggcaaaaacctttgcgtgtgagcgtgtcagacaggcgcaagaaggttcatttcgaattttgtagatggaaacatgcatggtaggagtacagaatatccccccacccaggcaagtaaccgccgagctaaccatcgatcgatggagccaagccaactagggtttccaaagccccaaatgcaacgtatactccactacgtactcgacttccatttcatcacgcatccacggtcaagaacagctggcgcggaatccaataatccaacgcacatatacacggaatcgaaaggttggagatgccaaccgttgtctgtacgagaccaaaatcattggccaccaaccagccacagccgcccaaccgaactgatcaacccatgcgaaacacccatgttaatactactgctaagagcaacccgcaatggtaaagtaaggcgctatctataaaacatgtatatctcagcaatagactagattaatagtaaaccacttcaatggtatgtctacatgggtatctatagctctctaatccattgcctcatttttctctatagactatcttcaagttagtagatagttttgctctctctcttcatttaatctcttccaagtagaaaaatatgttgacatggatctcttatagagagtctatagataaccattgtgggtgccctaatagtagcagaacaggggctggaagggccaattgatgatgctaatgacgccctaatcctggattattaatgtaaccaaactcatcattgctaattattagtaaccgccagccatatgcatatgcacccaggctgcatccttgcattgcatgccaccgaactcgatcatgtttgttgtgtttatatatatgctcttttcctattgctaagtaagggatataagtggtcaactcgtaaacctacttagagcaaatttaatagtaaaccccactactagctccaattcatttatagccaatctaatagccaattcatacaatagttgcttactatactactaatatatggtcccacctgttatacacacattgcgtcttggagtccgtgctgcagctggctacagatctgtagcccgctgctcttctctctcatcttttatctcattaaaatatgtttacagctggctaatagcctgctattgtatctgctcttatagataaaattagtaggcaacctgcggattaactcacggttacctactaatttgatctattaatggttttaagggtcgatccacttgatgcgatacgccaggtcacaatgtggaaacctgcggattaccatttatttaacatataaataggtttatgagttagcccgtttgtatgcctagctaattttgtacactgatccgatcgaaaagaaaagaaggaaagctagcgcactgttaggttctttaaagaccaaaaggttaatacagtgcaccatcaatttaaatatttttattttgttgttcgatgtcgaacaatattgacttaaaaaaatcaattgttttatcaaatgtggacagactaacaaggactttgcagtaagaacaacacaaggcaaatgaacaatttttttttactgctaacagaactgattttacttctacatgacccaagggaaaaggcaggtactaacattagacctagaacaatcattccatcggccattcctaccgtcagagagtcttaagaaaagaaaaaactgtcagaaagttgagtcaggttactcacatgaccatgaacggtggcagccagcagccgatcgatcgaggacgcacagctctgcgctgagacacgcgactgctcgattgaaatcgaactacggttccctgaatttggctcagtgatctctcataaattagatttatttaatttttagaaaacttctatgcatatggttttcataaggcatatcgtttatcagtttaaaaagtagcatatgccaatagtgagatgttcatgatgatttcgttaatattaaaatatactgattcattgtttcagatgcgctaataaaagtaagatagtattaccatgtttttttaaagagaaaaaatgtacttcctccgtacttataaaggaattgaagtcgttttggacagcgactcgatctacaaaacacaactttgactttttatttctataaaaatatttattgaaaagtgatatatgtactacctccgtcccaaaatataacaatttttagctaaaaatgtttatattttaggacgaaggaagtatacttttatgaaagtatttttcaagacaaatctattcatataatttttatattttcaaactcaacaacttaagagttatttataatttatattcttaagatttgactcaaatattattttaaacgattttttttttaaaaaaatatggagggagtatatatgcttaaaaaaacgatcgaacgcacgcgtcacccggtcactctgaatctgaccaaggcggcgccggaaacggagccgcggattgaaacgagatttcgggggagaggagcaacggcagccacggtggcaagcggcagcgtagccagcgaggccacgtggtcggcggtctcctccgtcccagcgccgggccccacccacccctcccccgccagtccaccaacacgaccgttgcctcctccccctcgccacgctccagcgccgcacggcatcggtggccgtgaggtggggaccgcgctcgtttgtggggcccacctgtcagcgcgtggggatgggcagcacgtatcacgcatcaatcttgggacaccgaggcgggcgcgaggccagacccgaccggcaactgaactggcagcgcattgccagctgtgcctgccaactgtgccacgcgctctgcccccgtaggtctgggatatttacgccatttgccactggtgacttgcctgattagcagaacagagatgggatctccgtgctgaagattagtaaaagcattgtgatagttatttgattattatttagagatgtaggggcagttcagattgatgctatttttaactatatcatttttttaagtaaaggtgtaaaaaaaattgtacatttagtttgttgccaaatttaataatacataagaaatcctatcatcttgccaatactaaaatttagtgatgtttattttagctacaatctgaacagcccgtaatggtaacaattgaaagcaaattcatcatgtactataacttttgtgacatcagtactatgctagtaccatattttcatcattaaatctacaattagcacataacggagattggatctccgtgctaaagattagtaaaagcactataataatgttatagacttaattgtttgattatgtagagttgtaatgataacagttaaaaccaaatatattacctaccataagtacgtagtactagtgctttgtaccattatcggttttgttcacattttgatcatctcctgcggtttctgcaatcttaaatcttgtagtcataccagcttataaacccattccagactaaacttagcatcatatgaatctggacacgtttacgatagaagggagtctaataaacattgcacataatcagtacgtagaccggagggcaaattggtcatgtaggccaacacacattctaatcatcatcgggcggttcaccatcctgcagaagctctgctggcctccggccctggccctggctggaattccgcccaattattagcggccagtggcattcccgcaattcctgacctcttctgctgcccctccccccctccatttctataactgcagccaccccagcggcgcccatcaaattctgcaaaaaccacaggccgcacagccacagcagcgtccacttcacgttccatcatctcctctacctccaaccacatcgttgcttagcctcgccaccgccgccgccgccgccgatcagtggtagatcgatcgatctagccggccatggattactggaagaccaaggttctgccgaagattaaggtcgtcttcgccaagggcggcaacgccaagaaggctgccgccgccgaactcatcaagtcgtttgatgaatctaaggtacgccgccgccgccgccgccgtcgtttgattcgtctggtcgatcgatctggttgattgcgatgagatgctgatgattgtggtggtggtggtgcaggaggggatcaacggcgagttcgaggagaagaaggctgacctccagcccaaggtcgtcgagatctacgaggctgctcctgcgccgctcaaggtaaatataattcagaaactaatcacacgccaaccgtatcatccgtcctactaattcagtagttaattaactcgatcagtgctgccaactgcacgtattagtttgcggtaattgagacttaggcccatctaatcatgcaactaatgaagtgatgatcctgatgtatcgatgcttggctgcatcatgctgcatgcgttctgtacgtctagtcgccctcgctggctcagtgatgagcagtgatgcgtcatgcatatgcatgtaccctacacatatgagtagtgatcagtaaaagactgccagccagctagcttagcttagctcatactatctgccaagtttacagctaattaagtataggtcactgaaacatttgatgtgtccatggttggcaggttctgatcaaggacagggccaaggtgtccgggatcaagaagaactccgccgccgtcaccaagttcgtcgacgatctcgccaaaatcggtaatatataatcaacaaacacatctcatcaaattcttttttaatataatttcgctgatcattaattagctacgtgaaattttcatggtggattgatcagagttccccggagcgaagcaactgagcgaggggatcgccaaggtcggcccggcgctgctctccggcccggtgttcgccaccttcgagaaggtctccacgttgctccccgccgacgaggaggagatcaagcccaaggaggctacggccgccgccgccgaagaggagaagaaggaggaagccgccgccgccgccgccgccaccgacgccgccggcgaggagaagaaggaagaagccgaggagaagaaagaagaagaggccgccgcccccgccgacgagccagctgcagccgccggtgagagcgcacctgccgccgccgaggccgagcccccagtcgaggccgcagcgacgccggcggccgctgaggcggcgccggcgaaggccgaggaggaggaggcaccaaaggcctaactagctatagctagctagggttcatcgccgccattattgatggacgcctcaagccctagctagagagggatgatcgatgtcgtcgttgtgccatgtcaccagtcaccaccaccattctttgctcttacacatatgcatgatgatgcagatattccattattgttgttcattatttttctctaccatttcttcccctctttatggttagacgtgtaagcctataatttttgtctgtacttaaattaattatatgcagtgtgaggacatgtatgtatggcatctgtatattatcgccagttttgttcatcttggaagcatatgcattattaattcattgattggttattgttctttctttcatgatatatctctataaatattctgaaaatttcaaaaggtttgcacaatcttttcttgcacatatgtccatgtatgtgtgcagttgttaacatgtaccattgaggcattgacacaatgaatcggtgctgtgttgatctgtttctttagcgttgggcatgcaacaatgtaaggggatggatggggcccagtggtcatgtgctccgtgagttgttgttttccgggcctgactgcttcgtgttggatcttctgtggtctactgctggactgggccatgtatgcgtgccagtttagtgagggcccactttgtcggggcatggtgcatgtgccaccgtgcagccttggatacctactccagctatgccatggatcttgctgactcgaccaaactttggaaatggcctattttcagtgtaagaatatgtataagttgggggggatgacaggtgggatattcaaccgttggaaagccacacttcagtgcatgcatagccgttcagacagctacaatcgtatacagtactctaatttgatccacggtactctgaatatggtatatggtatatgaaaaaaatatcattatagttcgcgttattggttggatgtcactgaaaaattttaaaattgaaactatgtcactcccatcactatttttgtcctcctctctcatgtcgtcatcctcaccgtcaccagtagatgacgcacatcgccgtggagaagtagcagcggcggcggcggtggcggcgatggcagcactccggcgtgtgttgatatttcttaaagtcattactaggaatatagtaattcccagcaatgactcttgaaacattactcggtattctttacggttacagatataatctgcaggcatacggatataccgctgtaacatttcaccggaaatattccaaggtatatatcgtatttatttaatcacaagggatgatatgataagagagtactatgctgataatttatatcacttatatagatcaaagtctaattcatgggttaattgattcaagaatatggtaggttgacacacaaaagaaactaaccagaatacttttattaaaataataatctaaactaagtggagaaaaaataagaaaaaaataatttctgaactctagtatagtcattttagtctacacttgctattttacaattatgcagccaatatccctaactatgccctcctggtatatcgagaaaccacccctaattgtcgagttccttacgataacccgtcgtggccatccaaccggtaatgaatacggaggagtacccacaccaggaaattctcttatattatatacgcatgtggaggaatactcgtactgagctgtcaccatcagcggcctacctgtatatagacccgtggcatataaccctatttaatgatatctgataatctaagcattgcgcttacattattaaatactactctacatctttgcagatcacatagagcaatatataaatgaacattaaaccaataccattgcatatctccagtaagctagctacataattattacgagacaagtataagctaaagccggtactcgaataattatataaatgaagtaaaggaccgaaactatgacaagaagaataatttattaatgaattaagtcttacaagagagagaagagctactaaagccttatccgaaatctccggaagacttcaaaaactaagagactgttctaattctactccactagcactagaacaaagtaaataaactagagagagctcttgattgcttcttcttggtgtgtgttggagtggagaaggtgagctccttttatagggttcatatgacagttgtggaattgtcagaaatgccccgcaaccgtctttgagaagctatcatggaattgtcagaaagggcctgatggcggttcggcttggttcaaccgaaccctgggccccacctcctggcctatcctttgtccaggaggctgactggtgggtccttatggcggttatgacccattttatggcggtttcacctgacctatgggcccttcaatacttgtacttgcgactgattggtcggaggtgtgtctttgatgttattttcttttattcttcctccgattatgtgaagttctcctgcaaacaatattttgccaagtataaatggaaatagattattcttaaacaaatatgcatgaagcattgctagttctcctttatttttggatatattgacggttggaattggtctataacgaccgtcaataacaatccgttggcatttctggtacatgctacttgttaagggcttgtttggcagagttccaactccagttctggagcccaatcaaacggtttcagttccaccaaaaaagggagcggagcgggttaaagtgctctcacaaaataaactaaataggtggaatttgttttaggctgctccacagcttcacttcagatccgactcttagagttaaatttaggagttggagccctactaagcatgccctaaaccaaaaccttccattgaggcatttactattttgataaatatcaatggacgttcactacataaatatttggtcaaccctgtctaaagaatacctctaccctttttaggggtaaaccagccctagtaacttttatatttcattaactcccaataggaataagtccactttgactcccttgaatagaggtccaacattctaattcatatatcggttatctttaccaccaaactattaaaattggtgtaatttgcttctctcggctgctcttgagggcggtttcgctcatgtagcacgttgacttggtccaacctactaagttatcaatggggcccacatgcctcctttctttctcctctcctccactttccccacaccgctgagctatcagggagagccagtgatggcagtcgtcggcggcacgatggtgacgaggagtgtgacagcagtcggcaatggtgcatcgacggtttcgtcagcctcccatctcattgccactatcatcctcgttcacacctcctccttcctgatgaacgtgccacatcagcgaaaacccactctcaaaaccattaagggagtcaaactacacctgttttaataattgggaggtcaaaatatccagcattgcagatcaggggtacgaaccaaattagacctatattttgaggtagtcaaagtggacttattccctcctaatacaattgggcaggacaaaagtgcctctccatgctaaaaggaaaaggtacatcgaaggtacctcaacttgtcatcgagttacaaaatcgtcccccaaccgcaaaaccagatatagaacatccctcaacttacaaaaccattcactttaggtccttcggtggttttgaccccggttttgtctgacgtggcagctgagtcagcgtgggacccacaagggccccacatgttagggtgtccacatcagcgcccctctctttcccctctttctttctctctccctctctcacttttcacttttctcctctcttggcagccggccggcgggcggggaggaggtcgccggggcgaggcgggagaaggggagggcgccggctacgtgggagaaggggggagcacaggtgtcatgcccagaaattcacaaacaagaatttctaagctgaatgtgcattaaatccctgtccaggaccagccagggtatacaaacgataattgttgacatacagatccacgtcttacaaaaatataaaagattacaaatgcagcggaaaagataaaacgagctaaacttggaagcttgacttctgcaacgggcgactccactccacaggcaaccttgacggcagcgacgaaaccaaccctaacaagacagctccaactaggaagatcttcagctctggtgtgggagaaa

SEQ ID NO: 80385 - DNA, 2815 bp, Oryza sativa
cacttataattagtgacataaaactgggacaattattgtgtgtttttgtggatgtggataacttgatttgcaaaacagcaagctcgtggtggcgaggaaagattcagaactcccattgcctaatgaattgtggactatgctagcagcgaagtggatgcgaccagggttttcgatttgacgaaagccgatcgaataccgtgaaaatttgaggttttgacatgggatgcaagtagattttggatgaaatttcaaatggttctttagaattcaaatttgaaacaataattcaaccagaatttgatcaaaacaaccatcctcaatttgatcttactgcgtttttctattgatttttatttataggaaaaaaaacctgccaaacacgggcagatccaatttacaataaacttgtccgtgagcattgcaagctaagtttcacaagtgcaagtaagaaatcagtcgatttacttcacaatgtaaaggggcttaatatgtgtcacttcatattggtagaatgaacagctttattgctctgtgcaagtaagaaatacggagtactaacatacagaagcagcgctgtatctatattgtctctacatcgacaaaacaggtgacattcaccttcagaaacacaagaagccacaacaactcacttctccagatgaaatatacgacaatgctaatttttctccaccgagccaccataaatactccttaaaaaactccagcctgtgctctccctgctgtatatgctgttgaggatgttcaaactcatgcttcaacattcccattaaagatgtaccaaaaatctttaggacgttcaaggatgtggtaggacaagcagagaaactgacaggctcatcaccaatataaaatgctcaggatcaagaaagcccaaatttggacaaagctgactgaaacaacgttgaaaatgcctctgcagcggtcccatcatcagccttcactttgatctgtgccttcgctgatgctgtgttgacgatacattctacaaggaagaaagcggtagcaccatccttttgagcatagaaaaagaacttgtagtttgggggctggccacctgaagcaatacactgaatgtagttgttttgcatatgtcgaatgagtgattgaggattcatcaatgatgctgctccttgtggacttaatgaacattcctgacaacataaaaaagcgcacaacgaaagaaaatttaaattgtataagggtcataaggcgaagcaattagaacatgtaactattaacttaaggcttcccgattgacaatgaatttatttcattagaattaaggattgctatcataagaaaacaatagcactttaacaaggccaatcattactcagaacatataactgctgatttcaaacacctcatcagagtgactttcatgggaagacacttagtatttagatttagacaatagcagcaccccataatttcatgctaaaatagttcaaatttgagtgagcaactacaaaaaggctacatgagcatgttgctgtacaaataatcacaaaatgcatgggaaagaactcagaagcaacatacctgagacaaggataaggccagctggccccatttcttctggaaagtaccaggatccagcacaggttttgagttgagggtcaatgctggagctggtggaggtgcagaggattgtggaacaccaagcccaagaaggtcatcaagactgaagttggactgtgacgaatatgtaggtgcaccaggatttattagtgaagtttcagacggtatttgtgaactaagcaatgaaggaccactcaagtctgaaggagcattgtaggtagaggcagaagaaccattgctggtagctgttgcattgtcctctttatccgaagtacttagcaaaagatcattatcactttcttgatatctttgggctgagatggtgttttccgtcgtttctgccccgacagccaaattcgtaagatcctccgagtactcaaatggtccacgatgctccttgtcagtaaacatgtaagatggctgccaaatgcaaagataatgtcatattgatacttcacatgtatttgttcaatagtagcatgagtaattatattagagtagctaacaccaagagaagtacataatggacttatacagaactaataaagtaataatactgataaaagtatccagtaaatgcattatcaatatttaattttgttagcaatggttgaatataaaaaaaatatataccttctgatataccactgataggctgttgaattcatcaaatatccgatctttgatttcactgctctgcgtatctgcaaatacagagacagcttgcttgggagggtttacaacacgttcagcaacagcaggatcatactgcaaaagcctatagtagaaaagtgctcggtcatgaacatcctgcaatcaattcttggcagttaagctagagctcatagaaatgttacagtaatcaaattattatcagaaaagatcttgacctggtgagtgtcagatagaccagcggttaatgtagctcctagtgccatttgtgtctctggtggcctcttaaagaaacatttcatcaccgcagtcaggagatgcaagcgaacctgcaaagtacaatattacaggaataatgaaatagaattcaaaaacaagtagctacaggcatatgatggtctaaagaaagggatagaattttacaataatgtccaatgactcactaggtataagatagcaattcaaaagaaaaaaaacaatagaatcacccttagtttttggtgccataatatgtgaatttcagtctggcacttctattttg

SEQ ID NO: 80386 - DNA, 1367 bp, Oryza sativa
cgtattgggttcttatatggactcctctttcaatattgcttatttttaattccaaatttcagttatttttcagattgtatttctacttggactcttttttttctttttctctgattaatgtgggaatttctagcctccacagcgaacgtggtgccttcttttcgagctgtcttaataatataactagctaggtggcccacgcaattgcgcggctagcacccaaataaaatcatatatttttagtatgattttaattaaaatttattaaatagctatctcattgtcttaagactttgaaagaccaaatcttatcatcgtcgtgtttttaattatatagttttttaaaagtcacaccagttgctacccattatgtcatttccttctttatttgcttgctcgatctaccactatttctaatcattctccttagaacctttaaaaattggatcttacagtttttagagtttattgtcatgttgggttttggttttataatttctagatgtcctgtcaaacgttgccattatactcctctatggcctgtccattgtttcttttctttattgtcattgagattttaaaaatcgaacataattatcgtttggcttcatttttactttttaaagtcccgccaaaccatcagcgactttgccattgtacttctctacggctcgcctgctgcctcccttctttattgtcattgagattttaaaatcgaacatgattatcatttttttttactttttagaaattccgaacctttaaaaattggatcttgtagtttttagagtttattgtcttgttgggtttcattttttataatttttagaagtctcgtcaaacgatgccactatgctcctctacggcccgtccgccgtctactattatggtcattgtgattctaaaaatcgaacatagctatcgttggaattcattttttattttctagaagtcccgtcaaccgtcggcggctctgcaactatactcctatacaccccgtccgatgcttctcctttttattgtcattgagattttaaaaatcaaatatgtttatcaatggggtttatttttttttactttctagaagtcccggcaaccgccttgctcgtctgcttcacggcctgcttatcgtccctccttttaatcgtcattaggattctatttggtgttttattaatagtttttatatgtcgtatcaaccgccaccactctactcctttatagtctagttaatttatctcgtcatgtgttttagatggtcttttctttcaatagtctttatttttatcacaaattttagttatttataaattttattcctaattgaaatcttatttttatttttccaattttagaatttatttttt

SEQ ID NO: 80387 - DNA, 11717 bp, Oryza sativa
atgtcgtgaacaaggggccttgcaacaagagcatcgtgggagcagtagcaatacagagcaagagcaacagcatacaggtggcttgtaaggcacagtgatgcttggtccaaaatgtgcagtgggtcagtagagcattacgggagtgagccaattgatctctttgtgcgggttctggtcttctggaagagactattttgtccaggaagtagaatggttagtatagttagtttagctgaagttagttgtggtaaacttgtctgttaggaaagtgttggtcgagagcaggaagacgtgtaaagatgcattgtatctattagctctcctgtctaaacatgcatcttggttcgcggcagtatgggaagctgatagttaattgacatctgtgttcgccaattttgcaggtatgccttctttttttgtctgcctttgttggtttcaaaatgatttagtgtgtatttgttgcaatgccatttcgttgaatcgcctgtaatatgtttcataggttttgatgtagtatgttccgtgcgctttggtcttgattgtatgatctttgtttcttatactgtttatgggtaaatagggagatgtatattgttctgtttgtgttagcatgtaaaatttcatatcattaaattgttctcgtcttttctcaaaaaaaagtcatcttctgttttgaaaagataatgcgattcaagttttttttgccattttgtgccatgccccccgcgggcgtcatgtagactagcttaaacttgctgtaaacgattcatctttctgcatattgaagaattataggtcttactttttcagtaacaagctatccgttgatttgcttcttaattataagttgatgcaaacttggtttgttagctttcaaatcctctgcttactaccgtatttttgttgatgcaatttctaatgataaataagctttcgagtcccttcctttaatagtttgaaagtaatctcaaattttagcttccaaaaattctctttccgaatcattttcacagttttattaacccgggctgttctttgttgttgcaccaaatttgcaagtctagtttgaggaattattatttttataggtaaattggaaccatgccattataattttgcaaagtttgagatatgtcatcagtatctcaatgacatggaggacccacgtgagtcaatgacatgtaggtcaggatggcatatctcaaattttataaaattataatggcatgtaggtcaggatggcatatctcaaattttacaaaattataatggcatggttccaattttccctattttgatataagggcaaatcttttcctgcaacatcaaagcaatccacattccacgctgaatacgtatggaacaagtgactgtcattgtaaataggcgtgtgtcgaattgccaggttgacaagaaaattacttgtaaatctttgtacctttttatttgacgatatttattatgaatgaggaagaatattaacggtgaatttcagggatgatatgcttgttcacattgcatattttttccacgcaaagtatgcattttttttccctcacaagtcataatactgatggatcctcttggcgttaaatgttccctttgtcttgtttaagattaaaattggatgaagaggcgtagaccttggattcaagactcaacggcctgttttggttagaagtttttaggagggattgagagtttagaaggatgaggctattaagtgttttatttggttgagagacatgggagttttggtaggatgggaatggggaattgtggaaggaactccctccttttcaatacctgggtaggggcagataattgggagggaatttctcctttactttgtctaagcaaatctcatccatccgtttttattaatgatctaatctccaactaaactccgtatcaattttcatcgcctctaccaaacaagatattgggattaaaaatcaaattctcatcttaatctcatcatcaattccctcgtgtaaactctcaatccccttctctgaagtggagttcagaaaggaccaagaagctagatctatgaaaggaccacaacaagtggcgaaaagagttcctcttttgaactcaatatcactaaaatcaactcattcaagtacgtgatagcagtatgcaatataggatggcttcccgcctctactgataccagcgctgtcggatcccaaaactaacgattcagaaaccgacatatttaactgtatcaagccctggatcagtaggttgaacaggttcaataatctggatcttcattgcatacatttggtcaaggctccaaaggagatatctttatatataaaataataggacatttacaagtttgtggctaactattacagcagaagctatacgatgacccaactctatcgttttactatagaactaaaccggctaactatactagacttgaagactaggtttaaagggaactaacttatgtgattgaactcccagctttggcaaaaactccaaatagactctgaaaaaaggggttgaagcaagggtgagtacatgccaatcaccccggccgcctgcaggctcagtttggggagaatcggtaatcaacttcagagaatctagagaagctactaacccagcttttagctatagttcattttctagattctacaactacaaaatctcataatcaactacaaaatctcataatagagtgacaatcttacagtttaaatggatagaaactccctaaacaagccttagcttggtccacaacaaggtgagaatgatgaggcataccgacatttaggctaacctcaccttccacgcactaaaacggagtaatgcttcttttgcaaaagacgcaccgtttatcaatttaaaaaacgtgcacaacacgagcgaagtgagttgaaaaaggtagggggagaaacccattagattaaggccattgaacggtcggatgcaagggagtgagtaccaccgctgccttgcaacacgcaagttggttatttagatgattcgtctcaagaatccttgagataggaaggatacgctccgaagtttggagctcagatgaacaaagcgcattgcacaaatgatgtacgaaggatgcttcacagggctggtgtccatcatgcaaagcattcatcgagctgatagagtgatagttgagaatcggcgttctgggaaacaattctaaaagacagctctacacataccgaaacacaactagtacaacacaaagcaaaacaaaataacacaacagcatcaggcaatacataaacaggaaaagaaggatcgaaatccgggcaaacagttactctcatctcatcaagataacaataccctattggcatcagttctatcagaccccgaagattttatgcgatgcaagaaaagaagaaacgcaataccacgacatgactgagtgccaatatcatagcgtgatgtggtacgtgaggagaagaaatgatcccatcagaactcatggaatcaattaaattttctaggtatatgacattctgaacaaatcgaggcatctttgttcaaaatagaacattttcaaaaaggcaagctgaacgttaggtgatataaataactttcccaaagcatcttctctagcttacacaacagaaagcaatgagcatctatgtaaaaattataatcactcataaccgcatacaagcaaaatactgaaactgtccattggaacatcacctaacatttaccaatgtattgtcaccaaaatcaaaatagaatcatcaaccatgccattatccccatgatataactcaatcagattgtacaaatttaggcgcagacttgtcacaaagcattgttagccagaacaactgtagtctaaaaaaacataaacagccaaaccacaatcccacaatacttgatgcaaaacatccagacctaccactaaactgtctaagctcaacactgaagtaggataggacaattacactttttttaatctatctaagatttctacaaggatcatagtgcagccactgattgcaacaactaaaagaatgaaataagttacttatagacgtcctatttcattactttgcattcggattcaaatccaacaatgcaaacaaataagcagctagccaattgaaccttaatacttgaagcataacataaacagctaacatacataacagtgcatagccaaccatgtaatccatccaaccaaagaaaccaagtgctaccaatcaccttgcacaccatgaaacaaacaaatcgatacctaaacactaatcaggcaacctatcgcaagttgcactaccattaccaaagaattgcctaagattacagttgctaaattttgatagccatgcgagttagtagacctaattaagttgcaaatcatgtccgcaaaacactgttgggcacatcgcaatgaatcaccgctggaaatggaggaacatggaaaacaaatcgcatctgaagcagtgtaattcccaaacaaaacttcaaccagatctatccttggcatgacttcataacacatgagcatcatcatgtcttaattttaaactcaatactaacaaccaagtcttcatggacacagataccaaaaaaagcagatatagattaacggatgatagcaagaacaagaaggcgcgcctagaagcggagcttggtgaagaaccacctgttcttgccggtcttgaacctctcctcgaggcgagccttggcggccttgcaggcggccaccttcttgtcgcgggtggcgagggcgtcgggtcccccggaggccacgtccttgaagtcgacgtcgagggtgtagcgggtgggcatgatgtgggtgaagttgacgagcttgaggaagcacttgaccctcgacttcttcgccgtcttcttcgccgagtccttgcggatcaccttcttcgggtacttggcgaggccggcgacgaggcagtggccgtaggggcggtcagggtgccctcctggaacacgcgcacgatcaccgccttccgccccgcgtaccgcccctgcagcaggatcaccgccttccccggcttcaggaacttcaccatcgcggcggctgtacggatctccttctccttcgccggtgtggttggtcgccgccgccgccgccgccgccgagctcacctctgctgctgctgcgccgccgccggatggtgttagggttcgcggagaggggagggttttatagtcgggatgcggcgaggctagggtttgaggtggggaacgaatggcggatttgcccctgggttgcggatcgttggatgtgaatcggacgggtgtttcctgggtaagttggtggtggggccgaggtggcagtgggagattgaagggcgagtggagggggtaaaatggggaaggttgagcgggtgcgctgagatgggctttgggcggagaaataggcccaataagacccatataggccgacctatcggtctggcccacttgtcggacggacggcctttcggcgcctgttagcaaagcagcagtggttatgtacagattatttgaaagagtactgctatatatacgactcaggtggtgattgaatcttctaaagatgaagttgaagattaagtgttttacgcaaaatgaggtggtaataatgtgtgtttaattgagttttaattactacaaacttgaaaaatggattaatctgatattttataacaactttcatatagaaagttttcgcacgaaacgcaccgtttagcagtttgaaatgcgtaccgcgaaaatccaaaacttcatctagtctttgtagaggaaacgaatgtggcctcaattgtacaactcatatatataactagatatatgcaacgatagattaatcgaaggagagcatgttcatatgcactgcaaccttttacagccgtcgatcaaattcagtcggatagttgggtcatatgcatagcaatttcctatttgaaattagcatggcatgtttagataagtactaggagtatttgttttctgaatggcagatgaatttaaattgctggagtcccaagatgatgagattgcgagaagggtaggggatgaaggcatgaagctgctcgatggttttttttttctttgggtggttgtgtgctaagctgaagttctgcttttcgatctgatctgggtggtgatctgctttggatcactctgggattgatgtctatgtttgtttttctctttgcagtagttgattagttggttgtaagatagttttcgtatatgcctgaagtctcccccaactatggttggatggcacctggtcaggtcgttttcgatgttgttttaaatcctctgaattttttgtagcttccgtttctggtaatagaaatggggagagcttggctctcctagttaaaaaaaaaaaaaaaaaaaacttctgaatgatgtccagtggtgttgggttgaactagtcagtgccaccgatttttggtttgaattttagtttgatgtcagaatcatgtttatgtactagttctccaaaaaatttggtaaggtaaaagtatttatcgagcgttcagtttactattaacaaactacgcgaagcaaactaggctgttattttgcttgcctgtccctttggatgtgctcaaatttgtgcctatatttgcagtgtttctgataggacttcccttcttttgttgaaataaaacacaagttcacaggagctggaaaagatcacaagtttgttatgtactcacatacatgtaaataccactgtaaaaggagtgacactgtaaaaaaaatattcgtttcagtacacatgcacaaacatatggttggttcgtcagctaattcagtgccagctccaagctttggaatctctgaactgttggtagcattttgagttcttgttcttccacctccttgactttgttgctccacttcgctttgctgttttcaacttgttgggttgtcaaacatccgttctaccggttttcctctgctttggcacttccttgatgttttcgcttgttggagaagaggcgactcatcttctcttgtttttttttttttttttttttttgctgtctatacatcttgggacagaaaatcccacctcatatcattcgaattttaaaccattggatatgcttcaagatttatgcagatccttttaaccctagctcctctcctcctcctcccgattcagatcgcacaccaccaccactcctccgtcctcgcgcgatcctccgccgccaccgccccaccgcgccgccgcccgcctcgccggaaggggtcaacggcgccggcgagccccctcccccttcccccctctccccgttccctcctctcctcgaggtgcccccgtcccaccgtcttccctgtctccggcggctccccgccaccggatccaccacctcctaatctcatgctttgtttgcccctgccgccgacgccggcccactgccttcctccatccccgcggcttcggcggcgccgccgccgcctcgccgcctgccggagtccaccacccaccgccagtcctccgcccacggccatccctctaagccccaaggaaaccccccgcttccccctccctcaacccccctcctaccctcaccccaaccccaaaccctaacccgccggagttggggtgtcgccagcgccggagaagaagggagcccaccggagttggaggagagaagccgatgcatgaatcttggcatgaatccaatggtccaagatctgtaagatttcttccccaaatttcattcgaatgccatatagcaatccctttttttttcatctgccttagtggcacaaacaagaacatggaggatctttaatggcatgagactatgagagtgaactgtgaattttacagaagttttgatttgttactcgcctttcaagtttggcagagtagatcacacaggtttaaaaaaccaaggctaataaaccacgacacattcaagcaaaatctctgtcagaaaccgtgcaaaactgaaccttttatgtattacgaagttgacatgctcggatagcttcggtctccttcagacaaaggaacaaaaaaaaattacagcaattctctgcttcaaaacatgataaacccaatcacctcccatgttattactactaattattgtttaattttcctttcgctctatctcgaattcattcttcgattctaaagaaagaaatcggtgagaaaccaaacaaacaatacatgagccgagccgaggtgagcgattcagtgcctcccacgcttcttcgcgggcttgcagtcgtcgtcgtcatcttcgaagccggacacctcgtcgtcgtcgtcggagtcttcgtcgaggtcgtcgtcgaactccccgtcgcttcccatggcctcaaactcatcgtcctcgtcctcgtcctcgctctcgctcaccgccttcgccttccgccccgcggcggcgtaccctctccgcgcgtgcagcgccgcgggggtcgcgcccgcggggtggagcaggaagcgcgccacggcggcggatggcggcgccgccgctgccaggcggggagcggcgggcccaacggcgagatgcgccggtggtgggcgtggggcggccgcggcgaggcggcggagggcgagggaggcggcgcgctgcatggttgggggttggcggcggcggtggcggcggtgggggtgagtgggagggtggcggctagggttttggagcgggatttgcgcgagggctggggatttttaatggcggggaagtgggagggagcgcgggcgtggctggaagattccagagaccgcaagcggctcccgcgctctactctgatgatctgatctggtcgccgccgccaccggcgtgcgtgtgcctgctttttcatttttcttttcctattcgggctttgttgggccggtgaatgcttgttgggccattgaagatcaggaacaggttagattgggggaataagtccacattgactcccttcaaagtgacccgaatctaatccatgaccctaaacggcaaaaccgaatatctcgacccccgaactattggaactggtgcaatttgactcccttggcggttttggagggctgtttcgctgacgcggtgctggcgtggcggtgttgacctagtctgtgaggttgacgtggcgcttagatggcacggaagttgacagccacgcagcgagctcgagcgatgactcgatgacgtcgtcgttgcaatgctgaatggcgtagcttgatggcggccctcgcccctaaccatcttgacaggctcgacatcagccatgtcatgagcctgccgcatatgtcgaatcttgttgttgcgatcggcgaaaaggccagagtgccggatcttattgtcgcggacagcgggaggcagcggagggagcagggagctcgttcccccggtgaggacgttgtgtcggtggaggtgaggactaggggtggaggaggtcgccggcgtggatccataaaggagatcggctccggtctccccccagcacccttaggccacgccggctcccagatcttggcccgctgaagccgtctaccgccgtccccccgctcgatctcgtcggcgctgtcgtcctctcccgcctccttgccggccatcgagctgcccgctgccgctccagaacccgccgttagctccaacccaccggcgctgccgcttcaactcccggcggccgccaccgctctagcccccgcccgccgccgctctagcccgtgctccccgcgaccggccgaaggggagagagagacaaagaaagagagaagggaggaagaggggaggaagaagaaagagataggatgacatgtggggcccacatgtcattgggccccataattttttgtgtgtgaatgacaaacgggtcccacatatatgtttttaattcaaatgccacctaagcaccacgtcaaccccacagactaggtcaacaccgccacgtcagcgaaatcgccctccaaaaccaccaagggagtcaaattgcagcggtttctatatttcgggggtcgagatatccggttttacggtttagggtcatcgatcagattcgggtcacttttaagggagtcaaagtggacttattcctagattggatcgtgaggcagcacgacaacaaacgggtgattttagcatggaaaaagtacaccaaaggtccctcaactttttatcgagttacaaaatcgtcccccaaccgcaaaaccagatttaggacatccctcaacttacaaatccgttaactttaggtcctccggtggttttgaccataattttgtctgacgtggcagctgagtcagcgtgagaccaacgtgatccccacatgtcagggtgtccacatcgtcaccctatttctttcccctcttctctcttactcttctcgtctaggactctgggtagggcgactgacggatggggaggagaccggcggggtggggcggggcgaggcgggagaggtggtccggccacaattgctatctcgcgccagttgcttatgtcgcgcgcacgtggcaagccaactgcacatgcatgcatgcaccacggtctccagtcgtgcagatgcattacacacatgcatgcatgcatctatacgatctttctttttttttatgctttcatcttaattaatttaggatgtagtgaaagttatcaaaatttctattataagataattttaataaaaatattttttataatgcaaatttaaaaactcgacatgaaagtttttaaatcggagttgaaagttttcaaatctcgagttgaaagttttcaaatccaacttgaaagttttcaaatctcgagttgaaagttttcaaatctgagtcgaaagttgtcaaatctcgagttgaaagtttttaaatctgaattgaaagttttcaaaatttatcttgcaaatttaaatttcgacttgaaatttttcaaagtttaagttgaaagatttcaaaatttgactttaaagtttaaatcttaagttgaaattttcaaatctaacctgaaagttctcaatctattagaaaaaagaaaaagtttttaggtactaattatgattagcactaatcactaatcacgtcatcattagtgctaatcacatctttgtgacgggggcagcgtacgcacgagttccgttcgcggcgcgtatgcgcgcgttaggactcccttggtccggcagccggcgacgacggtgcttgtgttggcaactttttttgacaagcggtgatcctagagtcgccaaccacctcgatctagcaaagagctaaacctagatgggttttgataactaaactagctagcggagccgatttctagataactacccgtctcgtgggcaaaacggaaggttttcaggacaaacctacaaagagatgtcgcactctcgcagcggcggcggacggtttacggcgcaaaccgacaaagatggaaaaactaagagaaaactaaaagcaatatgaaaaacgattcgattgattgattgtagattggttttttacaatgaaccggccatgtcccttatataggggttggtcttgccctctacaggccctcctccacgtccaactcggagtagaaaccaaaggaaacccgaaacatgctttcccgagcaagaaaacctcgagacccgatgaaacacagttagactcggacctgccggtcagaccggccacacaccgccggtctgactggccctcaaccggtggtctgaccgcccaacacacgcggtcagaccggcccactcgaaggaaaccggtagacttccaaattttggcaatctttcctattttaatcctaggt

SEQ ID NO: 80388 - DNA, 551 bp, Oryza sativa
agcataaccacagccataaaaacatctgattttagccccatcacgatgctccagcacaatgaaatgagaaaaaaaaagcacccattatacttccatgaaagtttatcccatggcactatattaatcgattccacacattcagtgatcgaaattaacaacaatctataccctcaaggccacaacatatccagaaaaaaaacagtagtaagaacaaatgctatgtgctaaacgcacgctaatttcccacagcatttcattgcactcccccaagccatctaccacgggccacgtactacgaaatgctaaaagaaaaaaaaaacctagaccatggaactagcacatatgcaccaaaaccgctggatggatggatcaagaaccaccaccaccaacccacccaccaagaaccgaaacgggttacaggtacccctgatctgagattgcaggccctcctccgctactgtagcgacggaacgaggcgtaggaagtgcgggaggagcagccggtcaccttactcgccggggaaacgcgccgccaccgccgccgggctgcag

SEQ ID NO: 80389 - DNA, 10212 bp, Oryza sativa
aggccatccccagcccggatccggcggcaacacccgtccctcgcggcagcgtcgggtgacggcaacggcatgcgtcagcggtggcggctcgggagcaaaaccctagctcctgccgtggccgccctccttccctcctctcctccacattcccgtcgtcgaagcgcgtctccaggagagccaggcggcgagtcgggatgtcggtggcggggccgtcttctctgccttcccgcgccggtggacgaggaacaggaggggatggggccggcacgtcatccggcagcggcgccgcggtgatccggtcgctgctccccgcccgctgttgctgctgctgctgctttcctgtcttcttgctctggtttttcccctctcatggcggttgctctgtctagagactactcctcctttggaatccttttcagttttggttggattaattggagttcgctttgctgcgcgattgcaattgttcttgattgatttgcttggctcagaatagtccaaggctctgtccttgtttctcttcgcatactgattcctggttaagaatggtcttcgctttgtgcactcgttcttctgtctccacgaagaaaattggctttctcaaaaacctgcaaaactggaaacaataaaaacgaaacgaattgcatatgattattatgttgctcgcaaacggaatagattgaatcagcacgattgatggatacagtacatagtccttgcttgtctctgactttgctctctactgataggtacagatgagcctgggaagcaagtcgatctggagtgctgtcaagatcaagaacatcagcaagtctaaatgtagcatttaaggtaattaacagagctcctctctgatggcttcttcatcaaattaaatgctaataccagtggttttgcaaatgatggtagttaccagtaactcagtaagtagtagccagcagtccagctcctgttaatttcaaagatgctgctcggattaatgataacatcaatcctctcaataactcaggttgaaggtgaactgtattttaggatgaaatcaatcctctcaataactcatattaaaggtgaactatattttaggattatctgtcaatttagagatgttcatattttaacagatgactatgtattgatctccaccataaaaatctgttggttcagtccccacctacactaatttgatggctactaataaagcactaatttgatgcatgccttttgttctggttccaaataacagcaccaaagagttgcttcataaaacctccaggtggcatacttgttctagcagtacaaacaatttcagcttttcctagtttagagatttgattctggcatgactggtatggggaatatgattagtgcttggcttttgggctatcggctcataagtcttcggacaacatttaattgataagccaatagtttctgaaattttctatttgatgtgctagtagattcttagattttctagttgatattttattaggctattagcttctgaaatttcctagcttggaagagtattacttgataggcaatacagttctctgaattttttttgttcacacagacatgtgcagaagtgataattttttaatccgtccagtggctgctctcaactcacctgttgatttgcagtggttattgctgaatgaaagatgggagaattttcgttcagagaaattatattcagagttctgagtgtcatgttctctcagtttgcaagtacatgcccttctcataaatttttagtttggtcggctggacaatttgatacttacagttgtgtcaaaagctctgaaatgttatgaaaattatggggtttatagacaaatcatgctctaaatgtcaattagaaatatgtcatttgcaaatttgtgtgtgcagtattctgagaaatctgctctcatctgaattatcatcatcatgttctctcatatgttggcgggttccagggtgaaggttggatcctcggtggagcatgccgatgctaccgactccaccatggatgtagctggcagtgggattttgacgtcgaccgtgagtcttcggcaccggcgatggtatttggcgagttgggatgtactcgcttcatctcaatatgtagcaacctcttccagatttgtagttctagtattggtttaatctcatcctagattgtaacatattgcgacggagggagtagtcattggttacaatcttcttgattttttttatcaaaatgaatatgtgtatgtctatttcccatctgtaatttttattggtaaggaaccagccaacaccgtaatattgtattcatgttgtgtaggatatataatttgaaaaaaaaactcttctcatatattgtcatcaagtaaaacatttactatgcgttaataagcgttcatgataaaaatactaatagattgatacatagcattaaaaataaaaatcacttggcagtaaaaatactactaccacaaataaggcatcgagctactgaaaataactaaaaaatcattactaataataaggaacttatctactaatatcattactaataataaggaactaatctactaataataagaaattaatctagtgatatattcgtgagtaactgatttactgaaaagatctaacatgactaaaagccaataatttatttaccaaatgaagattggttgggtgaagtaatctgttagtaattttttttaccgatgcttccgcgagggaagaaaaatagcagatgtgaatgagaaaaaaaaaaggaaaaaaggagggagcggagggagtacggacggttggaaaaaaaaagaaaaacgtggcctggagtgggtcaggccgggggggggggggggttagggtatctgaggggagcgttttagttattacgcaccctgggtgtagtttagctctattatatatatagtagctctattatatacccttcccttagaataactattctacaccacctccccaaccaactcccacccgatcccgccctcccccctctctcgtcgcgatcccgcccttccccccagtctcgtcgcgcccctccctcctccctctccctctctcttttttcgatctctctcccactcctggcgccctggtattttctccctctccctcatctcgatctctctccctctcctggttttttctccctctccctcatctcgatctttctccctctcccggcgccctggttttttctccctctccctctctcggcgccctggttttttttctctcgcccgttggcctctccccctctaatttttttttcatctcaccttggaaagaaaatttaaaattaaaatgacaaaatcaagactttaacccatgaccttatgattcaaagaaattctctattaaccaattaaccatatgagatcttgtgattagagtttattgcatcaattttatgtctctattcaagctttatgagagcaaatcacatatattgttgtgaaacttataatctgttattatgttccagtagtaatattattgtaaaagtgcaataacacgtcacgttactgcaaaagtatataggttgttactgtagttctgacaacatcatgtgaactagctgggtggcccgcgcaattgcgcggctagcgcccaaacaaaatcatatatttttagtatgattttacttaaaatttattaaatacctatctcgttgtcttaagactttgaatgactaaaccttatcatccccgtatttctagttatatagtttttaaaagtcacaccaatttctaccccttacttctgccatctccttctttatttgctggctagatctaccactttctattcattcttcttggaacctttaaaaattggatcttatagtttttagagtttttagagtctattgtcttgttaggtttctttttataatttctagaagtcacatcaaacgctgccattatactactctacggttcgtccaatgtcttttctctttattgtcattgggattttaaaaatcgaatgtaataatcgttcgggtttattttttactttttagaagtcccgccaaaccgttagtggctttgccattgaaatcctctatggcttatctgctgcctcccttctttattgtcattgagattttaaaatcgaacatgattatcattggtttttttttactttttagaagttccgaacctttaaaaattggaccttctagtttttagagtttattgtcttgttgggtttcaattttcataatttttagaagtcccgttaaacgatgccactatactcctctacggcccacccgccgcctactctttattatcattgggattcttcgaacataactactgttggaattcattttttattttctagaagtcccaccaaccatcggtggctctgcgactatactcctatacacccagcccgctgcttctcctttttattatcattgagattctaaaaatcgaatatgattattaatgtggtttattttttttactttctagaagtcctagcaaccgccttgtccgtttgcttcacgacatacctgttgtccctccttttaatcgtcgttaagattctatttggtgttttattaacagttatatgtcgtatcaaccgccaccactctactcctttataggcatgttacttaatttatcttgtcatgtgttttaggtggtcttttctttcaatagtccttattttctatcaccaattagttatcaataaattgtattccttatggaaatttttttttctttttctaatttcagaatttattttttttttcaaattttaaccaatactgtatattgttcttttaatatttttatttttcaattccagttgtttcaaaattgtattcctactcaaccctcttttactttttttatattattttattttttattcagaattttaattaatcttgtatcgggttcttatatggattcttctttcaatattgcttatttttaatttcgaatttctgttaattttaaattgtattcctacttgaactcttattttctttttgctaattttagattttatttttatttttcttctgaatattaactaatatcgtattgggttcttgtattgactcttctctcaatatttcttatttttaattccgaatttcagctatttttgattttgtatttctacttggactctacttttctttttctctgattaatgtgggagtttctctgattaaaaattgaacataactatcattggaatttattttttattttctagaagtcccgccaaccatcagtggctctgcaactatactcctatacactcaacccgctgcttctcctttttattgtcattgagattttaaaaatcgaatatgattatcaatgttgtttattttttttactttctagacgtcctggtaaccgtctagtccatttgcttcacgacctacctgttgtccctccttttaatcgtcattagaattctatttggtattttattaacagttatatgtcgtatcaaccgccaccactctactcctttataggcatattacttaatttatcttgtcatatgttttaggtggtcttttctttcaatagtctttattttctgtcaccaattagttatcaataaattgtattcctaatagaaatctttttttctttttctaatttcaaaatttatttttttaaaaaaatttaactaataccgtatagtgttcttttaatatttttatttttcaattccagttgtttcaaaattgtattcctactcaactctcttttactttttttttaatttttgatattattttattttttattctgaattttaattaatgtcgtatcgggttcttatatggatccttctttcaatattgcttatttttaattacgaatttctgttaattttaaattgtattcctacttaaactcttattttctttttgctaattttagattttatttttatttttcttccgaatattaactaaaatcgtattgggttcttatattgactcttctctcaatattagttatttttaattctgaatttttatttgtcttccgaatattaactaaaatcgtattgagttcttatattaactcttctctcaatatttcttatttttaattccgaatttcagctatttttgaattgtatttctacttggactctccttttctttttctctgattaatgtgggaatttctagcccccacagtgaacgtggtgccttctttcaaagctgttttaataatataatagatattgtagtaacacggaacatgtatgtagtagtaacgatacttctacagactacgaatgttgttactacgagcaagtaatcatatgttagtacagtatggttgtcttgttactgtgcaattcctgcgagatgaggatacgaaagaggtgggcgtggagggaagtgagcaacacaaaagatacataatagcaaactaaacacaagtggattatttgaaattctaatctttaaacaatcgtatctctcgcatcatatataatatttttgaaccgtttccaccataatgctttaaaaaaaaagctttacaaaactagatccgtcatcactatattttgacaacgttataatattgttactgcaagaaagtaaccctgttactgcacgatggtcgtcttgttactgctcctgcgagacgatgacaacaaagaggtggacgtgggggaaagtgagtgggcgggtttgaccgaggtctgaccggcgggaggatgctttgaccgacctttgaccggggtgggaggggggtttcgggctctagggagggtgggggaggtgggtttgacccatgggaggggggtgtagaataattattctaggggaggggtgtagaatagattatatatatatatatatatatatatatatatatatatatatatatatagagagagagagagagagagagagagagagagacgtttatcctggataatcctgcagtcctgccaatcgcgctcaactttctttttcccagactcaatagttgagccttttttgcatgataaaagaatcatttctgagatagattgcttggttttgtttttcgacccatcatggttttatgaattggaaccatagttggttgattagcagcacatccctgaacataacaaccatgaaaatagcagaacacacgctccaatatatttttagaaagtgcatatctcggctggaacaacgcacatcagctattcccaatttttcttttatatgctattcccaatcttctggatacatgattattacctgctcgatctcagtataagcagcagtgtctaatcactgagacatacaaagtgcagcagttagcctttgtgtcctctgctcaccttttccttgtagttgcactttggaaggcattgctcaagggttggatagcacagctggtcctttgaacagcaatagaacccaccggcggtcacggcgcaaacattaagtttaactccaatgctggctgccttttttactcccatcaacatattgcttccgatcttgcttgcagtttgacctagagatgcaaggagtcattatgtttatcttgccagtgcaaacaaaatgatgaaacggcatatgaatcacggaaaaatgcaatctaattttctaattacctcttgcttgtgtaggaatagaagagcacaccacaagaaccaagaaaaagaacaggaccccttgattggtgtgcttcacacattttgccattgtgaaagatatgtttactagtatgttctatatctgtcttgttgtgactaatgagtgtgaaaaagtatagcagttatatatcgaagaagactagcgtgtcaaaataggtgtatgtcttatccttgaatccctaagtaatctgctattaaagccacttctaaatatgggttttgaaaatggttatgattaattgcctgttttatgacaagaaaattatagctctagcatcaaacaagggaaattatcctaaagtctaattttaatagcggctaaatatgtctgtgtcttatcctaacttgtattatcgactaatgccattcattaacaatgattttcaaatgggcatatccatacttttctgattaatgatcataaattaatttttattttggtattaaatctgctaaattgtcctaaagtctaattttaatttcacttccaaacatgtactgtcaagctgcttctatccattgcactatacaatggtcttctaaatcgttcgtctattcatacttatattgattgggtactttctaccgatttttttacaaattgacccttttagaaaacttatttcaagaataaactatgccaaaaacttattgcaaaaatagaccgtcagctcagcgccatagagattgacgctgaggtataacggtttagcgtcatagatattggcgctgacatttcatccgacgtggcaaaaatttgacaggtcagaaggggtcagcgccaatgtacttggcgctgagttattggcaataaaaaaaatctacagaacactctgctgcatgtacactgctggtggggtggttagatgctactgctcttacttttttcaatgttttttttctttcatcttttttcaccaaatcctactcggtactaactcttgttttcttttgaaactacacattttccctggaactatatattttaagtattaaatgctatatactacatgctctcgtatttttattatggttttttcactcctaagtatggaaatatgtactatataatttatgttgacatttacctcctgatgtttattttaaaattatcatgtcttatgtttacgtaatgttcttgttctaaacatgaaacataggaaatgttaaatgccgtatactttcaaaattttatgaagatctttccctttgatgaatataagtattaatgctatacaatatatgttttcaaatttcgttgttcctaatttgtaagactaatataatattttatgaattagaaactaataatatagtatacgtattattgtaatcaaagattaactacaaattagatatttgtatttcgttttttgttaaaatataataatttgaaaaatatataagttaataatacttaaatattctgtaatatataagattggtagtaaacaaattatcaaacattacacaacctggaactcgaactgtggaccatgaactgtggaccatgaggtgagatggtaggcttctagccgccacacgaagcgagcacatttgactagtttgatccagcaaactactttagatagccaatatctcagcgccaagcaagccagctctgaccccttctgaccttggcaaatttttatcacctaggatgaaacgtcagcgcaatatatatggtgctaaagagttatatttcagcgtcaatctctatggcgctgagtcgacggcctatttttataataagtttttggcatggtctattattaaaataagttttctaaaagggtcaatttgtcaaaatttcggtacttttttggagctctcatgttatctagaaagatctaaccattgattagaatgtttgtatataaaattgagctcatctttactgactaacatttgctaacaaaactaatctttttgactgaaatttgattacagaactagcctatgttgactcaaatgtactgacagaactaattattctgggtgctgataaaactatacagatatgttggtgcctaaaattgttagaggcacacaaaactaagcattgattagttgacatttgcacatattttcagtgaatcaaaatgacctaaatagaactctgaaataattatagtgaaaaccctcctgaatttcttcaggccaagaacaaaaatagtgaattgtggataaatgatagaaattaaattgttgttgataaaacctaaaatcataaagtagtcatcaagggcatccccttgctctaattccacaaaatccatgtattgttaatgcatatatcaaggatcgatattcaagcaggtcttgttaataaaataatctcaagaatatcgaacagaacaaatatgcccccattgccagtacttgaaaatgctctaaccctcccccaaccctgttgccagtactgttacttctacacatacaaatcagcatagcacaaaaaagataatagaatcactaacctaataaaagatcaaatacatcctccccaacaggggcggatccaacgtgggt

SEQ ID NO: 80390 - DNA, 4485 bp, Oryza sativa
tcgtcggcatatatatttagagaaagtttagggatgaatatcctgaaaactgtatttttctagaggaagatggacacggatgattctatgagctgtggttcgtctatctaattaattttctagtcgattgattttcacgtggaaatactgtttttttatgggttggttattttcgagttaggatgtttttttttagtggaaaaggagcgatggtctggcaggaggatggcaccgctcttacggtacgtagtagagataatggattcgagtatgtgctgatcaaatgaaattaatctgtaggtgatccctccttttttcgccatttttatgataatgaggaaacacagagataaatgataacgtaattagttcctagattaattatagaaataccccactatatcaattaaggtttatattatggctgcttttttccaagactgttgattgatgagttgtctgaagatcaaacaatataaagaagtatagcaccttcattattcaaaattatatactccctcctttctaaagtataaagtataaggtgatttagatttttacgtggtgatctcctatgttatagcttgaccattaattttttgcatgatataacatcggcagctacgaaattaacatcatataaaaatcttatcaaatatgaatataatagtactacatgtaactaataaactctcacgtattgtaaatttaattattagtagtacaatttaaaatttttgatttttataaaagacgggtgcattatattttacggatggagtaacatacttgacgctggcatagtgatctatagatacgggaattgatgccagcgaaacttattacatcacatatagatcaacattttttacaagaaaaatgatgttatgattttcagctgatcaactctttacagtactgtgtttggtatattttctggtaaaagtgaaaaaaaaaactatatcattcaacatatatattatactttttatatactggaagtattacaaattaaagatatagttattccttatttgcctcaactcagcgtcccacgtttttttactgttatatcagtcgcatgcatatttggtcacggctagctgtgatttgggatgcgaagtatgtatgctgaccatgaaactattttaatcccttgaaaaaaatatctagctcctttatttaaaaacaataaataaaaacaatccgaagttatagaaaaatcttacaaaatttgacaacactcacatgacatatatatattagttaacaaaatttttggtataaataaactcaactcacttatcgagatataataaaataataaacttatataaatagtagggtactgttaacatttgaattcatttatttttcaatatgtaggtcaagtttaaacttaattttaggggattgatagttgtcactatactctgtattaccaagttattttttaaaaatatttcacaactaattacgttaaattaaaaagaaaaagttacacgatgagtatttccctcgagggattatgctaacccagcgcgtgttatttggtctagctaatttgggagtcataaacgatactggagatcgagctggtacttagcttagagaattactacctttcttgaacatttttatattttaaaggaccgtcgtttgattccattcaaatcaaaatccaactaaaacattataagataggaaaatatctccctattagtaaaaaaaaatctccagaatatagcaacgaaataagcagagacccgcttataaaaaaacggccggcgcacgttgccccacggctactggctggtctcggttgttagagagatcacgactctctcatgttttcctcccatgccacgagtcacggccggccggccagcgccgcgggcgtcgcgtcacaccacgagcgcgcgcacagtacacggaatacaagacgcccgtacgtacagccgcgcagctacagtcccccgtcacgttgggctcgctcgctcgcgcgcggcctgtgcactaacggcgtacgtcgactctggtgtacgtacgtggtggagaggccggccaccgggcacgtctcgccgtaagctagcgtataccggtatacgtcgatcgatcggcgcgctgcgcggcgcagcgcgcgtggagtcaaacttccccgcgcctgcacgtgcgccattagctatctaagccggtcaagcgcgctcgcccaaatcggcaaacaacccggcggaacccgatcgacgtcgacgcgcgcttgtcaccgagccgtgtaccgctccgccggccacacgtggcgtggcccgtcggccatcgcaccgtacgtggaggcgaagcatcgatcgccgtctacagagactcctccggccggggccgcgcgcgagcgatgggtcccgggtcccgggcatgcatcgatcggggccgtaattcattcgccggcgtgcgtgcgtgcgtgcgtgcgcgcgcgaccgtgtgaacggcccggcgccgcgatagtacgatggctggtaggcggcatcagtgggcgcgggaccgggtgggttattccaggccctctcccgatcgagttccgtgattccgtctggtttcctccgctgatctccagggatttccgagcgtgcgtgcgtgcgcgcggatcggacgagatcgacccggggccgggccggggagcggctgcgcgtgtcggcaggcaggtcaattgagttgaggtgatatgctgttggcgtggtgggtcgtggacgcgcggggggatctcggatcgatcttgtgcgtgttcgtgcagcgcgcggcgcggggtggccggtggacgcgaacgcgacgtatataggtggtgtagcgcgcgcgggtggggttgggttacgtggtggagctgagcccggcggcgcgcggtttgttccgccgcgtgcgcgtttcagctcctttttcggcttcttttttggcgatttgattttgatgcctgctccccgatgtgtccatcgggtgtcggttctaccagagacagcggggccgggccgtgactcggacaggtttggagtttttcgcgggaccggtaacgtacgtaggtgctgcttccttcaaaaggtgggggtgagccggccggcgaatatgcacgcgcgtgtacccgctcgaatactcggtcagctaatgagatgatttgggcgtccgtggctcggtggcggctacgttcagattcagcttcatatgcataccgtacgactgtcaattgtcatgataccgacggttacctttttcgtcgggttgaaatataaatgctaataagatgcggcaatggtgttagcgtagcaaggcgaggtatctgtgtgaaaatgaggaggaattcatgacagagatgctgattgctgagcggtacatatgggctggcattgccgaccaaccggtgactagactaccatactggtacagtgctactcatttctgagcgactgttgttttgtcccatgcaggctgcaggctgacctgatcaattgggctgtcaaaaatgtccagcccaaactctatggtaacgcagcccaatataactacgctcttttgggcccatcaggtctctcctcaagttagagtcgaagaggcccacgaacaagccaatattaccccccaaatcaccgaaccggaagggatcatcaaaccccagaacgacacttccgcacagccctagggtttctgttcagcgaccccccgaatcgaatcaagagggaggtgccatggcgtcgcggccgtcgctgaagccgaagcccaaggtcaagggcgcgaggaagggatccccggcggccgacgaggagcagtccacggctgcggcggcggtgcggttcgtcaaggagtggaccacgtggaccatgaagaagaccaaggtggcggcgcactacggcttcatcccgctcatcatcgtcgtcggcatgagatccgagccgaggccctccctcgcccagctcctcagcccggtctgatctgacgatcgccttcaagccctagatgcgatcgatctgcccccctttactaccgctttagtagtgactttagtaatagttctttcttagatcgtgccttctgagcagttgatgctgctgtgcggatttagaggtttttgctatatgaatctaataatgttatatgggtggatgcttctttggattaaactcttgctattattgtgcgggtcatggatctgctattaatacttcggtatggtatggagaaattttctgtgttatttgtatattcctactccttccggttccattttaattgacgttttggacaatgacacggtctaaaagatatttttaatcttacttttctattataatatatgttgttctagttcctttaaactaaatattttttaaagttattaatggtcaagttataaaagtttggcctcaaaccggagggagtacatgtttatgcttctgtgtgacctatttagctttccgatccgttctgattgaagtattgaactactcagaa

SEQ ID NO: 80391 - DNA, 7914 bp, Oryza sativa
cagtaggccaccgtaccatgcacagcacatgtaggaattatagcgttttacttccacatatgcatgagacagactctcctctcagttcttggagaatcctcccacagtggctgcacgatcagaagatccaacttttctagaaaacgcccaaaattgcgtgcaaatggctacttgcaaccttttgttggtcctaggaagaacgtccttcttggtgcatgcgtgacaaaatgattgattgatttgttcacgcccacgtactggccgtagctactagagtagcagctagctagccgcggacctcccttttcacgaactaatttccttgtccttagagtcggcaagaaatcgatcagatcatccacactagctgggcggtaatgagaatctcatcgatcgcacgttcagccagcaccaaggccttgtaggttgtagccactcaagttaattagctgaaacggagcagagtcaaaatttgactctctggctcgtgtagcttttgataaggaggttttactttctaattccaagccttgatcatcagttcatcacaaccataaaatgagtgaacgcttatatggctgctatttatggtatactaatgaaagataagcccttctgcgtgtgcccgcagtgttatgttgtgtaaccgaattgctttcttctaattgaatgatgtgcaattgttctgtgtgttcgaaaaaaataatcaaaggtaatggcagaaggaagacggaacaataacaccacatatgaacatctaatagtgtgccgcctaaaaaatataatttacacggaaggccatctaagatacgtccccatgtaaatatagatatttttctagtcggcacttcaatgaaaccgtctgcgtgcgggtggctgcttaaggtagccgctcgggtaaattgaaacaatcttcacgtgcggcggttgtcagtggtcacccgcgtttttatgtttacacgaatggctctctgaccctttgacacaagagatatcatcattcgtaaccataaaacatgcattttgtattttcatccacttgggaaattaatcgtgagggacctgcaaaaacttttttttgaagtagtgggagctagcacactggtgttgagaggtgtcctaggagaaactggagctcgagctagtaacaatcaacaagcctatgttagatatgaatataatcaaaactgaattacggaataatcaaaaccgaattgaaagtcgattatatggagatttgagatagatatatatttgcaaacatcgaaaaaggcaagatactaaagcactttcaatatctaagaacctgaaagatgaagctatccctgaagtgacctgaaagatgaacatgaaagacgaattacctccttgacaaataaaaaatagaggggtccacttgttagttctatctcttctttcggtcaccatatggcagttcaatcagcactaaaaaaagtacaaaaaggtagagcccacatgtggtgattgagagaagaggcagaactaacaagtgggcccccactattttttattttgttgactaccacgtgtgtgctacatagaatcaaaaccgttctggattcggtcaaggggtaattcgtccggtatgaaaagttaagagtgaagaatatctatttttaaattgagggggataatacgtactgttacaatagtttgagaggtagagagaggggtaattcagatttgtttttttcccttaattaatctctacatttaatttgtgacttgtcattcctggatcaagttctagagttacaatgttccatgaagatattataggcttaagggaaaattaacatgtactcccttcgtcccaaaatatagtaacctaggatgggatgaaatctatcctaggacaacgaatctggatatgtcttatcccattctaggttgttatatttttaggacggagagagcaacaaggtatttgtacttctatatcttgtattgcactttattatgtattagtgtgccactatcgaggagtttgaggataacaactggacttgaccagggcttgagaaaatactaggtccgttaacgcagacatacacaaaggctgatagctacttaaggccatttacaacccaataactaggatggtgtccataacattaaataagctgccacctaggatgaaaaatgatgtggcaagtgaataaatgaggaaagagaaggaaactatatcttgcatgagacatgacttctacacaatatccaaaacatcatgtgagataagtagcattaaatttaaatataggataattatgtttacattggaagagtagtgtctagtaggagtagtagtttcttaatgatgtggagtttatgaaaactatgtctagtgtcttgggttgagaatggccttagtgatcctgtccttgctatatattataggattggcaataattaacagccattctttttcctctcttcttcttttagatattttctttttttatttcaagaacgttagttgagctagcatgcgtcctttttttaaaaaaaaataatcaagatcttctctcttgcatgctgtccttaattaagagaagaaaataattgagcatatgaattgacttgttagttttaatttacttgattctccaaagctacctaccaattctatttctacacctgaccgtcaacagtattgatagtcgtcagcaactaactactaatttgccccatatatatatatttatatatatgcttgcacgagggataaccggaaaagaagagtttggtcaaatatgacggcagagggaataaaaatgatggcactagactgtcaaaactaaggaattattcagctatatcgagaggaaaccgagacatgctcgtatctgcaatccgtttaaaaggtgcaacttttgcgtggcaaagatacaaaatacatgtgtgtgctgaaggagatcgagcctttttatcattccatgcatgcatgcgtgaaaggattagaaaatacaccatctgtgcactcccaaagcatgtcgtgagggcaagtattttgcacgtctccttcacattttgtgcagataaaatttcgtaaataaacttataatcaaagtggattcactcataaagagaaaacgtatgcacgctagtaaagactaatcttgaagaagtatttatgcttgccctccgtcctgtaactgaaaacttactggtactccggcacttgcaatattaattaatactagtatatatgcggatttatcgtgtacatctaaaaacttgcggtcacaaccatatccatcagaccaccgtacgtacacatatattatctcagttttataatatatgatgtcgttcatttttttaactaacatttaatcattaatcgttttaatcaaaatttttgtgtaaatataaaaaaattaagtcatacatacgtaaagaatttttaacgataaatcaagtcaaagtaaaataaataatagttatatattttttaataagataaatgatcaagcatacgttaaaaaaattcaacggcaccatatcttagaaaaacgaagggggtacatcttggggaattaatatatcgatcatgatcattcatagaacatataaggccagataaaacatcagattcaacacatgttttgattagataccatacaagaatgtgaaaaaagaagaaataataaatgtgttatgttgaactgaataacaaatagctagcgatagacatagatctaacgcaaaaccggcctgctgcaggtactagctagctaatcgaatatgagaacaacagtattaattatcatttacttattcttgtgtcaaaatcccaatattacggccatctgctaccaaacaaaacaagcaaaccatgcatcatgataaggctatcttatggacactaccacaagaaaccggccagttcagtgtatcaatgtccaaagcaatcagaactctctcttttgcaccgtcattgtgtattaattccagatttatacatatatgtaggcacaaaagaaactacacacccgtcattaatttgtacaatctaacaaccaaaagcgggtcgatcatgtataataagttggcatcttctttgattgtcaaaagcgaaaatgtgagacgaaatattaattaatttgctctctccgaaaatgagtcaatgaggtacacatgatatacactagtacatgcatgtacaataagtctagaggtgcagaacagtaaagggctatgctgaagaatcaagtggaatgcagccgttctagttataaagttgtagcttccatctctactgatccgttcaatttgcaaccagggaaatgttgacaaatggaagagagaaaaaagcatgaagtgcacaacacacacaagttacgttcaagatgaaaagcttgcagaaaatcaattaattaataacaattatatattctcaccaagaccaagctgatcatcaagcactccctagccatcacatttttggcgcaacgactccaatgtttgaaaagcatcttgataaattccgggtgctagttaaatattgagtagtatatatttgtgcagaatcagttagatcagtcatcatcatgggttgctgctgggcattgtggaagggaaaaggtcttgcagcagggcgtagtcagtgaagtgatgctgctgaagaggaggatgatcgttgggcggcattgcaccgccgccagccacagcaggaggcggcggagcagaagcagctacgcccgggaagtacatgctagggtttgcggcggcggcggccatggccgggtggtggtgcatgaggcccatcagctcagggtggaaccccgccggcatgaggtgcgacggcggcaggccatgcacgccgggcatgaagaggtggtggtggtggtgccctccgacgatgccgacgccgccgccgccgccgcggaggctcgccgggctgtggtgcgtgtgctgcccttcgtacgtggtgatcaccgtggaggggtcctggtacgaccgctccacccgcttcttcacaccgcacttgggcgtcgtgcaccggtagtagctcctgcaatattcgaattcgaattgaattgcattttgaaattggagtacttgaacaccatcgtgccatgcaattgtatggcacagtaacatggtatactacgatatatgtatgtgctacaacaactgggtgaaattaaggtttgtacatgtatatagatgtgtacctcgggtatgggctgttcttgactgccttctggccgtacttgcgccaccggtagccgtcctcgaggtgatcaacctcgctcttggtgaggaacgccacgcgaggctgccgctgcctcttctcagctttcttcttgggcttgttcctgtgtagatgcatggtacaaaatatcaaaaataaggtcaggtggattagctagaaacagagagatgatatggattcagaagatcagttgatatttctgcggtgacaagctcaatcaggcctaattattaattagtttgggctttttcagagcaccaacaatcaaactagctaactagcttgctagataggtaggatcatggtggactatgggaatagctagctatttcatgttagattagcaccaggttttgctagaaatagttgttattttgatatatagtattaattagggtctaataagttagctagctagctagatatctgttggattgcatgttatggggcaagatcagcgttaattttgcaaaagtactgaggaactattgtagatttaggtggttggtggtgatacgaaaatatatcttaatttgaatcatttctaaaaggggaaatcataatataatcttcaaagacctagcaagtcaaaaattgaagctataactcgtaaaattgattcattctacgcaagatctattatggagcataggttggttgtctattaaattaaatcgaatagtagtagccccatcgtctgaaagatcatattggaaattgggtcaaaacggaatcagaagaaaaggggaacaagaggatagacggatctactaaaaagaaccctaaggaaccaaaattctagcaaaccctaatgttcacaccatgcatgcagtagagagaaagcataaacgaaagaaaatttcaggtcaaattttgcaactccgcaacagtatgaccaaccagatctagccccaagaaagtatccccatctcaagacacgcatcaaaaaagaattaatcaagcaagaaatcaagacaagaatcagacaaagtatagagtagaatcaatggaaatttaacatacggtttcttggagttctctccatcctcctcatccttgtcgtcctcctcctccgccttcgctgacccttcttgcaccggcgtgacgatttgccgccctccgcctctccgtcgctggacgagaaggacgccgacgagttcggcgtggcctgcgcgacgccttctccggcgacgccgccggtgccctggctgtcagggctcgtcacatccaccgacagctcctgcttgaccaccgtgtcctgagacgacgggcacgccacgtcgaggtgccgagctagcccggaggggtccaataacccctgcaggtagtccgtgatgctggagtacggcatgatctcgtcggcaccgccggcgccgacgacgccaccaccacccccgccgatgccgacgcccccgggttggctgaagaagaagctctccatgtcgctgctgctgtacacgtaatcagcgccttcgccgcggccgaggtgcccgtgctggtggtaggggccatggcgatctcctcctcctcctcctcctcctccagaagacatggggtgtgagagtatggggagctagcttatgtgtggaaaggaaagagaggcgtggaagtgaggagggtttcagctttcaaccggtctcacctcccttttgatttgttttttctttcttttccttcgctggaaaaggataggcgcaagatacgactttttgtgatggaatatgtaaatctgtctcggtgcggcgtctagtgatcttcgtttatatatatataatactccataattccagcagtactattaatatatatacacacatatatactagctagctagtcgtcaattcttaatggtagagacgttttattaatgaaatcagcgtgcttaatttagattcttttcgcatctgttggtcagggaggtattaggtataagaccggccagtgtcaacgtaattaaattgtgtagggcctgccgtactatgaatagttgaatccatacagttcagcttactgtatgctgaattaagatactatttcccggttggagttggtatatattgggcatagcatgcatatactatgtacatgttttgtgtccattaatttgagcaatgtaactcacttacatccaccgcgttttaacggacatctacggggatccagccaagagttcgaaactgtgcatgtgaatttcgattcaaatgtttatgcatgatcaggcatgcttcaagattttaaatgatttgcacagtacactacagctctttcttgacatacacgtgccacacaagtaccgttttgaaggatgacatgtatccatacgtatatacagctgtacatatttatagttggatattggacgtacggctgtcacagtacccttgcacagtgcacagctaccaaactactctcatcttattaaggacaaatatttcattcggttaaaaattagagaagaaagacgtcaaaaaaaaattcgagaagaaagacgtacgtctaaaaaaaatcgagaagaatgttcattgcaattgccttctgatctacacaatctagcattgacctcatggtccaattgaataacatggcaaaaaatatagtagtatatgcgtgtgtatctgtgagatgtgtctacatcgaacatgtacgtctacaagtttttaatttctgttgat

SEQ ID NO: 80392 - DNA, 652 bp, Oryza sativa
gtatatgccttcacgtttcgggtcagcgttctgcgtgagctcgatgagaccattgagactcgcggatccatctattgcgatgtcggaacgattgaaagtggtgggcttggagaaatcgtagctgaaagagagtgatctggagaagcaaggtagcttgaagatggacaaggaagcgaggagcaagagtgcggggatcattgagctcctcttggcacccatgactaacttggcacaagctcaaaatatttttttttcccaaaggggggaacaaattaatggcggcagcgatatctgactaggagaagagaattcaagaaacaattagaggtccaaaacaaatgtaacttgacgctggtaacctgagcggtgtggaacgaaaggaacgaaatgatcttcaatcagaaagcgcgaacgccacttcggatgtttggggacatcaaggagatggaagatggcgggcgtattcagagaggtggattttttttttcagtagttgatgtaatttcaccctgtacagaacactcccctttcttcctgagatccactaactaatgactgagccacgcaaagaaatggccaatcttcctcgctgcgactgcacacactatggggaataacctagtaacagtagtctttcaaaagtcaaaacaca

SEQ ID NO: 80393 - DNA, 9275 bp, Oryza sativa
agagtgaatgaagtgatgtccttatataggtaggtatgacggttatcctctatgcgaattgtctgaattgccccataaccgtcatcagggagtaatctgggacgtccatgccaaaccccagcctgaatggctgagatgctgattcggccgaacctgggctgggccctcctggcttggccttcggcctgtggactccctctgttctgccttatccatttctgtgaattttgggctgattctctggtattttgatgaagttcacaacccattcttgtatggatacatgtttctccctcactttggtctaattttcctcccaactcctaggtttattacctgcatcaaataaacaccaacacttgtggaatatgtgagatttaatacctatcactatgttggatgttttattatctagactttatgcagatgttggccgtaataccctgtatattaaaagatacttatgttttttagtttgggttgacttgtttaaaataaagatgttaacagaaataaataaaagaaaataccttttgaagtgggccaacacgagaaggcccataaacccagcccactagttctcccctaaaatctagagagagaggaaccgaatcccacctcccctcatggtgccgccacccctctccctggccggcgcctccttcctcccctcctcctgtgttcgcatctctcacctctacagcaaattgctctccctagatctccaccttcatagcttggatcaagaagcgaagtagaaaaacggaacgaggaggaggtgaggagtaaaaggaggggtttgatcggagtttcccctattgtctcctcacaagttctctaaagaaaccctaggtgagacttatccccttgttgtatcagttattctagcatggctttagtgctttaattcgtggttagggaaagctagagaaggagtttgggtagttgcggtttggtttgttgtagttctgcatgtgggcagatttgcagtgcttcagtgtttcgatgttttggagctctaaatattattttctgcaaaagtgtataactaggaagttgtagataatgtttggatctatcttctgaccaaagggcgcgattttatctcaagtggtttaggagatataatttttttaatataactgttgtttttgtgtcataatctggatagtagaggtttttcttagatttccatattggtaaagtacaccctgattggacgagtagaactctagttatggttgttttagtgtggacagtctgaaattctagacagattctgaagcctgctttcaagcgcaaattagaccatttttatggcagaataaaaatatgttttctacatcaaagttgtaggtattgttctgtatattttcaaagtgtatatattttcagtcatagcctttccatttttcaagatataaaggtttgaagcaggagtcttgtgtatagtccaagcggcgttccttgttattgagttttgatgggatggagcagtaggttcacctttttcattgttttatatgcatgtttgaatgtgtttgctaaggttttgtttgtgattaggtggtggtccttcagatcgtgcatgataccaacccttcattggaggcaagagcatgacgaactaattatgtgattcatggattgtttgctctatctatttatttccgatatatttctatgtgaaatctgactgcttatattcatattgttgttcacgccatttaggttttcatgtttatcttatgtttacgacgttattcttgtttcaatattccggattctggttctgggtaaataattcaagttccatgcttgccatggatgtgcaatatggtttcaatttggttctttgattctggttttcaattattcaaggaccatgcgtagtcatgggagtgcaatttggatctttattcatgttcctgtgggtaagcactgatcacgcttactcagctttgccggcaaatgttaggatgtattcactattgtccgggatagaaactactatttcaattcgtgcctgcccaggatgggaactactatcttctttaacttggtgtttgaaaatgtgtttcctatcaaagaaagaaagccttctattcatgctttattgccaatgtagtgtatatgtgttttctagttccatattgtacttgctgagtatttttatactcactcttgtgttttatttggttttaggtacgcattgagaccgacatgcacgggcgggaagtagcacccttatatacacattacttgcacactatcaaactatattgcttatgtccataatgacacttaaattatatcatggttcggtcttgtaataatcttttagatatctattagtttctttccatggaattataaggaaggatcgcaccgtgggaatgatattattattagtagaacttataattgcctgtcgtggatgtccgtatttacaggggagactgccgaaatttctaataattttgggagttagtggtttgagtgtttttttggtgtggcactttaggtacgtggttacatggggtgttacattggcggtatagaattggcatttaataactaccagcatggatcgagtcaacttgggagaagataacgtccggacgatcaggatatcatacgggatacttaggctaaataccaatgcacgtggttggtgaagattccatatggcatacgatggagatattgtgtgcatatcgtgcatatggaatacgatggagattccatatgactcccttgtatacctctgaattttgatttggatcccttccatacccttgccgtcaattgaccgttagttgaccgtttaataggtatagaaaagtcagttttacccttcaatacatgaggaatatgtaaaaatttgtaaactatattgttgcaagtatagaaatttgttgtgtgattataatattcgtaagtttgttgtacatagaaattttaataaatattaaaaaaagtatgtgtagcattttctttaaatgataaacatatttttggaaagcattcctatataatatataggataggaaaaagtgttgaattaccgtaaaaaaatgctacatatactcttttaataagtaaataaatattagttttatgtcatgatgtaaaaataaactttgccatgaataataccttgtacaataaaatcatgaatacaataattttatatataacaaaattatacacttccaacaatatagctagtctgcaatttcctgatttctttcatgtgtaagggcaaaatggtcattatcataggaattaaacattcaactaacggtcaacaaacggaatgtgtatgaaagggatcaaaaccaagattcaagggcatataaggtagtggacaaaactcgggagcatagaagggattagctaaactttcagaggtatagaaggaattttctctatatacagagagggagggtgtgtcctcccggtattgtttcagagagagttgagttgagagaatagttagggtttcgagtttagtcgagattttggtgaggagtgctattgttgcactttgtaaacacacagaaataacaaagttgtaattctacgtttgatgatgatcttcgatttgtgtttactcgggttcggcagtccaatcggcgagacaccggcgatcagaccgacgacattggatcggtcagaccagcggagcaacgatggtcagaccgacggcggcgacaggagccaggagcgattcttcggcggttagaccgggcgatcaacatcggtcaaaccggtggatctactccggtcagaccgatctatatcggattcgagggtaacttttagttccgtaaaaagttccggtttttgggtactacaaccattcacccacccctctggttggcttagttcttgttgttcgatcctacagaggatgaagaggtggaggtcgctctcgcggcaccgacagcgagcacacgagcccgagcccctgaggggatgctaccgcgccgccgccaccttcctcttatagcaacgctgacgccctcctccacaccgccgcttgcggccactcgtgcgctgacgccctgctcctgcctgccacgctgacgtcctgctcccgccgatgccgccaagaaaaaggttgagagaaagagagagagaggaagaaagggatgtgtcattaagtccacaattttttatttttttatttagattgaacggctatgacatgcgggtctcacactttactcagccgccacgtcagccgaaaatggccactatgctgtcgagggaccaaagttaaatggtattgtgaggtgagggatgtgctatacgtggtatttaggttcagggacaaacttcagactcggcaacaaattaaggaacctaaagtgaacttattccatctaaaaatgaaaaggatcaaataaattggaacagaatgccacgaattgattagtattgtggagaagatcgtcgccacagtggttccactcctttgtacacatctcggttcacgatgcatgccattgttgtctcaatgatcaactacattgcagtaatgcaaattaccaaagttctcgtatgcgttagtacatatgcacgcacaacacatgggccaaagttggcctcctcttgctgggctttggcccagcaagactccatgcacggacgtgatgaatacaaacttctagacggacgggcaccatgacagcgtgatgaaaaattgagaagcgcaaccgtttcactatttctccgttttcctccacgtgtcgctagactatttggctgccaccaccaatcagctagcaggaggcactgctgattttctttacataatttgtgagatcagggagacacgtggtccaataggcagccggcaaaactgccggcttgagattagttgatgagtaaactttaggaaatactaacacaacgaaaccaagcactcgactaggttgaaaggtatttttatggttggaagttggaacacatgaccaaaatgttgaacagtgatagcaagatattttatgcttctattcttgacataacaagagataatagtgaaatagaaaaggaatgaaaagcaaaaattagtttgaaattaagttctaaatttaaatatggtaaattgcacatcacattaagttggtattatttatctatcaaactaaaaatatatatactacgaaattagcacaagacagtaacagagaaaataaaagcacgaatagtacgatggtgtagtcacgtgtatataggggtattattgggtctaacgttttagcctacaaaaagttaagaggtgagtctaaaatgaagtaggctaagtttttatacatttttatttattcggcttacttaatttcattgttgtgtaactaacacaaacaattgttttgtatttgcgactgcagtagctatggctaggtgcagcggctgcactgactagccaaatggacactatgagtaggggtggatagcgagccagctcagctcggctcggtccagctcgttaggataatgagctggctcggctcggctcggctcgttatcctaacgagctagaaacccagcttggctcagctcatctgaaaggtcgagctagctcgttaggctcacaagccgttgatgggcgcctgggcagtgggcggcgtgtggcacggggcggcggctggcgggggcggggtaggcggcggccgtctagggcagggtaggcggcgccggcgggagcggggtaaaggccgtgctggacctcgtcggctccactcgtacgcgcgtgtgctgtgcaggtccaagcaatgaagcctcgctaagactagctgccagctgcgacgacgggtcatcaccggcctgcctcaatgacacctggtgccggctggggaagtgcggcgccgacggcggcagcgaccctagcggctggtggcagcggccctagcggctggcggcagcggcggcacggcgagaggtgacgccggcaccgactggggaagtgcggtgccgacggcggcagcggccctagcggctggcggtggcggtggcggcgacacggtgaaaggtgacgccggcgccggctggggaagtgcggcggcgacgcgctgtggaaggggatcgaggattcgaggttcgagcggaggcggagccaaagagagatgcgatgcggataagccgccgatgcggtgagaagtgaggagaggactagggttttgatgttgtgggcttgggcctttggtgttgtcttgggctgggccttttatgttgtctgttggagtcctggctcgttaaggctcacgagcagctcgcgagccagctcgagctggctcgttatctctaacgagctaaacttctagatcggcttgttaggaaaatcaaacgagccgagcttgtcataagccgagcgagctaaggagccacgagcttcctgtccacccctaactatgagggctaaataaggttgtgagaaaactcatgtaccttgatccatgttaaacacctctacgtgtgtgtataatgattataattctaatgccataaatataccaattgagaatgcgctttgaatagaaatttggggtggtcaggtattcaagggtgttcatagaggtgtagcttacccggtgcactggacacccgggtagcatctaattttttttaaccatattaatcatatattactccatattagctagtaataattagactgaagatttccgataattttcttctggatttcgccactgcgggtatttatcgtcggtctctatctctgtaagtacttaatttattctagatatagctatactcctcaactatatatatatgtggctgtgatgtatgcgcgcgtttcacgtgaaataaaaaaaaatcgccaacagcaaggataaccactgctcagcgccgtcgtgagatcatcacctccagcacctctattaattacagccgttttaggaaactaagttggcaccagatgagcccgatcgaggtacggatggagtacacgtcaagcagtgcgaagttgagcaagctgaattaagtatccttaattatggagcaaggaacgatcgataaaaagaagaagaagagagagatcgcacaaattgaatagctgggtagtggttgatctaaaataaagattacatcaacatctaaataatctttgtgttgatattttttagttgatgtctctagctgcgctgatatggtcatatcatatggagtatataataagaattcagcaactataccagtgaaggtttcggccagcaaattggaccgtgctcctgccttctaattttgttttttttattgaaacacgatatgatgaacagatagcatataaacaacccgtaactaatcttgatacctcgcactataaaactcgctggatgctaggaagaacgataaccaaattaaagtaccaaacaaaccaggagacctcgtgttacattctagtatttcataatactcatgtgaacatgtgagctcaccgccgcgaagtgagtatagcttaactagttaggttccttgtggtggaaccagcccacccgggttcaaatcctagatttgacatcctaaatttgacacccatcgacagcgaggcgcctgtggtgacttcgttaggttagggtgtgcatgtgtgcctttacaggggtgagcgcctgctgtgtttctcaaaaaaaaaaattgagctcaccgccaccgccctccccaactagctcacacccaaaaaaaaattcgcatgtgagctcccagcattatctttacgccttctcctattggcaaacattttcacattattttttaaaaaactatacattatagtttacatgccacacatattttcacaaacatgcaaagtcaatctatctataaatgaaaatatatactaaataataaatactccccacgattcaaaattaatgtactaattcttatagcaacattttgtatcggagagaggaagacctaaaagtgcatatgtgttttgcagttgcctttgttattattttgttgtccatcaaattgaattttgcatattttgtttctttaaaagttgaatccattccaaccattgcttcaaaggaccattattcccctcatcctaaaatataaagaattttgatcaaatgggatagattctaattctacgaatatcatccggttaaatccccttatattttaggacaaagggagtattataagggttgaatgacgaccgattgcaaattataaaatcacagattgaacaaaaacaagaaaaacctatctagaataccaactcagatattttccatctatggttggtgagggtctgcataaccattgtttcttgcaaatggccttacaagttatatatagttattgtctttcttaaaccgaaaacagaatcttcttaaatcaacggctgattgattattttgtgtcattcggtcggagagtaaatgagttgcaacgcaatcattcacccatatatggccattaccatagccatcaaagtcgatccaacgaagacacagctactaaggacgccacaccaacatgatacctctaatgtgatgtctccaagaaggttaaaatattgtcactgtcgctattccagacattagtgactaattaagtttccacttggagaatccatcccgagatacagagagcgttggcaacattgtctccgaggtgtttgacaggttttatgtgctagttggtacaactatagcaatagacgaatacggcttgctagtccagttactcctgaaagtatacgactgccatggcaaatagagccaactacgacgccaaatgatcagcagcaaaagcaacacacatcgtgctgctgaaactcgtctgtctcaatcgaccacacaccgtttccctcccagatgttttaaggcctcccaattccactatctacgagagaataatgttaaacttattctcttgtaaactccctccaccctaaattatagattataggacgctttctttttaaggaaaattaaactcggtaacttttaactaatgatcatactaactatatatgctagcatgttataccactagatttattaatttatattttaaagtgctttaatgcgatgctaattctatatttattgagaacatagcatgaaataaattactaaattatattattaaagaccatgtaaaaaaatataggccttataatttaagacggatggagtattgactaaaccgttagagaaaaatagatgctaaatgagtccttccaggccatctcgtgacctactactttaaaagtgcacctcttt

SEQ ID NO: 80394 - DNA, 23168 bp, Oryza sativa
tgttttgctctgaaaagatcagttgaagtaatttcctcaaaactcaaatctaaatgtagttttttggaaactcaaaatgcattgataaagaatccaaattgatagaaataaatatgtaggtacataccaatttacctgtggtgagggccgcgtcattttggatctgacgagcaagaccgtttctcctttcgtttagattgctaattttccaaccgtctacggatgtcatggagcgagcatcttttgctacacttgccacaccttctttggttttggtgtggacggcggcttctctggagccgtctcctctggtttcttggctggtgttttagactgtgccggcgtcttccaataacggatcctaggaacgggtgctccctctcccaggaagttccgcatgaacttccccaggctatccattttgggtggctccacttcggccacttgaatattttgcgtgtttggtccatatttgatcctcaccatggagcattgttccatccttggctgaaactcgaacttttatccgtccccacatcaatgttggcgtccctggtgctaaggaatggtcgccccaaaatgagtgacgttttcttctccgaatccatatccaacaccacgaagtcgaccgagatgaagaaatcccgtatcttatccggtacgccttccgctatcctagctaggtaacagaccgaagaattagccagttgcatgcgcatcggtgttggtgtcaacaccgtgatgttgagtttatcgaagacgtccttgggcatgacgctcacacttgcaccaaggtcggagagtgcttggttgaatttttgtgtcccgattgagcaggtgatcgtgggacaccccggatccttcttcttttctaggagtttgtggagtataacattgctgcattcctctgtcagtttgaccaacttggttgtcggtagtggcctcttgttgcaaggatgtcctttagataacgtgcgtaggtgggcacttgcattgcgtccaataatggcacgttgatgtggatcttctggattacctcaacaaaccgagcaaattgttcatccaccgatggcttcttatacctttgggggaatggcagcagcctcatgtcacaacattcctgcggcccggtcctttctggccaaacttcttcgacagcctgttgctagatggtgcttccagagcgttgcctgttcctacaacgttaggatacggtggatcgcaagtggacttaccacccctcgtcgtgatcgccttaacattctcaacagagggttcgggttgccccagaatcctcccagattcattagcaggtactagaaacaaactaattgttgccagctgggtttcaatcattttattaaaactaagctggtttcggaaaacggaagcaaagccatctaatttgaaatttatgttttccaaagtcttgtcattagtagccagcttttagctaagagcatctgtggttttggcttggcaaaaacaagatccttcaaggaaggttggttaaaatagttaccattattttgcctccttggaaatataggcgtggctggttccacccctgacctccttgtggacggaacccattgttgttgttgttgcccatgtacatcgcctcttcacgggtttctgggcagtcattcccagaatgacccattttgccgcagatttcacacataaagtgtgagtccatggccttgacgatgccttgaggcctcttctcgtggtcgtccaatcgcttcatgaggaggtccagcttcgcaacgagcatttccgtttcctttacggtgtgcatgccacgctgacgggtctggactccttcctcgctccagctcatgttggagactatcttttctatgagattgattgctcctctgaccgtcttggaaaagaaggctcctccacttgccgtgtccagatgatcacgggacatgggagtgagtccattgtagaagttctgcaggatcagccagtcgtccatcccatgatgaggacaggcagccatgtactcctgtagtcgttcccatgcctcagaaatagactgatctctcgtctgctggaaacttgaaattcttccgcgaagggcgttggtttcgcccatcgggaaaaacttcgataagaatgccgttgaacatttatcccaattgttgatcatagcgcggttggcataaaaccactgtttcgcttttccaaggccaagagggaaaatgggaactgtcggagcctttcggcatcagaactgatgcccttcatcgtgtacatgttgcagatctcgaggaactattgcaggtgtgcattggcatcctcgtttggcttgccgcataacgggctagcctgcaccatcgtgatgaggctggacttcagatcgaaatccacgtctcccatattgatttgtggcctagtggccacgttgtcagcagagggagcagtgaattcgcggagggtcttgtcagccatagtcttgaaggttggtggcgtgggaatggctggtttctctatcggaagagttttctgcggagcaacgactcgcggcttgaagctctgaaagaaaacttctggattttccttgaaattttccggcaagttaaaaccagtcatgcactaccctatttccacaatagaagtgaaaacaaccaaggttagcctacaaaggacagtgattatacagaggtaaatataaagtattagttatagtaatcttttttatgaatcttccacggcaacggcgccagaaatgcttctggtatattactcgaaatataattcctagcaatggttgagaaatacttctggtatattatggttacagagttcatccgcaagtgcatggaaataccattgtagcttttcacccaagagtattccaagggaatcatatttgagtaatcccgtgggaagattataatagagagaaccacactaataattatatattacttgtaataaccaaagtctaggcaggggttaatatcattcaaagggtagagtgacactaagaaaaagtatttatactcttattcataactatctaagctaagtggaaaggaaaatagaaagatcctattcctatacttctagtatacatacatcctacttatatgattacttagtgtcatgcccggaaattcactagtaatttccgaactaatttgtgcataaaatcctcgtccaggaatcagccgaggtacacaaactgacaatttaatatacaaatccatcttaataataacgttacatacttacaaagaaaagaaaaacagcagaggaattaacggtctagcgatggcttcagctccactcccacaggcagctcaactggggtataagccaaacgtcttttccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagagtagtaaaacaatagagtaattaatcatcaattttaatcaacactgaacagcacacccatgctgctcaggcccaaccaaacctgaacaaccaaccccggtcgtacagatcaaacctccaaactaggaattatccattccaaaccaggagtcaaattaattctcacattattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgcccggaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccacttcacagtctggcacactataatgaaccatgctatacaaaaggtaaagccgttgcccatgctgccttgtggttggcacggtaaatgtttcacaacagtagctcgcgaaccggtccttaattgtcatgagcacaaccatcaaaaccatatgctcacaacccaccttagccaggttataattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattataacccattggaaaataagatcatcttcggccattaattaacggggaaaggttcaccacccgatgacattcaaaaataatgcatagttgaaataaaataatagctttaaacgggttcaacatgctcaaagggttatttgggatctgtgtgacttgccttgggcttccgcaaacacttccgaaccttcctcaacgaaaacgctctcctccggaacgtcggaaaataaagcgaaagaacaaaaattaacaaaacagtacaaaaacaagcataaacagtacacgtcaatatttttaacatgaagatcttgattttagaaaaatttagcaacttgaaccacctgaaacggatctacggttatttagatatgtttttctgaagatctaatctatttcatctataaaaaaaactaaaaaggaaaggttatgacgtcatgctgacgtcatccatggtggccttggctcgggcggcacgaccaccggcgctacggaccttggccgggcgaaaagagggcaccaacgcgtagagggcaacaagacgaacgcaacggtactcaccaatgcgcccaacgacgaccgatggtggccggcgacgagaggatgcggcgcggtggttcagtcgacggtggcggcggcttcacggcgaccgacgacagcggagagggggcggacgagctagctctccctcacgcgcacctaacggcggtgagaaaaggcggcggcgacgacgcaagcggcggcgcggcacggctgagcggcgaccggcgacgacggcgactagggcggcgcggcggtgactccacggggcactagagagctcgggaaagggggcaaacaaaagaggaggactagggggtcctatttatagccttggattgaagagatcggactcctcccgcaagaaatcgatcgggaaatcaaaaactcggttttggagataaactcaaaaacgagttcgattcggataaaatactcaacgattagctccgatttttgggggtaaagatagaggaggacgaggggatcaaaatccctcaaacactcggactcaaatgcgagcgagggcggcggaatcggagacgggaggtggcgcggcgcggccggcttgggctcggcctgagtcggccggaggtaggggatgaccccgacatgtgggccccacatgtcggtggctagaggaggagggggcggttggcggcttgctgggccggctgagtcggctgggccggttcggccgcgggcgggagagagagagagagagagttgggccaaaaacggcccaacaacttaaaaggaggggttttggaactttttaattaaaataaatggtgaaatgttgtttcaattattaaaaaaatacttcccttgctcaaacaattcagaaaattctagaaaatagaggaacaagcaaaatatttaataaaattttatctagcccaattttatattgagatttagcaaattaaaattagatcttctcttttaagcttttaaaatcatttctgctaatttcttttaaacaacaatttataatttaaggattttaaacaagaaaagcacttaacaattataattagatcattattgatcaaataattactgaattgttctttgtatcatttaggaattgagctccgaaaaatccgagaaaattccagagagtataattaatcatggagaatttaataaaaattaaatccatccatgctttatattaagaaaattttatttcccacatttaacttcacttgtaaattaatgaacatttaatataaattctaataataatttattaaataatttataaatcctgaaacaaaaatcaggatgtgacacttagctaataccctccttccgatgccctcctggtgcttcgagaagccacccctgattgccgagtgtcacgcccagaaattcccgaataggattccaagcagaatgtgcattaaaacccccgtccaggaccggccgggtacacaaacgacaaagttgacaaacagatccacgtcttacaaacatcataaaatcttacataaatgcagcggaaaattaaaagataactggagctaagccttgacttggactgcagcgggaacaccactccacaggcatcctcgacggcacggacgaaacctactcctcggagaagccaccatctgatgcatactcaaactctgaggtttggggaaaatagagcaagactgagtactacccactgtactcagcaagtcataccggaataggggtatgatgcacggaattaactacggatagctatagaggttcgtttgcatagagcgagcatttataaacagtagttgaaagcagtaaaacagttgtaataataaatcaatattaaccacccactgtccaacgctaccccacgttgcaacaggcccaaccatccacctagactattcaattccattagactagacttgggtgagaataatcacggtgaatctggttgaccgcccataaccgcgggcacggctattcgaatagttttactctgatcagaggtgtacaactgtactgtcacaccctaaaaatccaaaatatataaattgtcgtttaattggaattattagaatttattttaaaagtctagaagagaagatctaattttaattaataaattccaatataaaatgggaccagataaaatttcattaaatactttgcttaattctataattcctagatttttctgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgtccgaaaccctagcgccgccgtctccttccaaattcggccgcgtctttccgtttccggtgaaatcaatagaggggaaatgatcttcgggatctcgtctaccttttctcttctggaatccccggctaaaatcgtttggaaagtgttggtttcgaggtcgagtcggatcggtctctctctctccgagccctaactttccttctcgtcgccggtcgccgtgggccttcgccgccgcctccttgcccctataaaaggacccccggtgtctcctcgacccgccgccacccttgctttcgtctctcgccgtcggaagcgccctagcgccgtgcaaccttgagccgccgtcgtcgccgtcgctccagccgtgcgccaccgccgttccggtcatcgtcgtcgctcggggaggtcgccatcgtggtcgccaagtcgtcgccgtcctcgtccgcccctgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccgccgcctccgagcccctttaaaaggacccccgagctctcctctacccgccgccaccctcgcctttgcctctcgtcgtcggaaacgccctagcgccgtgtgccctagcaccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccgaagcaccgtcgccgtcgtcaagcggaagaccgccgccgttttaacctcgtcgccgtcgccgtctgttggtcttctgccgctcctttggtcaccggtgagttcgccgcgtcgcgctctacccgttggtgccctccgttcgtgccgaagcgtcgccgttcgccgacgagcatgcgcgcccgagccgccgagtcgccgttgccggtggtgacgtcaccgctgacgtcatcgtcgccctctcccgtgagctggtcgtggaccgatcgatctcggccgtccgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagaatttgaagaattccaaggccagcaaggcaagtcacacagatcccaaacaactctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcaactagatattagatataattgcttagctctgcttagaaacattagcacactattgggataacttatgaatcactataatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcagagcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtttttcgtgattagtctcacacctctcatcatgataacaaatgctttaaatggtaataatttgtttagctcctggtttggaatggtacattcctggtttggagataggactgtgcagccgggatggttgttcagaatggttgggcctatagaacagggtatgttgtatagcgttggattaatactgcttaattattaactgctttattaaattctgaaatgtttattaaatgctgtttatgcaaatgaaaccctactatgccatcctttgttatcctgtgcacctgcatatttgttgcgtggcttgctgagtatgtcatatactcaccttgcaatcattcatcagaggaggagttctacagtgaagctgatggtgtggaggattaggtgtagccctggtcaagttgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcagatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgacgtcatcggggccgtctgccgtgagccgccgtagacccgatcgatctcggccgtctgttttggatggatcgatctcggccgttcgtttccgtgaaccgtcgccgtgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatgtacatgttaaaaatatccacatgtactgttcatgcttgtttatgtgctgttttggtgattttgctcttttctgcttagattccgacgtttccggagagtccgttttcgcaggagaagaatttgaagaattccaaggccagcaaggcaagtcacacagatcccaaacaaccctttgagcatgttgatcccgtttaaagctattgtttgtattcaactattgcatttattttcgaatgtcattgggtggaattaacctattgtttgttatagcccttttgttcttgtctactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaacggttgggcctatgcaacagggtatgttctgtagcgttggattaatactgtttaattaatacttaactgttttatcaatttctgaaatatttgttaaatgctgtttatgcaaatgaaaccctactatgccatcctttggtatccttgtgcatttgcatatttgctgtgtgacttgctgagtatgtcatatactcaccttgcaatcattcatcagaggaagagttctacagagatgctgatggtgtggaggattagacgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtatacacacatgtaagcgtttggaattttggatagaaattccgggcgtgacaagttggtatcagagcctccttgaccctaggttgtgccaaatggttacccatagaagccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttagatgccgcgctacaagcctgagtacttgtttggtgttgagggatttgtccaagagttgtgtacgatgtcctttgccataggatttgggactgcccctttttatgcccagattcctcatgatcgtcatgaagagaagtgccgagtcaaagtcactttgaacagtaatagtgatgaaatcccctcagtgatgttcgaagctggaggaagaaactacatccatgcgtgtcaggaggtggcaaggatcgccataggagagctccgcgatcgctattgtgatcagttggccgacactgagtatcgctaccatcctcgccaaccacagggaagtgatcgtggcagctaccttgagactgaaggaattgagaatgatgctaccacaaggcatttggttgagatgctgtgggctatggatgaaacccgtgcggagactgtgttagcagctcaagatcgtgaagaccggaatcgtggtaagatttgcaagctagaggacaaagtggatcgtttggagaaggaactagccgcattgaagggagaagcaccaccgcagaaggccagggttcgtcttaccgcaaggaagagagctctatttgtccctcgttaccaattggcgccaaaggtccgtgtggtggagaaagaagttaccccagccctagcagatcctccggttatcattataagtgatgatgaagaagaagaatccaagcacgcccattacaagatcgagtggggagcaactcaagatgatgaagatgagccgaacgagccttcaatcaactccgatgcccggaagacttagaatgccttgtcaaaccgttgtcttagatcgttgtgttagtttgcttgttttaagtttggttgtgtgtgtctcgcatgtgatttacatcagtggtgggatgtaagtgcgtgcgtttgtttgctttcgagtgttaggtagttggtgagttcagtggtgtgagaatcttcagttttgtaataatgaaactcacttaagatcaataaaagctaaagtaattctcggtcctaagtagttttccccggtttctcttcttgtgctcctgtccatgccagatggtgctcactcgtagcaacgggaatggccccaacaacaacaacaataacaacaacaacaatggagagaatcccacacttgcccaagtcctggctcaacagacacagcttatgaacataatgatgcagcaactccagaaccagcagaaccagggaaataaccatgcacctccccagaacaagttagcagaatttcttcgtgtgaggccgcccactttctctagcaccactaatcctgttgaagctggtgactggctgcacgccatagaaaagaagttggatttgcttcagtgcactgatcaggagaaggtctcatttgcatcacaccagctgcatggccctgcctctgaatggtgggatcatttccgccttaacaggactactactgaacctatcacttggcttgagttcaccgctgctttccggaagacgcatataccatcgggagtggtgtctctcaagaagaaggaattcaggtcgctcactcaagggtctcgctctgttacggagtatctgcacgagttcaatcgtctggctcgttatgctccggaagatgtgcgcactgatgaagagcgccaggagaagttcttggaaggacttaatgatgagctttcttacccactcatgactggggattatcctgatttccagaagttagtggataaggctattcgtcaggaggacaagtacaaccgcatggaacagaagaaacgtcagattgctcaattcatggcacaacaggggaatagtcagaggccgcgtcttactttaggaccccagtccatgcctcagggaggttcttcgtctgttgttcgtccgcagcgtcagttcttcaacaacaatgctggcaacaacctccgtaatcaagctccacgccctgttgcagctccaacacagcaacagcctgccaagagggagcaaggcagcaagcccgtggtgtgtttcaactgtggagacccaggacattacgctgacaagtgtccgaagccccgacgcgtgaaggttgtccctgcccagagcaactctaccgcaccagcatcaaaggcccgtgtcaaccatgttgctgctgcagaagctcaagatgctccagatgtgattttgggtacgttccttgttaacctagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcagggagtaccatttctggccaatcttatcctgttagaatccaaagaccttgatgtcatcctagggatggactggttagccagatataagggtgtgatagactgtgctaacagaaaagtaactctcaccagcaatgatggtcgagttgtaactgttcatgcattgtcttctgagtctttaaggtcaagactgaaccaaataactttggaagaaattcttgtagtccgggagtatcctgatgtgttcccagacgatttacgtggtatgccgcctaaaagggatatagagttcagaatagatttggtaccaggaacaattccgatccataagagaccttatagaatggcagccaatgaattggcaaaagtcaagaggcaagtagacgaaagaacgacagttgccattggagttatgtaaggaatttgaaagattaaatttgggaattgtcagtagaggttttgttgcggctttagaagcgaagctcactctaattgatcaagttagagaagcccaaattaatgatcctgatattctagaaatcaaaaagaatatgagaagaggaaaagctatcggtttcttggaggatgagcaaggaactgtatggttgggcgagagaatctgtgtccccgataacaaagatttaaaagatgcaattctgaaagaagctcatgatactttatattccattcaccctggtagtaccaaaatgtaccaggatctcaaggaaagattttggtgggtaagtatgaagcgtgaaatcgcagagtacgtagcagtatgtgatgtttgtcagcgagtcaaggaagaacatcagaaacctgccggtttgttgcagtctttgaagattcctgaatggaaatgggaggaaatcggtatggatttcatcactggtctacccagaacgtcatcaggccatgactctatttgggtgatagtcgatagacttaccaacgtggctcatttcatcccagtaaagacaacatattccggaagtcggttggcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtactttagacttcggtggaagttgggataagaatttaccttatgcggaattctcgtataacaacagttatcaagctagtcttcagatggctccttacgaagcactgtatattcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtaccttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttaataaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctttctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggtcgccgtcgtgtcgccgtcctcgtccgccacttcgccgtcgctgaagaccgccggagcaccgccgtcgtcgtcaagccgaagaccgtcgccgcttcttcctcgtcgccgccgccgtccgttgtttctccgccgcttctttggtcaccggtgagttcgccgcgtcgcgctctacgtcctggtgccttccgttcatgccgaagcgccgtcgttcgccggtgagtgtgcgccgtccgagctgccgagccgccgccggtggtgacgtcatcgccgacgtcatcggggccgtctgccgtgagccgccgtagacccgatcgatctcggccgtccgttttggatggattgatctcggccgttcgttcccgtgaaccgttgccatgcacctggtccaccgcaaaccctagccgctgacgcaataattcccttttccttttcaaaaataattcattattgcgtcataattcaattaaaatccatataagtgttttaatccggtttaatctttaaaaattcatacctaattcatcttagctcggatttagttggttcaagtttctaaatttttctaaaattgagatctacatgttaaaaatatccacatgtactgttcatgcttgtttatgtgctgttttggtgtttttgctcttttctgtttagattccgacgtttccggagagtccgttttcgcaggagaagaatttgaagagttccaaggccagcaaggcaagtcacacagatcccaaataaccctttgagcatgttgatcctatttaaagctactgtttctattcaactattgcatttattttcgaatgtcattgggtggaattaacctattgtttgttatagcccttttgttcttgattactttattccttgatactttgggttattataacttgactagttgggctttatatattggttcaactagatgtattagatataattgcttagccatgcttagaaacattagcacacttttgggataacttatgattcactattaattaattaatgatggcttaacgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttaattgcgggggcaccagactgagaaatggcggagataagcccacaggggtcgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcctatacaacagggtatgttgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttagatgccgcgctacaagcctgagtacctctttggtgttgagggatttgtccaggagttgcgtacgatgtcctttgccataggatttgggacagcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgctataggagaactccgcgatcgctattgtgatcagttggccgacactgagtatcgctaccatcctcgccaaccacagggaagtgatcgtggcagctaccttgagattgaaggaattgagaatgatgctaccacaaggcatttggttgagatgctgtgggctatggatgaaacccgtgcggagactgtgttagcggctcaagatcgtgaagaccggaatcgtggtaagatttgcaaactagaagacaaggtggatcgtttggagaaggaactagccgcgttgaagggagaagcaccaccgcagaaggccaggattcggcttaccgcaaggaagagagctttatttgtccctcgttatcaattggcgccaaaggtccgtgtggtggagaaggaagttaccccagccctagcagatcctccggtcgtcaacataagtgataatgaagtagaagaatccaagcgcacccattccaagatcgagtggggagccactcaagatgatgaagacgagccgaacgagccttcaatcaactccgatgctcggaagaactagaatgccatgtcaagtcgttgtcttagatcgttgtgttagtttgcttgttttaagtttggttgtgtgtgtctcgcatgtgatttacatcagtggtgggatgtaagtgcatgcgtttgtttgctttcgagtgttaggtagttggtgagtttggtggtgtgagagtcttcagtttgtaataatgaaacccacttaagatcaataaaagttaaattaattctctgtcctaagtagttttccccggtttctcttcttgtggtcctgtccatgccagatggtgctcactcgcagcaacgggaatggccctaacaacaataacaataacaacaacaatggagagaatcccacacttgcccaagtcttggctcaacaggcacagcttatgaacatgatgatgcagcaactccagaaccagcagaaccagggaaataaccatgcacctccccagaacaaagttagcaaaattttttcgtgtgaggccgcctattttctctagcaccattaatcctgttgaagctggtgattggctgcatgccatagagaagaagttggatttacttcaatgcaccgatcaggagaaggtct

SEQ ID NO: 80395 - DNA, 725 bp, Oryza sativa
ttcttagctgcttctgtcggggcactaggtcggccgtctttgtccacctcagttatgatgtgctgaccctctatcttcttcgcggcacctcgttgtccgcgtgccctcttctgtccagcagagggatgacttccactagcctcctcctcatcgttcccctcctcgttcccctccgcatccctctccacgttcccctcctcgttcaagtactggtttggatcctcgttcccctctccttcgttccagtactggctgcttccctctacgattgtatcgtatagtatctgttcctcatcgcgatcagccatctgtgcatacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaaacttatatttaatctataataatcttatattaaaattgtaataataatatatgtatgctaagtataacaatcttatattaaatcgctactaatcttatattaaaattgtaataatcatatatatatatatatatatatatatatatatatatatatatatatatatatatgctaagtctaataatcttatattaaatggctactaatctcatattaaaattgtaataatcat

SEQ ID NO: 80396 - DNA, 14064 bp, Oryza sativa
atatatatatatatatatgtatatatatatatatatatatgtatatatatatatatatatatgtatatatatatatatatatatatatatatatatatatatatatgctgatctgaatatgatgcattgagatgactgttgggtgaatatttagatgcacaaatttgttagtttgactgaaattgagtaatttgttagtttgatactatggcgatcaaaatgtgttgtttgaaatttagttcaaatggaataattgatagattggccgcagatttaatgtagttcctaggttatcaaaccatcacagaatacaaaatgcatggggaattttggtggattggtcagtgtagtccatggacggaaccaacctagacaccaaaattctccatgcattttgtattctgtcattctttgataattaaggaacttaattagatttcaggtttgaaatttagttcaaatggaagaattgatagattggccgcagatttaatgtagttccgaggttatcaaaccatcacagaatacaaaaatgcatggggaattttggtggattgggtagtgtagtccatggacggaaccgacctagacaccaaaattctccatgcattttgtattatgtcattctttgataattaaggaacttaattaggtttagggtttgaaatttagttcaaatggaagaattgatagattggccgcagatttaatgtagttcctaggttatcaaaccatcacagaatacaaaatgcatggggaattatggtggattggtcagtgtagtccatggacggaaccgacctacacaccataattctccatgcattttgtattatgtcattctttgataattaaggaacttaattaggtagtttgaaatggtcagggttggtggattgtaatattgatgtcgttgccgatctcattgattggtaacaatatttatacttgtagtacaaaattagtatctaaatttttccttctttttggatttacaataagaaaatgattccatttcgcaactaacattaattcacattcaagcgatatcaatggacaaacccacccaagagcaacccacgggtgacaagggcaaggaaactcagctagtcatggaggaagatatttgcacgcaagtagtcgtggaggaatcttcgtcgtctagctcaagtgaaccaggcagtggatcgtatcacttgccgagtgacccccatccttctccggcaaagaagagaaagggcggtagcgacaatgaagttgactctggctacgttccccccgaactggtggtacgtagcatataatatatgtttagttccaatcatattaactgcaaactatggattttaattaaagtgcaaaacagtgcatttaaaaggtattaccagcgaggcgaataacacaaaaactcaagagaacgcatatccgtccgcaataagtggccggtaagtacatttatatggatgccaaacagtactacttaattttcataaatgcttgtgtgtttccatgtaatcacctattataccttataattattttgatgttgaaagtgtcacaagcaactggtgggaacagtactatgcggatattaccgttgtgagttcctaagggttaatgggaaatattgtgccaattacaacgaggtaagtaatacacacttgttaaattagtcgctaacttgtattattgtgaatagttaatttccttaattctgtcatgatctgatgcagcttccaaaattccccaagtctgcaagagagctcaatgatacatccattcagaatattcaggcggacatgtgctacttcatccaccgtgagtgcgcacatcagcttgggctgtttttcgacaacgaaggagtcttagctctactggagaacgaatccctgtctaactggaccaggcgtataatatagctagggtttcgtaattcattcaaaatacttgtaaatgttatgtcgtcggtcgaatttaatttgtcaatgtatatatatatatatatatatatatatatatatatatatatatatatatatatatataggtgcttccgaatatttatatatatgtacattattctgcttcatatatactcaatgcgtggctctaaaatacgcgaaagagaacatactctatcgatacctcgattagttatatcaaccacgtctgactctgaaatacgcgcacgaagaaaagaaaaaatagtatatataataatgttttatttttttaaaaaaaattgcatcttcactggcgggccacgtgtcagaactaggacggtctatatcttcgctgtcgggccacgtgtccatccacagaagccttacttcatttttcctagcgtgccacgtggcctaaaatactgtgagtcgccagcaaagaattatcttcgctggcggccgacctaaggctaacgcaagtggagatacttctttgctggtggctgcgttatgtccgccgccagcaaagacatgtcttcgctggtggccgtcctaaggctaccgccagcgaatacatctctttgctttgctggcgggcattcctttcttggccgccagcgaagatgcattttggctggcggtaaataaccgctagcgaaaatcgacattttcactggcctttgctttctggcggctgcgatttccgccagcggaagcccaaaatggccccacaaaagatgattttcgtagcagtgagtgaaagtgaacttattccttctggtggcgacgggcaaagcaggcggtgattgggctgccatgtctcgtgggcctcctcatatatatgtggtcgtcggcgttacaaaccaactcttctggactgcttgcaatcacagagaacgaccaacacttaattactcttggtggttaataatcgaatatctagtagtgaggaaagtttaatctgaactagctgcaccataagaaaaatagaaggatgagatattgattaccttaggtgagagctaacaattaatctgccatctagtgtccgtgccgattcactgtagacacagggaattttccaattcaacaataaagttgatctaaggcaaatcaccagtacctacggtggagcatttgagcagatttggcatcgatcaaggtgagagagtgtgcgttgatttcaaccagcagcaagccaaaagagcgaccagctggtggctaccagccttatgttgagccctccagtcctagagttgtggcacaatgaacgtttgggtttctgacttcgtgcatgctgttcgtgcatgctgatcacggccaactcttggtttccttgcaattcctcagtgtatctctgggttaggcctcatttggctgtttgtgtttcgatgtggaacaggccccaaacccacccttccgtggaatgcagcccacgcctggatcaattcccacatccggcccaaatgtgcatttggctgttcgtgtattgctgtgtattgcggctcgatacatgccgacccacgggtgagagaataatcctcacccgaggcctggaactctctcgcgtgcacgctgcagctcgcgactcctcctgcaccgtcgccgttttttccaagccgtccaccgcctcctcgccgtcctactgcgccgccgacgccgccgccttctccgagctgtccaccacgtcctcgccgtcctcctgtgccgccggcgctgctgccttctccgagccatccactgcctcctcgccggccgccgtcgtctgtcgcctcatcgccagcgtcgccccggcagcctactcgcttgatcaaggttcaaagtcctctcctccatctcctccttcatctcatctcattttctttgcccatcttctttcatccacttgttttgctgctaggaccttcaagatctggaaagtacagccatcctgctagggtttgacgatctgcaagagaaatattggagacgaggtatgtcaatgcttggagatatgcaaagtacagccatcctgaagggaacaaaacacagtagggaatcactagctttgatcttgtattagtgcaaagagattttgagcagaaataaactacagctagtagtactcctctacacactgctaagactgtaccaccaccactgcatgatataccaatgtatagcaagcaatacacattacagtattttacactaacaccattgaatgcacaaaacagcatgctagcatagtagtatagcacttctattaaacaaagtgagtgctcagttcatacacatgcataattagctttaattatttatgaacatatatagtgttgaaactaaaaactagagtgctgaaaccttttttcttttgctaactgcagtcatcttaaatattcagtattccttctagttagaaggtatgaattcgctaattaggaagagaaaagatgaggaggatgaggagattattatgttctggttgcctgccctatatcttttaactagtaatggagggatagagaaaagagtaagcatactttaagttagtacggtgaagaaaaacccagaaatatttttgagggacatgaaaacaattgccttgttgcattccgcatggagcctaacatatttagagcaatagcgacatatcttcgagagggcaagaagtaatgtgcatgaggatgagttcctgatcccagtatgcattgctgttgtggacagcatggaagatatgtcagatgatgagaaggtcctggcttatgatgtcttcaaagatccacaaaactgggccattttcatgactgcaaaagactctacatgactcaagtggttaaggaggaagattacaattgcgtaaatctggtattgctcctttcgtgttattgcctctatgaaactgatgaatatattaattagtactacactttagtcatattaaacagttggattttgtttgttgtatcacctaaaacttcaattcagtgatgctcagcaaaactattttttggggtaaatgttgtgcagattggcagatgatacatttgtagttttcacattgtagcatcacctgagatgcaggtatactatttatgctaaaaatgatgttcattatgccttacatattattcatgctcttttgtttttttggaagtgtaaactttttatacatatattctaaaatattgttgttgctctctccgggtgagcagtactgggctctgaaagtatgatttgaatttgctgaatgaatgataacgctgatacttggagtgagcttatctattcaaatttgaagatgcatagagtgaatttgtttaaatgtattacatccgttctaaaatataagcatttctacttatttatcaagatatagcttgtaaaatgcacaattaatttcatcttgctccaacttttcttagtcccctagtgctcttgtcctaggaatttgcaagcttccttattagctctgttctctagtttctctgtgttgctagcagtcagtttgccacggcagatatgaagccaattaatcttttgccttgtactttgtttcaggtgatgcatggaaaaaaagatgcaatggaaagtaaggagatatgctgctgttggagttgtctgtcttttgcttggatgtttcatgtcaaagaaattattcgtagatgaaacacctagtagacttcaaattaaacctctatggtagacttagctatcaaagttatttattactgtcatatatgcttggatgtgtatgtctggtgtgtgctgtttctacctggaaggtttatgttgaatcaattattctagttcacctataaatatttcatggatcagtaatatgttcatccatgtgcatgcatgttaatttctctattttctatgtgaaattctactcttgtgttttttttttaatttttaaagcaggatttttagagttacagatggatatacatgttggattttctattctggtattttatttcttaggtttttcagtattttttatattaactttttacttaacaaacgagacctaaaaggtaaaaggtaaacctaactctgcccaaatctccatgcataccactagcttagctagcactacgtacttgctgtggagtcaaacctgggcatcaccggtcgaaccaccagcccaccctgtgtattgaatcatgctgtgtattgggtgggtggtgtggattcactcaatacacaggtggaactattcacacatgtataatatacacgggcagccaaacgaggccacaatacgggcatggaatacataaacggtggagaagaacactcatctgattaacggttcacatcagagatacatgtcgttccaacagctaacatcattttgatgatgtgtaaaaacattgaacctgccttatactaattaatacgtctagtgggttacacttatataaacgataagttgctgggttttttttgtccaatcaagttttttttttatgtttgaaattatggttggtccaagacacatttccggatcataggcaccaagagactgtctcatactcaagatatttgaagaaactgcatatcgttttgaacatagaaatcaggcatccataactaatcccaactgctgggtggagtacatgattattcgtaattaatcacttgctcatcatgatcctctgcgcacctttgatgatgtgcattctggtatgcacagcccaatagttggatagcacagctggtccagtgcacagcaatagaacccaccgggggtttgaacacagtgatcaggtttataataaagttctccaaagctattcttgtttttcacaccggtcgacatatctttttggatctcatttgtggtttgacctatatctgcaagaagtagtatgtttatcatgccagtgcaaatagaatgatgaaaatggtgccaaataacataaaaaggaacctattttttaaattacctcttgtttgtgcaggaatggcagagcacagcagaagaaccaagcaaaacaacatgacttcttggtgggtcggccttaaacatttccccattgcgaaagatgacttactatgctttacttttcttgctgtaactaactagttgaatgaggatgagtctgcactccaagaaccatggttcacatatatatatagaacagatatgtatggatgaatttaatgactatttactttcatatcttggagattttactctaaaagaatctggtggattgtcctgaaaatagttttaatagcacatcaaagcatgcatttatatcggatccttgtgtgatctgctattaatgccactactgatctgggagattgtcctcattaaaatataatttctatacaaacacatgcaaaaacaatttgatttcatgatattttctcaactacaatattccactctttttagtagaaacccgtggagaaggacctaacgtgaattgtacttgtacctcgggttagtttagtgctcaatttatcaaaccttgattttgttcacttcaatcaggcgtagtgcggttcttttaaacaattttcaaagtttaggcattatcaaagaatgtggcaaaaagctttccgtactcagttatcatagggaacagcttgcactaagctatagtgcaggctatggcaccctcagctccattgatttaggcacagtagaagaaatgaacttgttagcggactgatcaacacatgaatattgatggaagtagggattacaatatatagctagcctctgtcttatttatctttgtaaccgattaatagaaactgggaggagatcggcgaggcggtgggtttgggatcgcaacagcaacaccaattgtggcgtttcggacgcgctacagtggcgcatggcaatgggcagggaagcccggcagtgcccgaaaatacggacgtgactacacagctagtggtagctaccactccatctatgagagattttgtctacatatactttaaataaaattttctcttaagctactcatccgatttacaatccgattacaccattgtgttcgtaacaattaaatctttataacaagatctcacatgattatattttgatgaaaaattataaattacttttataatatatttaaattacttttaaatttcactaaattacttcttagacataaaagtaaatttaataaagcctaaaagtaatttacatgtattatataagtaacttataacaaaaagaaagtaactttaatacatgcctttttttcatcggacgtaactacacatctagtgatagctggtagtactgtctcctttcaacttgaaaaatacaatagtatgtgacaaaatattgtttttaagatctatttgcatcattgtactccactcaaaatatgtgacaaaataagattcgtattgaatatattcaaacattttattaatttaaaagtaatttattacatgttagaaagtaacttccatattatcaggaagtaactattacatcttatacatagttaattcttattagttattccatcaatgtgatttacaatccataaaaggttttatcttcttttctcattctacatgaaaaacaaaaatgaaaagaaaaaaaacaatcggtgattaaacagatttatagagagttacttctgaaccatgcaaaagttacttccaattaacattgaagttacttttaaaaattattaaactttcgtgtgttgatctgtgctgattaaatttaatttctagataaagtcatatttttatccctacgacgaatttacttctaatttcgtgacaaagttacttccgttttgttttaagttacttttataatatatgtaaattacttttagactttattgaatttacttttatatgtctaagaagtaatttagtcaaatctaaaagtaacttatatatatgataaaagtaacttacgtatataatttacaaatataaatattttttcatcataatataatcatgtaagatcttgttgtgaagatttaattgtaacgaatataatggtgtaatcaaattataaatcggataagtaatttgagagaaaactttatttgaagaggaaaaagacatacatatctattaaaaaaaggcacgcactatgttgatccttctcattgcgccattagagcgtggccacgcggatgacgtcaggatgacatgcgcgatcagacggctatgaggcgcgtcgcgtgatacgactaaagcgataagcctctcggtttagattttacgcgaaaatatctgacaacccccgcaatcacagcagcgggaaaggcattgagactggactggaactttgtaaatacagtagtagtagtagggagactcttcgtgaatatgtcggcgtattgggacaaagttggaacgtataggacatggacctccccaatgtgacatggtcatggactcacggacgaagtgaagattgatctcgatgtgcttcgtccgttcgtgctgaactgggtgggtggataagtagatggtgctgatgctgacacgatcgagctgatcactgttggcagcgtcatccgtacattcaccgacattgtcttcaagtgattgccaccaaagacgtactcgagcttggtgccaccgccggcctcgcccatatggcgccggcttcatcttcaggtggctactgttgataacatgctcgagcagggtgagctatagcctgccggactcaacatgcattttctgatgacatgtctgagctcgacattgctaccgacctctacctctattggattaatttcagattaagcataactaactgagggcagtaatgggatagactattggactaaatttcaaattaagcataactaactgagggtagtaatgggagagacgcccaatgaagctatccaatgatgtgcgactcacgaaccaattcatgcccgctatgttcgggggcattcccaatagaatcgaggcactctcatcagaattggtttgaacccctatcatatcgtgcatataaaatatggccacgtttacctggagtgttaccccgtcgctcgtaggttatgctacgtcctaacattccctaaaaccacctaatcctaagagtttgttgtaatgatgagaaggccgactccatctcgtaccacgatgatcgttagccagtacttgtggagaccaacagggcgatactaccttgagtgccaatgtgttggttgatgcacaattacacaaatccgtacctctacagcgaggcaaatgattactccacggaatagataatcaacaatccgatggcatcattctccagtgctgccaacactgtactcgaggtcgacaccaccactggcatcatgcattcaccccctaacaccatctccttggctgccgccgaggatgtgctcgagcttggcggcacaatcaagctcatttgtacttctaataacgttggcttggtggctgccgctggtgacgtgtaggagcttgtcactgctgctggcatcaatgacgctttgccgacctcgtcgttgtactcgccactgccgccgatatcacactactatagaaaagcactttggtgccggttaggaaccctctttagatgccgttagtcccaaccggcaccatggaggtggcactgatgactttggtcattggtgtcggtttcaaaaccggcatctatatgtgtaatagatgccggtttgtagttttcaaaaccggcacctttgagatatacgcgagccaaaaaaaaggctggatgcaccagctcaaatcgagccgatgcatcgagggcatccaccccgcattgccccaaaatattaatccacaacatcataaaacaacgaacacccgaatcaaccaacatcagtcacagatcaacaaacattgaagaataagaccaacgcggaaagagagaaggccaactccaccgctgctcaccttcgccatctgccagatccgccgcgggagaagccgacgccatcgccaccgctggatccgcccgcggaagtgttccttcccaccacctgccctccctccagatctggcagagggagggcaccgccgcctcctacactccctctgttgcctgagtatccgtcgctgccgtcgctcgtagatttgccagtttgccaccgctactgccgttgcccgaggatcagctgtcgcctggccaccatctgccctccctccagatctagcggagggagggcgccgcaactgggccaccggcgcttctaccggatccggcccgcaggagttgccgcctcctatgttaccgtgagtcagaagagaggatgggggggagagggagagataaacgggtgagtggataaggcggagacgggaggagagacgggatcccacgtggtgttatctcggcgctaaaagaaaaaaacggctctccgtcggctcggctcgactcgtttacacctataatatacatatagttgtcggttcttgactatgaactgacatatattccttttaccacaaagatgcgggtttttagatgggccccatgccaactactccgatggaatgggtactaaaaggtaccagattttcaataaaaaccgacatctttctctgacaccagtaataggtaccggttctttggattttggcacgtgaacggacacgtgggcgggaaaagtaatataggtaccggtttacatactccggcatctataatgcaggcatctatttgatgttacgtggtagtgtcatgcttgagtcctcacccttgctcgcgtgagtcatgaccatcatgattgccgtttaagacgtctttgtattcttgctcccgcgctgcggacggccgctggcggtgacctcgaactcgtcgctgccgccggtatcatcctcacctgctcatcaccacagtcaacatcattctcatgctgtcctaggattgccactggcagtgacgatcttcgacttgctagctgcctccatcagcatatttctcatccatcactgctgtttgcgacaacagtaccctgtcttcaccgctgctgactatatctgcatcaatgacttccgcagtgacagttcttaccattccatcatgctagaatcaccgccatactaaagtcacataacttcgtgactacatacaggcaggcttatgcatgcatgccttactgttaatcaatggacccttgcaagtcttagaatcattatactaaataactttatgcataaataaaatatttttctaagaaattttatattagaacaaataaactacttccacaaatcatggtttataagggacaaaacttatagtatatctagaattgaagctaaaaactaaaggaaccttttcttgaacaccttatatatggtgtagatgttatatatggttcacatatatatacgtagaacatagtagatgttatatatggaagagtttaacgattatttactttcatatcttgaggattttactctaacagaatctggtagattatatgctgagatatagttttaatagcacatcagagcatacatatatcttatccttatgtgatatgttattaaagccacttcggatctggcagattttcctacttaaaatataactagttatcgtgcacgtgcaaggcacgttttgacattatatacacaaaatagaacattaaatgatacttttttatgcagcactccatagaccatagtgggatgataatttgaatgatctctataaaacttgcaacgtctattcctagagtgacaatataagatgcaatgcaccatccgcctatattaacagaaattccaaagctccatatgagtgcaaagcatatttttatagagatcattaaaaaacatcgtgcacatgcaaagcacgttttccaccccttagtgccacattaaaaggccaagcatacaataacatcaaaatataaaggacatccatagtaatataaaaatttatgacataccaaaatcagtgatgtaaacaattggtgtggattaaacaaattaacaattggtatggattaaacaaattagtggtgcagatagttagaaatagacatattgttattagcttataagcatgccaatgtgaagacatgttgtatatgaacccccacagcatatatactctgatatatatactttttgttagaacacgccgaagataagtgtatcatttcattaacacaccctaactcttaaatgaaaaagaaggaaaaaaacaaacaaaacgacctccctaggacacaagggctatcgacccaaccaacacatcttggagctttgatgttccatccaagcaccaaagtgtgcagcttcaactattagagaaacttcatagtaattggttagaactgatgaaaatgattagaggtaacatttgaggtcaatttaagccatacccccatagatggcagtctatggccatgcttaacatcttcttaaacccaatatggattttttaaaaaaatatataatatgactatttccagagcaaacatatatttaagcatcgagagaatagattcacaagcaagattttattatatcgttgacatgggtacaaaaatgagaccgactatgacaaacaaaaagaacctttggttatcccaggtaaacaacctgaaatcatgaatttctataccatgaatcaaatttaatttaacaatgatataaaaatgaatggcgtgtctcgaatatagtaaacatgtagaaaggtcaatttctcatttaatatatgcaaaaccagctgcaaccaatattgaaacatcagaatgaaaaagaattctaacaaatgattagggatttttccacttaaatcatctcagtaatatccttacaggcttacatttgcagggaagctaatcatattaatagaaaatatattaatgataaatatgaagcattttagcaaacaaatgatcaggagattataaacgctccatccagtcaaagcattttaacaaacatataatcattggataaaatagaatacaaataatcagataaacaacaggagtcacatgcatgaagcatattccttctttcctctgcttcccttttttcatctcccttggaaagcaaagtaggtagctatatgaatattgaatgacatttgtttcatgtacatgtgaaaattttccaaacagatcaagaaccaaatacctagcatctagtacagcaa

SEQ ID NO: 80397 - DNA, 655 bp, Oryza sativa
ggcccacatatcattctcacccctcttcttcctcttctctccccttctccctctccatctctctcccctatcctctctctaggcgcgacggagaggcagtggcgcacggcggccggcgggagaggagggagcggcacggcggcggaggcatggctccggcggctgtgggcggaagaggaaggggatgtggagcttcttttctctctctcggtctctcccctctccacgccattgatctctccctctcctacttaccgcagccatggcggaggacgccccagcaacgtcgctgccgccgccgccgaggggagccagcacgcgtcggctgtcgcggagggaggctccgccgccgctcccgcggcactagccaccaaggccgcggaggcgctgctcccgtcgctcagcatctggccgctgtcgcagacattgatttgattccaagatttttttttttgagcaagggtcaagacccccatttcttttactagaaatgatcataccagtacaggttcagccaaaagcggcaagcgatttgattcgaagatagtatcagcttagctagcagtggctagctagccatgagtagtagtggcaaggagaagaagcagatggaccggttcatcgtgatccccttctcctccacctgccaaatgct

SEQ ID NO: 80398 - DNA, 13832 bp, Oryza sativa
gcatgcctgcagtcgactctggaggatccccctttaatttttgtagtatgaatgataaactaaaagtccctagatggctgaaggttgaagaaactgtataattgagcccctctaaattttttttcctggatccgcccctgctccccaaatgtatatagcgtcacaaactgcattatacatcctcccctaatgacataaaactttagatccaacttaatcaaccaaagtgaacgcacaacatgagacagatgacaaggatctaggagtactagcttagaaaatggaaataaactgttgcccacaatctgagccgtaaacatcacattgcctgatttttaggagctgaagccacagctgcaacggcaacctcaggattcatctccccatcacctgacgattgctgcatcgccgggataccttgtcgagtcagcggagtacagagtggcgttgctgcacgagagaagaatcctctggagaagactaacgaggccgtcgtcgagaagaaatcgccggagttggcagttgcctcctcccatcgtcgccacgacagcatcacccaccaccaccagtggaagatggaaaaaaaaaaaagtaaaaacctgacccccaccgtcgaacaagggtggaaaaaaacagatccaacccgaaaatagctttcgggcccgatgaaagaagcgctaatcttgaagagattggacggctggaaattcgagtgcgagttagagaaaaaacacgccggtgatgtatagcaaataccaataattaatatgtattacctagaaactcaaaacagtaagaagaatttaggccgtgtttagtttcccctgttcccaacttttcattacatcatatcacataaaaactttcctacacacgtaaacttttaactttttttccaattaaactctcaactttctttaaacttttaacttttttcaggaacttagcacaccgttatatacaaattcatgatagtaagaaattttatgtagctatctgcattatagtttgtcaggtcaaggactacgaccaagtagttcaccggataaattagtagcaaaatgtaatggtcgctatattagagccgatagcgtaagttgtaaatgatgtagtagtaaacgctttttattcactgtgaatggtacatcaaacttacacacagttgtacagggctattatgacttccttattttttattttttagggagcactcctcttctaaatctaaagtactacctccatttcaggttataagatttttgattttagttaaagtcaaactgtttcaagtttgactaagtttatagacaaatatagtaatatttataatactaaattagtttcatcaaatcaataattcaatatattttcttaataaatttgtcttaggttgaaaatgttattatttttttctacaaacttagttaaacttaaaccagtttgactttgacgtctcataacctaaaacataaaacggaaagagttgtcgctacttcaaacttcttgtgatcgtgcaatttctcgatatacgcctccttctccgtaggttccttgtccttgagctcctcacaatcttcatgcatcttcacagtatgttgccgatggtaaacctttgttgggtccacatagccaactggttttctcaacctttcagcgtcgtggaagtgtgacttacagacaacagctagcttgtgttctagttacttttgctttattgtataaaaatataataaatactttattgattgattaagatgtatctttttagttgtcttttcataaatatatttatatgtatacagtagatattaaaaatatgtacactacaaatgtaataatattattttaacttattataatgtcagaaggagaggagtattttttggaacattaccaagacttaggttcatttagttttttcatcgtatatccagtttaattattattaagttatatacggtgataaaatctattcattattttttctcataattttataattttttgaatcggacacaaaggtcggaaaatataaccaaaagttacatatatttttaaaagttgaattatagtgaatgtggacccttaaatgtaaaattatataaagaatgcggtgcgtatgtagacatggaggtcttttgattaaaataacattatttatataatttagatgtcatagctgcttaacttttttgcacaaaatttgatttctaactaatatattttgggaacattacttctgtgttctttgctaaacggtatgtttttttaaaaaaaaaaatctatacgaaagttcctttaaaaatcatattaatccattttttaagaaaatagctaatattaaattaatcatgcgctaatgagttgttttgttttgtgtgctcaagagattaggtcctgaacatacgctcaatgaggaagcccggttttcatggaagtggcggagaggcgattgctaaggtttcggctaaaacctaattggatctacgtgattcgatcatgatctctcctgtttctctatgggagtctcatcaagatctaatctttagtctctctttcaccgctacgtttagtcgggagcagatttctgtctgttttgactcggctttgaccctgtaggacttggtccgtctgctatttttctagggtttgtgcttccgtcgaaaccctagtatggctttgatctgcttcgtttgcctcgcctgttgttttctcttcctaggagttctggtggtctttggtgggggcgatcaaggggatttcggtaaattatgatatgtatgcatgaagagattgctcttgctggagttggttggagttggtgagaggtgatgttttcttttgaaccgaatgaccaccggctaacacgtgctggcattggaattttttgcgcttgtctaaccagttggggaattgaattttcagatgatatcactgaattgcttgctgcatcaatagatcaatttatgctagtccgcctgcacagaacattgagcggatttagacacaggagcctcagaatcgaaggcaaccaatcaatgctacaggattgttgaagagagcataatagtccatcataaaatcacatgataatgaataatgacttaagatcgttagtttaacgactctgcctattgcaatttgccataatagattaatccttaatctgattaatgaatcaatcgtaccagcatatgtcgacattggcgagtggcctggaatacaatgaactcatcgggagtgaaagggaggttatcgagaacacgaatctggctcgtagttagtgacgatggcgcccgcctggaccagcctctcgtcgtgcttcagcacagcacagagtagggttttttttcattatgtctacgctgttatgattcggtaccacacagtgacacagggtttttctttctttttttctagtacacaggcttttaattacatgtttcaatgggcttttagttgcacgtttattaatgggtttttaattgcacgctaattgtacggttaagatagaatgatcaatctaatcaatagtcagatctttctgattaacatggaagctcgtagaaagtgcctaattagtataggtatagatagataatattgcggtttgaggatataattcgaattcaacatcaaaattagttaaaaaagtgaactttttccttgtttgaatgggaaaatggaaggtgggacagaaagaggagaggacgtgcgtgggctgggaatgtggctggtgagtgcaggcatgcccacgtgtgagaaatacaaccacacacaccaataatagagtatcggctaaatattttcttagagatctactgcaacttgaactatttgtgcacgatataagagtttatgaaatatatcgctaggttttttcatccaatcatgtttttttatggttcgtcactccgaaacacatcgatgtcctaaacataagcaccaagagactgtcatctcatactcctagatattattagacagtacatatcggatggaacacatatcaggtattcataattaatcttaagtgatggatggaatacaagatattacggatatatcacttgctcattataatcttctgtgaacctttgctatgcatttcgctgctcacccgcggttcattatgatcctctgcgcacctttgatggtgtgcaggctggtatacatagctcaagggttggatagcacagctggtccagttcacagcaatagaacccaccgcgggttcgaacacaatgatcaggtttataataaagttctccaaagctgatcttgttttttactccgatcagcatatcccttcttatcttgtatgtggtttgacctatagatacaagaaatcatatgtttatcatgccagtgcaaagaaaatcatgaaaatgacacacaaaatacataaaaaccaatctaattttcgatattacctgttatttgtgcaggaatagcagagcacattagaagaaccaagcaaaacaacatgactccttggtgggtgtgtgtcctgcattttgccatttgcgaaagactagttactacgacttacttttcttactgtgactaattagttgaatgatgatgagtttgcacttcaggagctgcggttcacatatatatacatagaacatagaagatgttatatatgaaagaatttaataattatttactttcatatcttgaggattttactctaacagaatctggaagattatgctgagatatagttttaattgcacgtcagagcatgcacgtatatcttatccttaggtgatgtgttattaaagccacttcggatgtggcagattttcctaattaaaatatactttctatagcacagctaaatattttaagtgtcctatgctacttaaattgtactttcaatgcacagctaagaatagcaagtgtattatcccaacatctattatgatgtcaatttcatcgcacttccaaacatggattttcgaaacatttgatgctaaatcgcttagttccatggcattctttcttaaatatacttcattcgaaatattggtttgaaccctttctttctctcatttttgtcaatttaatttcatgatattttctcaacaataacatgccacttgctctctttagttgaaacccatggagaaggaggtgattgtacaccgtgttagttttgtgttcagccggggtttatgcaaatggacacatcaatgctttgttctttgtctagctagatgttgaggtacatttgtgatatgtttgccaactaatatcagttttgaaatcttttggtctctccttctgtcgcaacttgatattggcgaagaaacattagaaaaaaaatatttatatagggaaatattgatctaaccatattaaacattgatcaaacctttagattgttcgcttcaatcggtcatagagcaattttttaaattttaaagtttagtattaatgtattatcaatgaatgtgacaaaaagatttgggtatattgttctcatagagaatagcttgcactaaacagttattagtgtaggcggttccttgcgacaaccacttcattaaactactgagagaattggttctatgccaccgagtttactgtagttcaaggatttgcccttaacacaattgcgtttatctattttttctacaatatgctagttgggcagatactttaaaaaaaatacccaaaatgccattcaagacttacaagaggttacaattaaagttacgaaaaaaattaaattattttacgtagcctccttacataatatagaagtatgtttatatttcaagatttttattttgcatgtgttaacttttaaagaaaatataaattatgttttataggctaatataatgctcttgtgttaatgttcttctatatacatcattattgatatgctatacaatttagttgttgtccttggaagaatcctgttcttaaattatacacacatgttctctgtggatacgataccctagaatactcttaggtaaagactataatggtatctgtatacttgcagattattctatggtcgtaataaataccaacaacactatgtaataaataccaacaacactacgcctggagcgagggggtcgtcgtggatgaggatgaaccatgcgtgctttgttatcgcaccaccgccagagcgcatggataaacagtgagttaacactttcccgacccatacctcaatgaccatagttttgctgctcgccgccctcacatgcgctagccggctgctgcccggtgagcactcattgccttccactctgtccccctcattgacacctttcattgatgccgcagccgccatggtacagtgacgccgccactgtgctcttggccaacaccgcagcactgcatgcatgctcactagtggacaggctgctatgccctacagtgataatgatcgcgaccgcccaatcatcacaatccgaccattccatggcaagccaccactccggcacctttctcacccactctaggaacaattgcctggcccaaattagaacaggaccaccgacacactagagtgcgcgcgcacgcgcgcgcgcagacgggagaagagaagaaaaggagaaagagagaagagagagaatgacagccaggcccacccctaaaagcttttgttaaaaactaggggaatttgcaaaaaacatcccatacggcacttgaagtttgatattccactctataagtcattttgatgcaaatgcttacccacacacttagttttgttgaaccatcccgtacgcatatgcttaaccacatcaagatgttttcataaattatgagatgtcaatgcaatctttaccagaattaaatatttatatagtatagtcttgacacgtttttggagattcgacaaacagaaatattgatgagagcttaaatgtcatcgcactgagtatggctatatccacaaaagaagttcaatgaaacatgatgaaaaaaaaatctaatacaagcacttggacaagattgactcgggtagcttagcccgtggtagattcggttaggctggcaaaaagttaggatttaaagcattgtcacatctatgtgatttgttatatagaagatccctcaatgcattctctaatgcctcaaaattatctaatcctcttgttataaccattaacacttctggatcagttcagcatggtgcagcatgtgtcatcattaattgtcaaacaccaaccatattgtctggtttgtttgccactgttagggaagcaacatccagtatatattggttgtgccattattgattcacaatagaaatcacctccatggaaataattgcgatgtgcccatttggaattaacaatctcgtatattgaacaacataaatataaacagttagtacaatgagtaacaataacattctctgtctctattttatgaaaaggtacagagaacacacacattgtgatgttgtgatgtctaaccttactgaacaccaacacgtgaacgttagatatgataaaaatttgtaatcttggattgaagatgcagtagacagacgggagaatgctgaccactattcaaagaaccaattcttcatctgtaattattgtcactggatgcacctttctcatttgtttcgtcatgaatcctaccatcgacaaggatatttggaagaaaaacactttgcagcaaattaacaaggtcaatgcaagctgtgttttggatggcaattcattaatcaactcaagtatagcacaaaatagaaagctttatgtttgatgaaattatgaaagggtatatagcctagtggttgcagtaatctgagtagcactgaatgtcctaatgtcaaatcttcataggagcgaatttttgggttatttaagggctaagttccctatttgataggctaagttcctaatttcaaaaggctgcatatatcctaatttaaaatatttgacaaaactaatgaaaattccaaataatgagtataataattgttcgggctgaaccaatacactttcaatctgcaaactacaattcgcaaaccgacaaacgtatttcacacaatcaacccctcatctttccatgaactttgaggatagttttaactagcaaatcagcagcgaaacaacaataaacacatgcacacaagacacggtgatttacgtgaaaaaacctcctcggtgtgaggagtaaaaaaccatggaaccaacggtccactccaagcttccacaataatcaacaatgggtacaaatggagtcttctctagaacatgtagaggtacatcacaacagcagctacaacatcaagttacacacttggtatcatcaacatcaaccatcaattagctacaacatcaagttacacacaagaggtatatcaacaaacaagcaaagaaatggcagattctatcctcttgattagaaccacatatgcaaattgcacgaaacttggcaaaaatgatagtctatgagtcccttcctatatttccaaaaaacagcccaatcagacaccatttgaccccacaaactgacactttactaactgctgcacaatctataatttcaataactcgagctgaaaaactaccactcaaatctagtgctctacttaaccaatcctcatccatactgaccagattgaagtgctcaaagtgaggaacaaactcaccaagtttggtgccaatccaaccacgtttgagcctccaaacgctggcttgatgaagatcgggtaagagcccccactactacagaacccctaaatggtgctggttgggaaaccctcttaggtgcggcacagatcacataagcctaaaggtgccggtttcaaaaccggcacatttgaggtgcatatgagccaaaaaaaaatcggctcgttgcatcgaactgttgagccgatccctagaatacccaaaaatactccaaatccatgaacacatctagatcaaacaaatcacaaatcaacacatcaacaaatatcaacaaatcatcacatcaacaaatatgaacaaatcatcacatcaaaatatcaacaaatcaaaaatcaaaaatcagccgctgatgacgatgccgctgccgcagatgggaggatgatctcgggccgctgctgtcctttctcccgccggatttggcggaggaagagcgcctccggaggctgctgcttctcccgccaaacgccgccgctgccccacgccgctacagcggaagggactgcgctgtcgggccgccgccctccttcctcccaccggatctagtggaggggatggcgctgtccggccacacgccgacgacgccgacgccggcaccgacgcacgctgctaacgacgccgacaccgatgcctccgctcctcccaccgctcttcctgccgccaggagaggagaagagaaaggaagagaagagaagaggaggtgtgcggtggagaagagaaaggaagagagaccgagagagagagagagacacgtgagaaagattcggtctcccttatccgcttgatgagaccggggcactctcccttatccgctcctcaggcggctcggctcacggctcgatctgaaaggtgccgttttttttaaaaaaaatgacatctttaagtaaataaccgacacctataataaattaaaggtgtcggtttttttatagaaccgacacgtataatagcttaaaggtgtcagttttctgtgttttcggaccgcggaggtgggaaaagacttataggtgccggttttagcaaaaccggcatctatagtgccgacactatagatgctaacacctatttgatgttttgtagtagtgccccaagctgaacaagctgcacttcttcttctccactctcctctccctctcttgtgtttgttggttgtttcttcacctcaaaggctgctctgctcactctccctccaatggaaactagggtttttcttcccaccataaaggatgaggcaatctcaaccgttgatcaaggcatgaatcagtggctcacaattgttggacattttgggctgtaaatgggctgagaacaaaatgtccatatggagggaatttagcccaagaataattatgtggactttattgagctttagctttactgctcgaacctggtggtatcatccataattttattcctgccgaagataaactgtttaagtatgataataaaatttcagtagtatttgaaaaaatccacatgtcaggccaagttcaagtattcaagctaattcactccaataacttgtctggaatactcaacttcaaagaaatgctaaccagtcaattcttcaagtgtgtgtgctactggtgccagtgccggcgccttgccctccgcgtgaacgctgtgtcatactatcattgccagcctcacctctggcgttagggctcccattgtgtagtctagcacattcctccaatcacagttcaccacccaccagcgcaaatcgaatcactgatttgggatctagggttagggattgacattgggcacaaatttaatcattcgaataaatgcaaaatcgaatcagtgattagggatctgaggtcttgagtataccatacctttgagttgcagagcggaaagcctcacattgtaagcataccatcctcgtcgtcagccttgtccacctccttcccagctccgatccccggtgatgtgtgcccctaccgtatctggccttgctagcatgtggtgaccggatcgcacaggaggggattctggtggggaataagtttactttgactcccttaactagtgaccgaatctgattcgtatccctgaaccacaataccggataattaaccgctaaactattaatttaaaaccaattgaatttgactccctcggtggttttggaaggcggtttcaccgacgtggcgcctacatggcggtgttgactcggtctttattacacgtggacctgacgtggcgtttaggtgcactagaattaaaaatagtatgtgcgggacacatttgtcatttacacaaaaaaaattgtgagacccactaacatttgggggccaaatgtcatcccctttccctccttcttcctcttttctctctctcccttatatctctctctccccatttctctccagtcttcacgggagggccggattatcgacggcggtggcagatgggggctggagcggcagctgatggcgcctcctccaacccatctcgccggctatgcggtactctccttcgacaaacaacgtgttcacgctcgtcgccaccaaatcatcatagagaatgccgcctcctcagatggcgcatgccgagtaggagccggggcgggggaagcgacggcgtgtcgtcgaccgtgaggtggctgcagcaggatgaggaggaggtggagggcgagaaggggagtggaagggagggaacggagaaggagccctcctccaagccgaacgcaagacgtgccctgtcgccctcactcagacaccccgccgctagggaggagcccatcggcactcggcaccaccattggggaggagcctgccaccaccggcactgatggggatggaggaggcgccggtcgctgcccctgtcgttgctcctccgatctggcccctctactatgaagaccgaagagaaacggggagagagagggaggaagaaggaaaggggatgacatgtgggccccaaataaatgccacgttagctccacgtataacaaagaccaagtcaacatcgccacatcagcgaaaccatcctccaaaaccgctaagggagtcaaatttaactagttttaatagtttgggtgttgaaatatctggtattgttatgggatgtgaatcatattcggtcactagttaagggagtcactactagaaaatcaatttttcatggcgtttggaaaatatttttcatggcggccacgtggaaaaaccgcaagcgcagaaaattgtgggggtggggggtcaagggccgccagtggaaacacatcttcgctagcggtctacttaagaaggccgccagagaagatataggatatcttctctggcggctctcttaagctcacgccagtgaaggtattgtatcttcgctggcggtaaggggatgtggcccgccagcgaagatgtaggtgtcttcgctggcgggcctcttaacttaacgccagcgaagataccatatcttcgctggcggtgtgatgacggggaccaacagcgaaaatacctgcatcttctctggcggcatccttaacctctgcaccatctcaaataattttcaatggcagttcgaatgaaccgacatatgacgaccgccagggaaaatgcgctgaactatatgaaccagctacagtaacctcgagcaccattaggagcacgattttctctctcttaagaacacatacatagggggaaggttttgatctcgaatcttttgaaagatttattgtaccagacttactctttttgtcaactttttttttcatttttattggttgtatgttgagatttttcatcgcaaaaaatacatgacatggaggaagaaaaacattttttatttgttatttggagctcaaaatggcaaactttgcaagaaatattgtgcatgatcgatgttccatatatatatctagtttttgtcacgtcctgatttttcgctttctgttcatctcgcctatttgcgaaaattcacattttgtttattcgtctaaaatagcttaatgaaaaattcattaaatcaaaaggttttaaagtgattaattagttaattacgttgttcgctttgtgattgttaattggagttagttggatttaatttgtatttcgaaagtggagctcaatccctaattcaaattccatccaaatccaatattccttttcaaatcctaaatccttcccaaaaattccaaatactttatatttggaattttccagagaagaccctgtctttttccctttttccttcctctctttttctctattctgcccttttgcagtttagcccttattcttctttcttttttctttttcccccaccttcttctacctccagctctctctctccttcttgagctgcaggcccggggaggccaagccccgagcccacgtgccgccctcggcccggcctcctcctcctctctgcgtcgccggcccaagccgccgccgaccgagcccacgccggccacgccacaagcccaatcgggcgccccaaatcccgcaagccgcgccgccaaattcggagccgccgcctttccaaagtttgcgccgtgcgccctaaccctagctactccctcctctataaatagcactggccaccacccctttttccccctttttccaaagccgccgccatctccaccgtgagcagccgccgccgccgttgctccgtgccgccgccgggagccacgccgtcgtcgtcaccatctccttccggtgccgccgccgctggtaaagccccgaggctgagccctctctccctttcgcgccgccgtttctctctccacctcaacttcggcgtccgcctctcgtcgccgtgcgccatctccacgccgtcccggagctcggtgctgtgccaccgcgttggcctcgacctcctctgcctccgccgctgttttccgtagccgccgtgcaccttcgccgacgaacgccgccgacgccgccgcgctggagccgccatggcgccatggccagagcacgcccaggcctgtggtggagcagctactcctcctcttccctgtgacactgacgtgtgggacctgccatccaaaaactcaaaataatcacagccgtccaaatccctagatcaaatcccaaccgttggatctacataatccctaacatatgccaccttagccctagatccaaccatgtcagtaccaccgcatcgccttgtgtcgccacgtgtcattccacg

SEQ ID NO: 80399 - DNA, 6773 bp, Oryza sativa
ttctagaacagtggatcccccgtcccacgaatttattattttccggatcgaattgccacgtatgcgccacgtcaatgccacatcatatgaagaccaagtcaaatttgccaagtatgcgccacgtcagccaaaaccgccctcaaaactgccgagggacctcatcttcactggttttgatagttgagggacccgttgtatctggttttctggttgaaggacgaaaatcggattcgttggcaagttaagggacctcagatgaacttatttctttttctgcaaacaaatcacatatgctcaagctgggccctgggatgcttcgtagaaaaatgtattgggccttgggccattgcctttgtaggagggtggctttgggagtttggactatacgtgcgccgcgtcgttaccgggctcgccgtcgccgacactcccaccaacaacaccaaagtccaaagacacccgcttccctccaaccacccgccgcaaccggtcagacgcaagcaacgcaacgccacgcacgcacccgcctcaccctcatgcgccggcacgcgtaccgccacgcccacaccgagatatagcagaaagccgcaccccgcaccctgcgccctcaccgcacgcacgcacgcaaaagccttcgaccctgccgtgcgcctgtgccgtgcactcatcagctggcgaggaaatagaaaagagtatatgaaaaaccaccgtatgtttttttaagcgaaaaagtttttaacgttaagtataattaaaatgtaattatattgtacaactatcttgtagctataatgtaattacgatataacttatgtaaaatttgtattcaacctttatttagttggttagcaacgagattttatacgtgatatgtatgaaaatttctttttaactattttttatgcataaatctcgaggtaatccgatgactgtaaatttgaaagttctgcgggtagcaattctgaaaaaaggacagacagtgtggcacacaccaacaaaacggtgctaggtacgggggaaaaaagtttttaaaaaccaccaccgcggaggcaaaaacaagacggtggcgagcatggcacatggccgcgcgcaggcaagcgcacagccgcgccgcgtggccgcgagtgcggtgaacagggccgcgcaatcacgcagtgccaccgtctgtggccgtctgtctatctctctctctccagctcctccacgggcccccacccgcgcgcgcgcggccactgtgccgcacttcacccccccgggcccgtctcccctattcggcccatgagacggcgccatgcctccccctgccctggccgccgggccagtccaactcatgatcacggggagtcaggcggtgggcccccacgttcgctcggaccacagaagccggtcccctgtaccacactgtgggttctccggttcgcaactatatcgtctttattggggattccgtggtaccggcggtccagaccggttcgtcatcatggaacgagttttggctgggctagctacctgtataggcttggacagctgagctggtgctgattggaagcttcctttcaaaggcaaaagtacaaaatcgtttcttactcgaaagggattaaaccgttttcgttgtaattaccgttttcaaaagctgcaatgcagttgtgtgtaaaacaaggttaatctcgagctcagtaataggaaatgcctcgactagtttcctaccaacgccgttcgaaaaaaaaagagagactaatttcctaccaaccagaccctattaagcaactactacgagcatttcaagttacgacatgtgactttgtggaattgaaaattcaaattcgtacacgaagaacacattgttgactgttgacttggaatagttttagttggaaatagcacatactggattacatatatacatactgacatgccgggtaagcatgttccaatgcttgacaagcacagattcgaaggccaaaaaccacatgtgtggcatcattttcattgcctacgattaggtcgcgttgggacctcacatacagtttgtttcttccgccttgatctcggatttaggccgctaagcttgttgcttagtgagaatgcaaaagcacacggctccagtcgatgacaatttaattgacacgggttttgcatcactaaacatgtcctttgcagagcagtttaagcaagacaaaatcacacagcttccatccgtcggtgccagtgccaagacaggcattgactctgcactcttttgtgcagggaccatggagaaaaaagaagtaaccatttcctcaattctcagtgcagagctttccttggtgtccctgtttctcctcctcatccgacctttcggctggatgtataaagcattgctgaaagctactaatgcttcaggagcagagcagctctctctatcgtcttgttcctacgcgtcatagtattgaatctatttctcttgtattgtcgccataatccattaattgtagttagtacgatatctattcttctctattacaaaagaccacacgcaaaatttatactccaaaagaacctttcaccaatttcacagaaaaacttgtggtgcttacacaagtactaataaagctgtttgggtgtcgagaaattcaacaaagtaggctgctttttacacccatctttcctactgttgttacgctagcttgttctccctttcactctctcttcagtatcctgtcgattctttgtgatggctacagttcgattcgtatcggcgctagcaacaaaattgcggcactggcacacatcgatcgatacggacgatggaaacggagacgcggctgttgtgtaatggcatcttaacaaaggacggcgaaggaaacacggaaacatttaggtccatataaatgccttgtttatatcagctgatgagaggaggaggatgacagcttgaaaagaaaactgtgtgttctagaagcaagcaagggtaggagtacataattgtgatttatgaaaggccctacgggaaatttaaagctgcagacatgtgctcagggaattaaacctgttagttctctgatactaaagagcttaacaagtactaaaattactaattgtctagtggccattggaacgacattgccctgcatgtgcagcatccttagagttcaagccgtttaatccgctaagattctactgaatcataccagtaatcatgtccgccattgttgcggctttgcaagtaggcctacttaattggaaggcctgatgagagacacaaacagttggctattttgcttacacgaaatctgttgtcaaaatgttagtagtagtaagctcccagctaaaggcaaatgccattcttcaggtcgccttcacaaataaccaactatcccacgtacaagcatcaccggccttattttattgtttctcccagtgagatgtttggcacaagaatgaaagaattgatgctggtactaccaaactaagaaagtagttgagattgtgaccattatcttagcttcagcctgttcaagtgttcatacgatggataagtgattgattaactactaatttaattatcactgtgggttatgcaggactgatgctaaaatgctaaataatggctctcccaagacgaaatggaaaagaaaagaaaagaaaagaagagagatacggcgaattccatttcaccagctgtaccccacctttgccgctcgcttccacgtgggccctaccttttgacccccccacgtcagcggcgcagccagatcattccaaaagcggaccacatccccacgaaaccccaccgcgaccgacccccccggaaaatatactaattacaaacaggtccctcgtgggctcgtgggtatatataaggctctttcagttggctccctcgtcgtctccgttaccacgcgcacactgccactgcgagtgccgttcccctcctcctcctcctctctcccatggcggaatcctcgagccgccccacgaaaccctaaatggcgagccggcggcgccgccacgcccctgtgccgtagcctcgccgcagcgagctggtcggaaggtaatccccgcttcgcctcccatccccccgcggaaccggcggatcttacctcatttggcatcttctctggatccactgctgatctgttcctccaccgtcccaaccgcctcacagatttctctcaatccgtgtagaacacagcgtcacctctcgatccgccaagtggtgggggagtaggaagcgtgtcttctccgggaggcgcgcgccatggggagcgatctgaaggagatgaagtacaggcggaggattgggctcgacgagcgggcgcaatgcagcgagcagagggcgctcgactggcacgcgctgaagcaggacccagtggagttgctccgcaagctggacgagctgagggagcagatcacgaggacctgccagatcgtcgagccgccgcgggagcaccgtcgggcgggccgacgagcgctctcgctgctccctgagaaccctgagccgccaccaatgccagggtatcaccgctcacgctatggtggtgggcggtatgggcacggcttgccgccgagcccctacgagccgctgcgccctgagattggggagaggtactccagacagtcaagtgggcggtatcggcagtatcaagggaggcaatgggatggctgtggagttggacatgggaattacaatccttcttatacatgttcctgtccgcattgtctacatggacagagaactgcaccacaagaagagcacattccaatggcgagatactttgctgggcagcatgagtgctaccggtttgaaaggtcgccatctgtctcatcggactatgaccggaggtccgtagcatcatcattgtactcgcatcggtcggtttcaaagaagagagcagagtatttccggaagaaggcagagcatctttgccgtcctgtttatggcgccgccccttttgttgtgtgcagttcttgttatcagctgttgcaggttccaatggaaaagtgtatggggaggaatcggctgcagtgtgggtcttgctctcagattgtcagtttgaagcgtgaggagaaagttatccccttctcaccatcagcatccttttgtgtgcccaaaattgagcaaggttcaaatgatcaaactaggcgagattttgagcaccagctcaatgagtttgccaattctgccttttataatttgaatgagcatagcagcatgcaaatcaacatagactttggtgatgatcattcagtttcttcttccattagtcatgacaggactgagaaaggatgtggatcaagcaggagcattcagttaaaaacagatgggctcttgttgtctccaagcagatctggagatattgagagcccgaaggatatattatgcgaaagagatgctgaatgtcaggtagaaccttcagatgctcgagtcagcccatgttccccagttttagaggacaaacttgttgatccattgtgcagccaggaaaaggataataatagtgaggacctaggcatggctaatatatctgatgtaaattgcaaaggagaacacaaagttaatgatgatgatgatgggagtcttagtatgggaagtgaacagaagagaaaggaatgcgatgaagattcccttgtagatgaaagcatgtgcaaaacccatgaacagaagagcaaggacgatcactctagccctgaagatgttagcaaaactcatgaatttgatagtacaaaagataatattagcagtgctgtagatggaaatgaaaagcatgagtttgaaagcaaaaaagatgataccaatagtcttgaaggtgaaagtttgaacaaggaacatgagcaaaagagcaaagaagacgaaaatagtggccttgaaggtgagaatgttaagaaggggtttgacaaaaacaacaaagaaagtgaaaatagtgcccttgaagatgccaatgccccccttgaagatactagaaatgcctctgatgcggcaagcttaagcgagatatctgaagaaaagaaaacagaggaagaaaatggaagtttggaccagccttttgttgaagatggcaatgcctttgcagagagtgggggatcatcatttaatgagcgtacaaattctggtttttcccgtggttcttctgagactgcattagaagaagatcagccctcaactggaaagagtggggattcgtcattttttgctggtttcctgaagaagggtttcaaggacctttctttatttaatcagtccatggacagcgttaaggtttcaattaatggccatcctatctctgaaagagctcttaagaaggcagagaaaaaagctggtcctgttgagcctggctcgtattggtgagtgattgctatagtaacaaattgtttggcagtttgctgtatttgttttagtttcactgaatggattggcttgtcttggtcataaaactataaaagttaattttgatagagccactcatctgcagcataccacaatcacttatctaaattactagtttactacaagaaaacctacattattgatgaaaatactgttgagcttcttaactttgaacttacattagtagaactgtttttcccgtagccgcgcaatagacttttataactgcaacattttgaaaattattgtgaatttttcacccaatttggggctttgttttggcaattgataagtattacttcctccgtttcatattataagactttctagcattgcccacaatccacattcatatatatgttgatgagtctagacatatatgtgtgcctagattcattaacatcaatat

SEQ ID NO: 80400 - DNA, 612 bp, Oryza sativa
tccgaaactacacgcgaaacgggacaactcaacaaacggcgaaaataaggccctattaatgacctctcagcgtgccattagatagatctcgagattcgaggaattttggaagttgaacagagtcaaacggacttacggttgggaagatattgaatttctaagattattagatttttggtctaaaggaaaaaggatttaattaaacccttttggaaaagaaaaggaagatggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtcccgggtgggacccgcttgccagcggctcggctcaccgtgccgagggagcacgtggcgcggcgctagggtgtggagcggggcgcggtgcatgcgcgtggttcgcggtggacgcggatgcggcgggcccacgcgcagcctcacggctcgcggtggaccgcgcccgcgagcggggccggaggaagcggctgaccggggtcggctcgaacccggtcttggccga

SEQ ID NO: 80401 - DNA, 646 bp, Oryza sativa
agtgaacgtggagggggttatataagaacaggaatgagaattatggtcagatcagagcaggaattgcagagaacatgccggcgatatctcagtcagcagtgcaagctaggctcacatgcatgcaaggaaaatgtaagccgaaccctggagatggaattgcgcgttcaatcaggtgattgatacgctgtaaacctgcaagctgggcatcatcatcagcacggcttagcattttctcctgataatcatgacctggaaaataatacatttcatgcatgtaccttgcatgttcagtaatccgtacttgccggcataaaatggatctacttagatattagtctgataatctatggacaaaaatataatttggaatgaactgtgcatgcatgccatggctatcagcatctatgtggaatttgcaaattcttggtaggaaagaaactctgagccacatgaggccatgagggggccagcactgtcagcacatggaagatagctaggaggtggataaacaactgatcagattgattattaactcagcgcctacttagatgtctaatcatttggaaaaagctgactaaaagagtcagcagatttaattagccaccggtaccgcgcgcggtacggcgttgaaattgattacattttt

SEQ ID NO: 80402 - DNA, 619 bp, Oryza sativa
cacacattcatatagatctcgtttttcttcctaccaagtagcagagaaacttctctttcttttttttctttctttcctttttcttttctctccaataaacatgcgtgcatgcaccgatattcaactcattcgccttttccttctcttcccatcgtccttgcttcatttgccgaccaccctccatcgatttagattaattaggcctctccttccctaataatttgggcctttcattcattcattcattcattcagacgtacgtgggggcatctgcccattccttccttctttcactcgcttaatactgctctacgtaaacaccacttaaaacggaaaatgatcgatcgaattagataattcccttttgtattactccctccgtcccattataagtgcaaccataagttttcgcgtccaactttgatcgttcgtcttatttgaaacttttttataattagtattttcgttgttatgagatgataaaacatgaatagtactttactcgtgacttatgtttttaatttttttaaaaaaaattgaaataagatggacggtcaaagttggatttataatgtgacggaggtagtagctaagtggtccttggtttttctccatcgaa

SEQ ID NO: 80403 - DNA, 6096 bp, Oryza sativa
  unsure (1)..(6096): unsure at all n locations
tcacctaaccacatttattgcggtttggctgagcgtgtcacgccgcatgtaacgcagtgcagtgcactagtttatccggtcagtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattgcaggcaagatgctgtgtgaagaagggcgaacatgtagattgctaagctgacacgtggtggacaagaatgaccgacgtgactggtctgacaccggtcatgtcgtcagcagacagccacgattccacatcgcacctgctcccggcgaaagtggaggtagttgtggcccgtctcatcagaaggtgactcggacggcaactatacaaatctccgtccatttatgaaaaggtggggtaagtccccacaaaaaaaagagagaaatggtgcatatggtatccccttaagatataaaaggaggaccttgcccactgagatgtggactggacttttccagattgggaacccagaacaagggagaggctggctcataccttgtagctccttcatacgcagatcacccaaaacacaggagtagggtattacgcttctcagtggcccgaacctgtatacatcgcccgtgtcttgtgtgttttcggtctagcgaaccttccacatacagagagcttagaatctcaccctgagtccccggccgaaccggcaaaggggggcctgcgcagtctcccggtgaggagcctcacgctccgtcatctggcgcgccaggtagggggctctgcgagggattttctgagctctcgcactctttcgtgtgcgccaagcttttcctgttcagcccaatggccgagccagcaaaggcacacgacctctccccgagtatgagcggtgacgacggggagccaaacccacgccgtcgacctcgtactccaccgccccttccacgccaaagtcctaggcgggagaaggcgctcgagagggctcaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggactctggtgctgctaccaccggctccacgtcgtcaagacggagggcgcggcgagcggcagccgctattcaccattcggccgccactccttcgtcaacgcctccgacccgggaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgnnaacttgccacccgcgtctgtccactcttgggaggatttggccaacagttcaccatgaacttccaaggcacatatccgcgcccaggtgaagaagcggacttgcacgcagtacagcgaagggatgatgagtcacttcgctcgtacattcagcggttctgtcaagtccgcaacaccataccatgcatccctgcacacgcggtgttttacgcgttcagggggggtgtgcggcacaaccgcatgctcgaaaagatcgcctccaaagagccccagactaccacggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgagaccggcgctcccagcagggaacgcccaaccggcaagtggtgcaccgtccacaatacatcccttcacgacctcgcggactgccgtgcagtcaaaagtttggctgagcggacgaggaagtgggaggaggagaggaggcaggagcgccgagagggcaaatccccggcggttccttccagtaatcggcgaagtgaggccaagcagaaggcccccgccgaggacatcgatgacggcgatgatgacctaggtttccaagagcctagggccaccattgctaccgtcgatgggggagcgtgtgctcacgtttctcgccggagcttcaaggccatgaagcgagagcttctggccgcggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggacacattgacctaccggtcaccttcggtggatccgctaacttccgcacggagcgggtgaacttcgatgtggcggacctcagtctgccctacaacgcggtcctggggaggcccgcattggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctacgcccccgccaccccgaggcagcggatgatcacaggcgacgaggtcccggtcaaggaggtttccctgggcgacggcccgtccaacaccacacggatcggtggtcttctggacggcaaataggaagacgcgctcgtctccttcctgcgggcaaacgctgacgtcttctcatggagaccggcggatatgcccggggtccccagggggttgattgagcaccgtcttgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacctccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccccgagaagatacgggctatagagcggatgcgcccccccagcaaacttagggatgtgcaatgcgtcactggttgcatggccgccctaagtcgattcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacatggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttacccgcttgtccgacgacgccaggagcccccgacccccaggacggccctgaagccactgtgggaaggccgcccctgttatcctccgaccccgaggtcatcagcacagaagacaagtgcgccccgcgaggctgcttggacaaagagtgccccagggatgcggcccctagcaaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactcagagtggcagctggactggggatccgccgcctcctggtgttaggcgactcccagctggtcgttaaccaagtttgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaattcccttagattgattgcttggatcgccgagatccaagcatacctcacagataagactctacccgaggaccgcgaagggagtgaacgcgtccatcgcatttccaaacgctacgtgctggtagaagggaccctctatcggcgcgcggctaatggaatcctcctgaagtgcatttctcgggaacaaggtgttgtgcttcttgccgatatccatgaaggcgaatgcggagcccactccgcctcgcgcaccttggttggta

SEQ ID NO: 80404 - DNA, 7600 bp, Oryza sativa
gagatgtgtgtttctcgcgctgattcaataataacttttttttctcatgagaaattccgttgtgatttctcacctagtatctcatgaagtgcacttttcatctagatgttgtagcagctttaatatgtgcacttcactggaatcaaataatgtcattaacctaggcccaaaggtaaagcaacaaaatttgagcacagatctagtgttaagtaaaacaacagttaaaaactgcaggtgctagagcagtgttgaactgtagagacccaacttgatgtatgcttgctcaatggtgcatttctcatgttttgactaaactacacaaaaggacattcataaggccaaggaagcagattcattaactaaagcaaacataccagagcattggccacatccattgcaatctgtagtctagactgccagcttaatgcctttcttccagatgctgtagcaattcaaattggacaacttaacagcaattaaaaaatataaattatatgtacagaagattcaagatatacaaagcaatcatacagtgtaggtgatcctttaggcttccgtttgccatgtactcatagacaagaaacctgacaagtacatatataatatgaccacagtgtaaaatctgtacttctgtagtacaataggacaaaaagataccagcgtacctttctttcctttcgatacagaagcccttgagggttacaagatggcgatgatgcaacctagctaaaagctccatttctcggcagaattcttcctcagcttgtcttgataccttgtccatcctttttacggcagctatagatccatcactaaattgagctttgtagactgttccaaaacctccctttccaataactgtgctgaaattgttcgttgctttcattgtctctttgtaactgtacctttggaacattggtgattgacctgaaaagaaggtaacactttggtttcgataagagacaacagaatgatgaggtgatcggtttagtttttattactgccatgctaaagcccaaagctatacttgttgatgcacaacattataactcataaatagcagactttcttttagattttttttcacataacaggtttgacgcaggaatgcataaagcagttgataaacactgatattagaacatcttatgcgcgcatcaacattgggcataacaacgtagcgtaacaacctaagcaagtttcaggcagacatcacactatctgattaccatgatttactgaccataaacaagctaagaccaaattccacctttttactagcttaaagcatttttagtaatgtgaaatatggtgttagatatagattagttgaatagaatcaagtgcacaaaccttctggacatctccaggattgactctgacagaatgcattttctgggttctgagcatgaaggtctgcatttttcaattccctgttctttctacgaatcaatatgactaagacaagttggagcagaacagcaagcaatataaccgctatccctatcccaggtatcactgtaatccggtaaggctggtgatgtttctgcagaacagttttggtctttggagctggagcatcaacaggggttgtcacatttggagaagaagctggagtcgatgtaacagatgatggccctggtaaattccccaagttagagagtggtcatctttaaacttaatcagaatgcatcagtagtaagttagtaatacctggaaaaattgtgatcccttgtacaccgaagaagcacttgacaatgtcgtcgtaagagaaaatgccctgttgagttgcaagcgtgacaaaaaccgcgttccgacagacgctaagaccaacgttatcatccgagccaatgaggcgatgcaagaaacaatgccgtaattcaagcaggtcttgcaagtgatatccaaggatagaggacccctgcagcttccaacaacgtcattgaaatttggggattgcaacatttcaaggacggtgtcgcgtccggcacactgatatgagacccttatcttgggtcccagcccgcagaagacatcagcatcggtggggattccccgtagcttgaatgtctcggatacagagctaagacatatctcagagaaggccggagggacacccagcctgccggtggcattggcgtagcgagccatggaaatggcgacgaatgcattgatgtatcggcagcatgccgcccgctgcgtgggatcagagcacgcggctgaagctaatgtgaagttggcccaactaaaatccaaagggcaatctgcagagaaacgcggtggatttagtagagagaaaagtagtgctagtaattgggaagcaacagaaaatgggtaagcgtctgatgatgtgcattgaatcaagtgagtaggaactcaggtagaagaagaaaacgtgcagttatcaagtgagtagcaattaagcggcatgaaacactgggcattatattcgtactacagaagatggggatggtatatagggttgggaagatcaaatcgggcatgagcagtatcgaaagcaggaaggcaggtagtgattagtacagtaatcagtcgcatggggagcggatcacaaatactgctactctgctagagtaaataaggcaatcgatggatggagaaggtaactgacctccgacggcggttgctgcggggttggcggagaagaagaagggggaggcgagcaggagcaggacgacggagacgaggccgccgcggaggaggggcatttggctggatggcggcgcggagtgtggagctcagctcagtgttgaaggagagagagtgaaggagggttttggctgcgccggccgaggttttcttcttcttgttttttttttttcctgaatctctccctctcttctcttgggtgtggtacaggtactacggtggtgacaaggaaggatttgcttttggggctctgcgcttttatgtgggtgtctccccgtgacaatccctatcttttgctaccacctgctcccaacacccaattgaaggcatgtgccacgctgaggattgaccaaagtttgttggaaacctactagtaataagtttgcctccaaaatttgttgaatttaagtagggtttgtcctgaactttggtgcaggctaaacaagacgggccggtatttgggccatggcaaacagtagaggcgagaaagtggagtccagcagagacagcgggtgggggcagcaggcaggcagccattctggcacaccaccccccactcagcgcagtccagtatcacatgcattgcattgcagccacctaatttagctgccagtgccactaacaatctctcgctcgctgccttggcttgattaattaagaccgctgtaataatgtacaccgacttattaccccacgcattagtgtgtgtaatagtagtatgccatcgtcccgtacaagcagtacgtacgtacaacaacggatcggagctagctagaggtagaagaagaaatccgatcccaacaaccgggcggccgtgtctatttctagtacgtgtgctccccggcttccccgcgactttgtcacagttttcaaccaacgatattatctgtgtgtgtgtgcgccgcgcgggcatgcaccaacgcgcgcaacggatgaaccatccgcctgcatcgatcttcctgcgatggccgccgcgtcgacgttccctctggctctgctgctcgccattgttgccgcatgctgcgtcgccgggggcgagggcggcgcgctggtgggcgacacgtgcacggcgtcgtcggcgtcgagctgcggggcggggatgcggtgcgccacctgctcaccgctgcccgggatgggaccacccgtgtgctcgcggacaacgccccttgaccccaaggcgcacgtacgtacacatcactcctctatcatttcgcaatgcagcaaccaaattcctcctcaatccattgatgcattgcaggggacggacctcgcgttcaaccggtacacatggctcacgacgcacaactccttcgccatcgttggctcgccgtcgcgcaccggcacgcccatcatcgcgccgcccaaccaggaggacaccgtcaccgcgcagctcaaggtctacatctctctctctctctcgccaataaataaataaatattcgaaattataccattctttcttcaccgattttacaaagcatatatatacacgcttataaacgattggtacaagtatattactccattgtcgtatagtgaggtatccatctatatccatctgtgcctgcatactggggtactgcacacggggctctgctactgtatcatagcctgctgtcttttgtgctcgtcgcacataatcgtcggtgcactttatcctctagagagaggtgtcatgtagtatatattctctctctacacaacaaacaaatcagaatcattcaccacaacgcaacgcaacgcatcacggtgtccgtttgctcggtacacatcaaaaggaggcaaaagtaaaaggctgatgctttggtctcaaggtacatttggccacgccacaccgcaccttttgtcaacgtgcatgcgcacccattccccaccaagcccaaattctaccgtttgctgcttacagtttaatttgcatactgtacacaaattgtcgattattgtactttctggtcactcagtgcaagtgatgccagcaagatagattaggcggcttgtctagtttcttagaaagaactacgactatatgataaacagcagttcattcaaccctgtattatctttggccgaaaactatagcatttctgtcaaaaacgagttttggtccgtccaggattaaccatttaagtggtatttatcgatttaactatttaatgtcgattgtaatgcaacacttaaaaattagaaaaattaaaacgatactcggtcaattggaaatttccgtcattattttcatccctattgaccagtgtgtggccttgcaatgcatatctgcacagtacagctgaaagatctgctcatcttcattacaaaactgctactattacgatacttgtagtcctagtagtactagctagcttacagaatcctgtttaatcattactattccgtttgataattaacgtcctagtacgtgctagtgcattgcagaatggcgtgaggggcctgatgctcgacgcgtatgacttccagaacgaagtgtggctctgccactcgttcggcgggaaatgctacaacttcgctgcctatgtaagcctgcattgctctgactgactgactgacgatagaaacctatacgattttgttgttgtttatatgtcgtggattgatcacagcaacgcgcgatggacgtgctaaaggagattggggcgttcctggatgcgaacccatcggaggtgataacggtgttcgtggaggactacgctggtccggggagcctgggcaaagtggtgggcgggtcagggctgagcaagtacctgttcccgcctgccaagatgcccaagggcggaggcgactggcctctgctcaaggacatgatcgcccagaaccaccgcctgctcatgttcacgtccaagaggggcaaggacggcagcgacgggttggcgtacgagtgggactacgtcctggaaacccagtgtacgtaaaagcacactgttgcttaattggtcgtcgtctgcatcgtgatgtctcctgatgttattgatcgatggtacatcacatgcagatgggaacgatgggctggtgggcgggtcgtgcccgaagcgagcggagtcgatggcgatggactccaccaagcagtcgctgatcctgatgaacttcttcagcaccaacccgagccagagctgggcctgcggcaacaactccgcgccgctcgtcgccaagctcaaggcctgctacgacgcctccgccaagcgctggcccaacttcatcgccgtcgattactacatggtccgctcccataatcattctgcctctgtttctgactaactgactgacgacccatccacgtgcagaggagtaagggcggtggagctccgttggcgaccgacgtggccaacggccgccagcaatgcggctgcgacagcatagcatactgcaaggttcttataatatccatcctttgtctccatcggttttctttctcaacccatatttatatatgttgtatacgcagcctgggtcagcgttcgggagctgcagtttgtcatcgcctcctgcagcgccaccaaagatggctgctgcttcaccgccggcagcggctccagcaccagcaccagagatggctcctagttcaccgccggcagaaccaccagagacggcgacggaggctgctggttcagcggtgcgaccggcgtccatcaagttagagaaggacgacacgacgggcacatcgccagcggacaccgccaaatcctcctcctctaatcgctctcctcatccgtccagctgcagcttcctctttggattattattgccatctcttctcctcctccacctttatatttcagattgatcgatgaggcttttatccatctcatcaattcgatggtgctaatatacttttattcatggatggactccatgatccatatgcgcatctcttagctagctagctagtagtagcagcttccacgcaagcgcaatccatccggactcctgctaattaaatgttttgcacaattaactgtacacctagctagctattaccacttaatattagaatctcttgtagtaatggatgcatgcgtgcatgttgacatcaattaatttgtctttgagtctttcgatcttgtttcgttggtactacgttcgtgtcgatccattgggttgttcaaggaaaaaacaacaacttatgctatgcccagtagattagttgtgatcttaataaaagcaacgagctcgaaaagaaattcagaatccttctaccaccgagttaacagagcctgaattgaagcacaccttcctgcagggcgaacggctgcatagccgtctttcaaggacggcccactcaacgcccaacaacttttgcttacggcccaaaaacatttcatgtcacataaggccataaccttgccatctccgcccacataaggcccatatgactggcgtcagtccacttaaggcccaatattttccttcggcccatacatactccaggccgcacactcacagcccataaattctgcatttcgtcctggaataagttcaccggaggtcccttagcttgacagtgagattttttaagatcccttaaccacaaaaccagaaatgtgtacccataaactctcacaaaccgttcatcggaggtccctcgacagtatttttgtctggttttgctgacgtggcatcctagttagcaaaaaaaaataaaaaattaatatgtggggcccacatgtaaatgacacaaaaatgtgagctcaacattcctagtcagcactgatcttctcaatcgcttttttctttggcgcatagggggagcagcagcgacgcgcgtccaaggcaggcagagcggggcgcggtgggcgagcggcggttcgcgagttcggctgcggtgagcgcggcggcgacgggcgaggggcggcggcggtggcgcggcagcagctggtgccggccggagagggcggagatgaggccggcgggagagggggtg

SEQ ID NO: 80405 - DNA, 29232 bp, Oryza sativa
taagtaataaatgttgataagcgaattactaacacatattaaacaagagtacaaacaaacaaaagtgtttagtccgaacactcatcacgataacattatgatacaacacgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaacactatgttgttatcggccatggacggaccaattttcttgtatcgatccctaaagtacgcttgcgtgccgggaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagaacctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccacaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccataacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcataatacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacagcatcccctgcattgataggaccctctacatcttcggtttgcattgaaacatttatatctttctcttgtaccgacacaaatataacgaggggccatgaccgttcaaaagccatttccacataccgtctctaagcatcagtgctgtccatcggcattagttcccaaaaataaccttctgttgcacgactcactacaactgacactgacattgtgtagacttcttggtctattctaaatcctctcaacaacaaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtgctacgccctaagttacattctctacaacattgttctctaaatttctaaaattacgttacattctccagatcaaactaaactacatctgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacatgtgatgaattagcgaaccagcagggcttcgccgctccccttctgctgccctcccctctctctctttcgttttttttggatttttagtgaatataatgaaatttcacagaggaggggctgggctttataggggggaggcaaaaatcgccctcccccagggcggcaagggggccgcctgcaaaattccatgccccatcgccgcccatttgcaggcggccccccccacagtacaaaatcgccctagcggagggtggcaagggggccgcctgcaaaattccatgcccccctcgccgcccatttgcaggcggccccccgcacagtataaaatcgccctagcggagggcggcaagggggccgcctgcaaatttcgttgacggctgtcgcccgagagcgaacggccggctgccacgtcattttcgccgccctctgggagcccagagggcggtaggcgactacttccgtcaattttcaaaatggaaaattatttttgtaaaacttttaataaaaaaaattataaataaaaaaaattcgagaaaagactagtgtgtgtgggctgggctagttagtgtccgggactgcctaaaccgtttattgggcctgtaaggactactcctactaattaaaaataaagttcacttcaaatcccatatcgtgtttcaatcgcaatccctcgaccactgactgaactagcagcagacaccattaatccttgccattgacagcggtgtgggaggacggttgatgcattgcctccactgcctagtaatggaggatgcaagtccatgaaaaaaaaggagatagatgcgcagagggaaggggtgaggaatggtaggaaaccttgatagggtgcatagagggggtgtttggatccagggactaaactttagtctctgtcatatcagatgaatttagagtattaaacatggactacttataaaactaattacataaatgagagctaattcgcgtgacaaattttttaagcctaattaatctgtaattagcgcatgtttactgtcgcatcccataggctaatcatggattaattaggctcaatagattcgtctcgcaaattagtccaggattatagaatgggttttattaatagtctatgtttaatatttataattagtgtctaaacatctgatgtgatagggacttaaaagttttagtcccatttaaacagggtcagattctcctctttaaatcactctcctcactgtcacacacacaagtggaacccagggttcccaacccctctccatcatattccgcgtacacgcttttcaaactattaaatggtgcgttttttataacaagtttttatatgaaagttgcttaaaaatcatattgatccatttttcttaaaaacaattagctactacttaattaatcgggcgctaatgaactgctccgttttcctgcgcccactgttccggatgggaactgccagcagtgaacacggtcagctgatgttggtttccactgaaaataaaaacaagaaaaatcattagtgcacgatcaatctaattttaattattaagagttaaaaattgtatttgatattttaaaagtaacttctatatagtattttccacgaaatgtaccgtttagcattttgaaaaacatgttaacggaaactgagataaattttgtatattaattagaaaataactggttttattgttaaaactccctctggcttaaaataaattaatttttcacgtactcatctcacacataccaatacaaaactaaaactaaaagaattagaatactcctaatttatcaaatcccaatgtaattaattttctctttatctacaattaatgtatttacccttagaaataaatttattctaagataaatggcggaagcttaaaaataaaacttgaagtattttgagacaccgggagcagacgatagtgggtttcctccagtccactcaactcaacagcatctgcacctgcacggctgcacgtacggtacgggcgtgttggagtaaaggaaggctgtatggttggctcgaaacaccacaactccctccctttgctgccgtctccaagttgtagccatttgctttatttgctctgctctgatcggctgctccaacaacaaaattcaaccactcgactgtcatgcttttttggtcccaaagagcatgggcaaaaataccattctcctgtgtacaaacagcacctgagccaaagccttgagaagacatactagtttcagggcttgtttgattttgaatgttgatgactaacgttgccacaactaggattgctaatggtatggcttaccacatgaagtgtgactaaccatcattggtcacaaggagggtagcaaagctggacaccagatcaagtgtatgacatgtgggacagcccctagtagttaacggacgggatcatgcatgccttggcaatgaattttcatactgccactcgatcagtcattaagctcatcgatcgagcccaagaattaacaataagcccactgctagctctagtatgcaataatgtactcctccttcagtagaagaaactaacaaacatctatctgattgtacaaattgattgatacgctgatcactagtcaataccgatcgatcgatcagatagtacaataatcagacattaacgatgaattaattaattataaatgggatcatcatcatcatcgatcgatcgattgattacatgcaattaacgaagagtgaaggaaatgatgctagctaagattattattattggttaatgatcactaatcgatcaggccctgtagacgacgacaaagcaagggagaatggctgtggggttgaagacgtccagctcgtccaggttggagtacagccccggcgtcgtcccggccaccgagtcgtactcctcctcctcttcctccgccgccgccgccgccgcctcctccctcctcacccggccggcgatcacccggcacaccagcatcgcccggcggtcgccctccgacccggacgagacgacggcgtcgtgggcgcggccgctggtggccatggtgcggatgccggcccccggcgcgggcggcctgaagccgtggcggatgatggcgcaggcggcgcaggagaggtggtcgcagaggtgggtggcgccgtggaggccgaggtcgcaggagagggtggcgcagtggaagcggaggagctcgttgccgtcggcggtgcagcgagggtggcggtgggccattgctttggccttgacggcggcgcggtagtcgtcgaagcgggcgagggtgcgggcggcgttgtggaccttgaggatgcggtcgatggcgcacacggggctctgcttcttcagccagctcgactggaatattatcgatattatgttcctgctcgtgtcctccgcccccagctccgacactgcagtgcacgcattccattcattcattcatttttcacattatagtgaattattttgttgcagcagcagctaaattaagcctaacctaattatacattttgctcatcatgcatgcacactccaacaacaatatactgctagtggtagtggctagtgcattcttcattcattctgttctggtcaaaatgaatgtactagtagcagtgtccttgtacagtactactacgagtatatgggtggctactttgcacttgagatttgacagcctgaaactagtatatgtgatgatggtgtggtgtgtgccatgatgaaaggaaccatgcaatcaatcttctccacccgcctgagcctgtactacactcaagttaatatgctgtctatagctacagagatgattgagagcgtgaaaagcagctcctagtacaaggaataaagctccatctcactttcagcaccgaccaacattacaattaacctcattcaatctgaccgcccagtacaacagggccaccacagctacttttatagctaagcacgagtaattttcaaggatatatactcgctcatctcatcacgatatctcatgatgtgatgatggtcaggaaataagactgtacatacatattgtaatgtataccaccaacttaccaagtgtggagtattactctagtacagataacataaagaatgcagcttagtagtctaattagctatgccaaaaaaaaaaacagggagctgatggagggagaaaattaattaattgaagaagggaacgatcgaacaatatgcaactacgcaagcaaattagctggtaattagtaagattaatgatacttcagtaattgaagtggagataataacctgcatgcctgatggactggtggaggtggagggagtcgggcctgacgaagatctcgccgcagtcggggcaggagcagatggtggccctcatggaggagctgtcccggaagacgccgctgatgggatccaccaccatgtggcactcgtagcaccccgacagccgcctcaggctcaactgctgcatcccccggaacgaccccccaccacccgccgtcgacgaacacgacgacgccgatatcgacgccgacgactgcaagctgctgctcgcctcctgctgctgctgcttcactgacttcttcaccgaccgctcgctgctgatgttgcacgcgctcaccgaagctctgcgcttgcagtacggctcggcgaccggcggcttgtccttcaccttgagctctcctccgccctgcgcatgtgctgctgcatcgggttgtcttgcttgaccttgcagatggaggcggaattgcagccgagcttcttgccgtcggcggcgcggtggtggtggtggccggcgtggctgctgctgctgctgtttctgcacgagaagaggctcctgagagctaacctgtaggaagggctctccggctctgtgcactgctgatgacggctctccaccttgcagcactcgtctctgccgctgcttctactgcacttgtaatccacctgcttcttgtctttctcatccaccttcctgcttgctaccaccagcttcttcttcttcttcttcttcttcttcatgacagcggcgtctgagcctgcagagcttgaggctgaggcggtgaccttcgtctcccgcgctctccccggttccaccattgctatcctttttgctagctcgtggagtgaatgatgctgcttcttagcttgttgcttccttatctaaagaggaggtctcggctcggctctgttgcttgctttttgctagatgctcttgccatgcatgctgctgaaatgtctttggaggatgcaaaggaaaagctctccgaattaagatagatggaggtaaatggctgcctgcctaattagttggttttgtacgtcaggttaactagaggagtataagagtgagcagtaatgatgttttggacatgcacacctctctcatgtcaggggactagcatcaaatcagatcatgcatatgttaaaataatcttgtttaagaactccatccctctcatccgtctcaaaatataaaagattttagatatcagatttatatttttaagatgtgtcatattcctctaaaatctcttatattataggacaaaggaattagtgagtactccctccatcccaaaatgtattaatctataatgaattggtatgcatactaatactaaatttaatagatctcttatccagatttacattagtagaataagtttcatccagattattatattttaggatagaggtagtatattttatctacctatctgcagttggaacaacactaggagacggatttttatcccttgaggaggtatctcctttatttctcgcatgtcacctaaatagatagaaaaaattaacatcatatattaatatgaaatatgtcactccacaaatatacgggactaaattcaacttctatatgttgcaatcgaaaggacaaattaaagtgaaaatggttaacgtacatcgacaattattgtagaagttgaaagcagtgatatatttcatattattttatcttattatttttaaaattcttttgatgacatgcaagaaataagcgactatccactccaggaatgaaaacactctccccacctaataacgtgctgatacgatattagctgacatttgttcgctatacagtcagtggcttcttgtctccaaagcagctgctgtctctttttcactccttcctacttattggataatgattggttacgttgagccatgttgttgttaagggctaactagaacatgatgaaagaacaaaagcatagcaaatattcttgcgtgcagagtagctgcgctcatgcatgttgtttgctcaactgatcgaatacagcctcgatatacgaacctagctcaagaagctggatcatatttgatactactagaaatcaaaggtggtagagtgctgacagttttaagtttgggatttatcatttatgtagagaagatgctttttgtctctgcatgcttgcaagggtcaagtgtgttaagttctattgtgtgtttgtatgtaagttgccgacaaactgaaggcgggtcaagcaggccgatggtaaaaaaacgacaggacagcgacgccacaccacacgacgacacggcttggacggggatccatcggagcagcataaacacagagacatacgcatatgctcacgctttggatgttgctggagcagagtactactactccactccatttgtgcagttcaggtgcagagctagtggccatggcagcggcagttgcagcatgatgtctatggatctgcatgctggaaagaaaagaaaaaaaaaaggagcaacacaagcctagaaagagagagagagagagagagagagagagagagagtgatgttggttttggtgattttcgattaaaaggacagggcagctgggcagggagggggagagggagcattgttgctgcattgcaattgcattgcattgcattgcattggggtccgtagaaagaaaaggctggctggcaaggcatggcatgggggcctgggagatgcccatgctggtgctggctgcagcaaccgcaagctgcctatagcagcagaagggaggcacttactacagtaactagtgtgatttactactccactaccactagacactatagcggccggcacggctgcagatgagatgaggcatcaacatcaacccggatgcacggtccgcctgttggaaaggaaataaagaataaagacgaccaaactttttttaaaaaaaagaagaagcatgagctacatgaagctagtagtaacatacagtacatatctgggactgagctgtgggtgtggttgctgcatttcttcatacaagaatacaatgcatgcttccgtagttccgttgatactttatgcgtcactcacacgtctgtgagcctcatcgctcatcgtttgtcctatggcttataagccaaaactaaaatttaaattttaaaacttaattttgaatttaaatttgattctttttcaacatagttttttttaactttagcttttcaatcactaagaacatatacatacaagatttttattcacatatcattttttaatcactaataaaccattatgacttataataaaactagaccaaccgatgaagatctgtctttatatctcgagttaacagtagagttggatatagtgctttctcacagacacacaaaaaaagcatacatagataagacgccgaggcggttacgagggtatgggggtgtttacaaaaacagaaactgagtagtctcctaacggaggggaaaagaaagataagctaggctatgtgcctaatagtccctcgaaggattggcaatcgcctccacccatccaccaattaccttccttcttgtacgatctgtgtcaccaccatcggcacatgtgacagaactccgcgggcattcctttccttctacaagtggcaggtaatcagaatgacaatggagtcgaaacccttcctatcatgcttgtgcaggagacgctgcgaggtttgccagcaatcttggatcattgcgtggtggtttggcgagagattagcgagtccgatcaaggatagcaggttgcaccatcacttgttcaacgaagacgcggtggacgataatatggttcacgctcagaaggggcacatggagtggctgtccattctcttgtcgagcaatcgatcgattggcctcgttgcagcgccaaccaaagaaaaatctttcatttggtcagcctgctgctgcatcaaaaggtttttggcataggagaatgaatggagctaggccaaggaagaaggtttaatttgtaggtcgactgatcgagctgaatatatatgcaccgccggtccagcgccaagcgaactcatcttaattcggtgttgtgaactcgatccaatatccgcgggaattgcgcgatcggactcgatagtgagcgcaccggtgatgtcctgaataatctacgttgatggctgaaccggccgggctccagggacaccatgcatgcatttaaccagtacacaagaaagaggaagtgcgaagacgaatataatcacgatctagtactcccgccagcacgggctgaaaccgatcgagatgatccagcacatccaagatcatcgagaaagggataaccaaccgtgtcaaacgccttggcatgcaattaatatccgacttgaggcgtagtcgcaactgccaacggcagtggacacctgcatgcatatagctagcgaaagtactcccttgatgaagacgctgtggttggccgccacgatcacgtcgagcctcggattgcatatagtattactcctaggcctagccgggattttcacttcacttgcttcatgcatgcatgggctttatgcttctcctttttctttgttctccttgcattggggaagtttccctctactgtgcctcactgttcccaattcctgcctttcacttgccatcccaatattcccaatatatatattccataggtagcctacctagctagcttgcatcagaggctcttcttcctcagccctttgagatgagaaagggataaaaaccaaccggatacaagcctgccttcaccttaatggttaatggttacctattaacccggttcaaggtaaactcaatggtggtggcattcaaccccttattatttattttggccaggaacaccttccaaagatgctgcctgcctctcctctgctgctcttaaaagaaacaaaagcataactcgattaaccaacaatgctatatacttgtactccataattaagcttttttcaggttcaatcatgcatgcatgtcgccatgcatcctcaaactaattaaccgatttcaagaatatatatatccttccctccagccgagacggacgtacgctagctaacatgcatcaccacgcaatcagtgcatccgaatcagctaatcttaacccttgtcgtcattagctagtcaacaaggatgaacagagacaaccatctcagtgcaatgataataggcagctcgtgttcgtaaaggagtactctctccgtccaaaaaaaatctaattctagatttgtatctagacataatggattaggtttttttaggacggaggaagtaataactagtactctttatctggagtactactcctattgtaaactctgaagttcaagacgacgagcgagagtgacgcgcggagatggagaaataattccagtccagtccatgcatctcgatccccatcatcactccatgtggggctggtcatgatcatatatggcttaggcaaacagatttcaacttttttctttaaacttctaactttttcgtcacattaaacttttctacaccacaaacctccaactttttcgtcacgtcgtttcaatttcttcaaacttctaattttagcgtgaaactaaacacagcctaagctagcatggatgggaaaagaaagatgcaatgcactcgaatataaacgcaatgcatgtggcatgttctcatgctctagctgccatgccatgttctatcgatgctagctagctccggcctcagctccttgctcgatctggtctcttgtttgatagtactactcactactcactatgcttgtacctggtcaagtgtgtttgaggctttgagctaggcgtatctgtcctcaggatctcctactgagacctgaggtcatgaacctgcttttgctgagctaacgtatactccctccatttcaaaatatttgacactgttaactttttagcacatattttaacattcgtcttattaaaagaatttgtgaaatatgtaaaactatatgtgtacatgaaagtatatttaacaatgaatcaaatgatatgaaaaaaataaataattacttaatttttttaataagacgaatagtcaaacacgtactaaaaagttaacggtgtcaaacattttgaaatagagggagtatatcctttcactgatatctcactctcatcaatagatcttgcaccatgaacccatactccatcattattatcgttcttgcacacgtgagctatttttgttggcacaattaactaatgttctctatcaatctgattactatttttttgccaccttatctactactacctccatcctatattaattgtggctttgaatttttgtttgtaatgtttgatcattcgtcttatttaaaaaaaattagaattattttttttggcttgctttattatcaaaaatattttaagtatgacttatccctttttatatttacactaatttttcaaataaaatgaatggtcaaataatacaagcaaaaagtgaaagcgaatttattataggacggaggtagtataacacattaacttgtgcacgaggatcatagcaaacacttactccctccgtatcaatttctgggattcaaattttacgtacaccataatataaggatttctgggttgattctcactaatcccatcatttcaatgattccaaagctaatcaaatgtctagaaaggaaatcttaccaatttaaaatacaaaaaataacaactatagtgactaaaaggggatcttttgagctaacctcattatttactaaacaacctgaaaatccatatattttgtaacaaagggagtaaaaatctaaaaatccatatattttggactgtcggatccgtgccaagattcgtataggcctccttttcctctagcttcggtgagacggcgacaaccccgatcagtaagggttttgggttgtggtcagggtgggtagggggagggaggtttccctgaggtttagaggaaaggcagtgggcggtggactcaggtgagtggcgagtcggtggtggtgccgctggagttgcaaggatggggatggtgaagccgccaaggcttccaactctctaatgctctcttctcttctcttcttcctcctctatgtgtttgtgtgtgtcaatggtggagagggtgcccaagtgcagttggtgctgctggtagggtcagctcatccgggcgagctgttgtgtggtgcgtggctgctctatacgtcaaccgtgctaggacgccgccttcatcacaggcaactcgggaagctgtcgttgtttatgttcggttagaggtagctggagttgaaagagaagatgtggagagaggatcccaatgcaaattttgtcccgaattatattctagcgtgtagccagaagtcaatagtgtcaatttatcgaatccctttgcgaagtggcatttagacaaagcccactttttaacactggcgttaatccaaatttctcaaggagggggaggggaaggaaaatgataagattgatgtgcgcttgaatcgtaacacaaatctagcggtccaaaattcatatgatgtggggtgtgattcactactagaaaaagcattttttttccgacgtgggggtctttttttcgcaggcggacatgacccttggagccaaacgaccgcctacaaaaatataaatcagggtgaagtttgctgcggaccacttaaacggcgtctacaaaaatgattttcacaggcagaccacttaagcgacgcaacgcaccttatgtggtccacctgcaaaagccatacctacccaaaaagaaaattttaatcttcccttatcttctcctcccacccctccccaccactcatttcctttcaactctctctctctctccctcaacactcaacctcagcccgtccccctccctccccgccgaagggggagcgacgacggtgcggggcagcggcggctcccctcccccctccctcgcagatctggtcggaggagggaggggggaggccgacgggggcggcggcgaggcgtgtcccgcgatttttttttgtgtgcatttattggattttcacaggcgggctgttaccccgactactgtaggtggttgtcccccacgtctggaaaaattacttttggccacctgcaaaaatactttttctagtagtgattttctgccatatgttgtgtagacaatctccttatatatttattttgtgtgggtgttgtgggcctttgggggctactgctcgatcgacgatcattggaagcaacagtagatcgcacgccaattgatagacttggctaatataatgcctctaagtacattctcaatcgatcgacctgcaacatgcatgaacgatagccccaagtcagaaatgcaagtacatgtctttgctcaaatctgagactacctatttaattagtcatcaatctaaggatcgtttaggaaatataccattgaaagtaattagggggttattcgatcgcaagaacacggacgacttcgttcatggcagggatggaaaaaaaatcgagaaccgcagaccgaaccgagccgactggactggcggtttcttcggtcttgagcttcggcgtcactttttaggaaaaagtataccgaaggtccctcaacttgtcatcgagttacaaaatcgttccccaactgcaaaaccagatatccggcatctcttaactaatcaaaaccgatcacaataggtcatttggtggttttgaccccggttttattctacatggcggctgagtcagcgtgggacccttgtgagccccacatgtgctacaactccctccgtttcaggttataagactttctagcattgcccacattcatatatatgttaatgaatctaggcacatatacatgtctagattcattatcatatatatggatatggacaatgctagaaaattttataatatgaaacggaggaagtagcaatgaatgatgggcttggcatatctgggctctcggctctcgtgcggcagccgccctcctcctctcccgcctcgccccagaggcctcctccctagccgccggccggcttgcccagaggagaggggaggagaggaaagaagagaagagagagaaaggagaaggaagggggatatgacatggcacccgacatgtggggcccacgtgggtctcacgctgactcaggcgccacgtaggataaaaccgggttcaaaaccactaaaggatctattgagaccgattttgattagttaaagaacgctcgatatttagttttacggttggaggacaattttgtaactcggtgtactttttcccagtttttatatcggtttttgatcgcctcttggctgcgtgtgctgggccggtgctatttcgctgggccgtaagcagaccgaattaacgtcgccgtcgtgagcaaaacattctaatattaaattagtatagtataatatacttccttcgtagtagtatcagaataaaacaacatagaataggagtacaaaataacctttggactcggagaaatggatcatatcatatcatgattcatgaggggtgcgtactgttgtctccattggactggcccgcagggtacatatatatgattgagaaaaaaacagaggaaaaggcacatccacttatgctactactgttgtctctctctactgaatgatatacgtatatatatacagtagtactgtattcacatgtgaatgaacaaatctcatgcgtgtgatgtgatgaaacgtacaagcaagcaccagctgtagcgcgcgcgtaccgtttgcttctcagatggatcgtccaggcaagaagactagagtactagcatatatgtcaggttggttttctcatccatgccaataatcaattaattaattagagcgaaaactgcaaagccagaaaagtgaagagcagcgcagaaatgacactaggccaagatcgggtggaggcgctgcagataaggcgattgttgtggtacgtgcacacaggtcgcttcctgaagatgattaatcgagcttaattaattagcaagaggagaaatactttggatggatgaaagaaagaaaggagatggaaacctggtggagcagaaggtgatggtgtagtcggcgttggagctggtgggatcgtcgtaggcgctgtaggcggtggggcaggcggccttgaacttcttggagtagaaggtgggctggcacgtcgacgggttgccgtacatccccctgcagcagtactggtcggtgtcgaagacgtcgcaggcgctccggcacgccaccgtcctcccgttcaccttcttcgacagctccgacgggcagctgtcccgcaggtcgccgtcgcacccggccaccgagcagttgccctccccgttgagagggcgcaccaccatggggaggttgaagccgtccacgaggctgacgtcgtagaagtccttggtggcgagggtgaactcggcgagcgtggccggggtggcgccggagccgccgcacttgagctccgacccgcaggaccccgtggcgcaggagccgttgcccgcctggtcgaagtcgcactccgtccgaccccagatgcgccccgaccaccccaccggcgccgtgaacaccatcgattgccccggcttcagcgcgaaccctccgccgccgaagctctcgccgggcgtcaccgccggccagaccatcgtcttgcactggttgatgatggtgaacacgcgggccgactcacaatgcctcacaaagcagcagcacaggagggccacagccaaccacacaacaccacctcttgccattcttactttattaggtaccaattggatcgatcgatcgatcaaattacagctcctagcttgattgtacgtaggatcggagcatgcatcaacacctgtctgtatgtgattgtatatataacctgccagaatgaagaagattgattgaggcatgcaacaaggaatacgtgcgacaacacattaggcatggccatagcagcaagcaagcaagcaatcatgcaaatcatcttgcttgcagtgcaggagaggcctggaacccctcgctcttccctccattcgcggttaactcatcgcatatttggacatccgtacattccagccggagttgaagctgaatgacaactttaagtggtgtttgtatcatggactaaacctatcacataggatgtttggacgttaatttgtaatattaaatatagactaattacaaaactaattacataaattagagctaattcgtgagataaattttttaagcctaattaatctataattagtacatatttactttagcatcacatacgctaatcatggattaatcactactacaaaatcgttttttcttgacaccacctttttttttctctagcggttatacgtgccagcaaaaatattacggtgggtgaggggctacggaccgccagcaaaaatagattttcgtgggtgaccgagttaagagggccgctagcaaaagtctactttgactccctccaatatatgtacaatttgatttgattcgtttccatctatctattaacttattaaagtaataaaaaaggagcctacatgttcactctcacggcctagaaattatcatattaatcgggaaaaaaaaacatagtcaatataataatacaatttactcccttctctttactctcttgttctgtaatgacacttattcctgtttctagtaatggaaatgggggcagcaagtgccctagttttttttaaaaaaatataaaaatataatttagaaatagctaaaattcggaataaaaaataaaggcaaaataaaaatgtctattttgcctccctctagtctgctttatatcctcacgcaaaactcggtatatcgattctctaatctaccaaaaccggttgttttgcaaaacggtttgtttgtaaggtggtttctgtcctaggtgacacccacaagacacataaacaaacacgttgacttacccttcgtctaatgtagcgtctacatggcgcttaaatattattagtcattcaaaaataaaaaaaataaaagctaagaacccacatgtcagagtcatttctccctcccttcgacaatctcgggccactcgatgcctcctcgggctcccgatacgcagtccacaggaaggaaatgatcaccatgtaaagataaatgaatttcatgcgcaccacaaccaacacgaaaacagaattatctactgtgcaggtaagatcttaaataaaaaacgaagcgacacaactcgaggcagcccttgtatactggagtaactactgtaatgggtaagcaggttatatattgcgctagtttgcttcaaccgggaacatcaaactactaggcggaacgtacacaaattgtctagtcatatacaggctggataaagagtatatattacatatagcgaatgaccaaatttgctgcaagtaggtaccactgtgaacattacacacctgagcagctggctaactgagaactattcaatattatcgcaattaagaagggaccaagcaacagttatttctacctcacagaagcctaatttgcatgtagcacagctttcccctgattttttgggcctgaagcgaaccttatccgttgtgaatagggcctcatcattttgtgcaatcccgccatcatcatctctagttcttttaccaacatgtgtggctgtcaaagaaactgtcagttctccacttaattctacagttacaacacgccttgatagcttgatcacatcatctgaaccaataggcattgtttctgcatcctgggaatcaagcaacataaagtcctcatggcatatactggaagttgtgcaaacaattcgtccttggtattcttttgtccacgatcctctaacaactttgactctgcagatagtcgcctcaactgccccattaagcaccgcatatgtgaacttaaacttgctgtaccacccaagcatgattgggtgaaatctacgaaccagcgttactgattgtctaccattaaaaaacccattttgtctgaagagttgaaagctcaatatttgatcatcggactctcttcttccctttacttttagttcaacgtcaaactcaactgggtcgacaatcagaattgcacgggatggacctgtcaactccaaaaatgaatcctgcaatcatcattcgtacgtcattataataataataataaaattaaatagcaatgcaaggataaaaccaatacacattgatgaaatagtaattgcttactttacaggactaaaattttagtggaagtgcatataagttctgtcgaaaatctcctaggttctagaagcgacaattttatgcatacatatgcatgtcttatgaattaatagtttagtacagtggccaaccatcccatgtctttatcattatatatttgcaagtcttctcttttttgttttccaatttgttattttatatcattagttgtttttgcatgtttgagttgaaataaatatgcttataagagcagttttactactaccacagtccatatatttcaaacattgaattgccaagaaggtttccagtttacagtagatattagagaacgtggcagaattaagaggcggaattgcattcatgataaaataaaatcgtgttatcgtgtacacagtagtaaggtgatttgaatgtttatagcacttgagagggagtacaaaataacagtacctgcagctagaaatgagcaaacaaaaactaaaaaaaatccaaataattaagataatttaaaaatggatggtactccaccttctgagtgagaatttgacaatcatctctagtgcggtggaacagaaggttgcgattatgatccacagagtccctgacagcaaccaagccatagacatgcaacggccactcgagaccctttttgattcttaccacctctatggagaagatctgcaaggtactatcacagcaagcatatcttgcgataggcccatgtgtatatcgcatggcgggcacagacgctgcaaacataagagttatgcatgcatgcaatcagaagacataagaatacattgattatgatccatctttacttataataattagaggctcttccagaagccctctgtcaatcctagataagaacattaatttaatttagaaaattaaaaaaagaaagctagaaatcgcacattaatcaaataaaaaaagatcttgatcacccaatatccataactaacgtaccatgtgaggatatacttatatagtacgtgtcgcaccttgtgaggagatacttatagagcgtcgcactatgttaatgcagaaaggatccaaaaaatatatagtgagtcatggacctcatggtagttgagaaaatggcccatgccacatgcgcacggcaacaaaaaaatttgatatatttgttattgggtttgattcgaaaaacgagttcaattttaagaagaactttggttggatacaagtttttccaaagcgtttaatagattctagttgttccttctttcttaggtacattcatccaactagagcttggagtctattctcttcattagtgatcataacaatgttttgtatgcatggttcctatactcctatgcacattgatgtacatgttctggtttcttaataacaaacaaatggaatgtagattgattcattgtactctccttttaacgcaaatagacatgcagcttatggtttccaaggagtcatattgaatattgagtgaattagctcctgccaaatctcatgcagcagcacataacaataacaagaatattaatctgacgagatattgatactaacagtaagagcacccgcaatggtaaagtaaggtgctctctataaaatatgtacatctcagcaatagacttagattaatagtaaactacctcaatagtatgtctacatgggtatctatagctctctaatccattgcctcgtttttctctatagactatctccaggttagtagatagttttgctctctctcttcatttaatctcttctaagtaggaaaatatgctgacatggatctcttgtagagaacatatagataaccattgcgggtgccctaataaaattggattacgtacttgtgcattggaagggaccataacgggaagacaaagaggaatcccaagatgtacggtagttgcgaatctgctcctcctcgtccacctcagtgtacttgtcctgcaactccaacttcacctgccgcaatttttcctccatctgcaccgggtccagctcctcctcctcaccgaacaccaattccgcgcacctcgaatccctacacccatcctcctcttcctccaacataggagtataattgttcatcctttcttcgtcatcctggtcatcgatcctccttgacttagcagcaaaggcctcctcctcctcacggcggcacttccggccttcgccgcctcctctccccttcgtctccgccgcctccatcgctaaatgtatgagatcagtttccttctctttcacttcttaaggcgttccaaatgtccagtgggccttgccctgggcggctgggccttcatcaacacaaattgaacggaatgcagcccattacggcttaggctcaggttttaatattctcattttcactccactattaatattgtttcagatggataaaaaattactcttctagtcgcgtatatatatatatatatatatatatatatatatatatatatatatatatatatatatatatatatatatatatatatttaacatcagttcccgtgatataaaataaaggattggcttgttcacttcgttcaacaaaagaaacttcaagaggtcaggtggagatgtgtagtagtagtgtttagtttgacacttgaccaaatattggtagcagttttgtgagtagaatggtctagaattatcaataattcgcaaggttgtgttggtaatgacatatttagtttgttatcttagtaaattttggtatcaccaaaatttcgaatagttgagaatggcaaggaagtaaacaaggccaaaattttaagacttccagttccatacactctacagctaacttcagtcaggcctacaacagacgccttctcctcctcgaaataacttatcaatacatccacgagtctctgaaactaagcaagaaaagcatcagcttctagtatacgacagcacagttcaatgcttggtaattaagcaggcttcatcatataaattaagacatacttatggtaaccatctcgcaggacgtcagagaatcacaaggaagaaaccagtgctgttgtcaatagcccctccagataaattatagcaggcaggcaactatctttacacaaaggatatgcctttgatcacgcctaatgcgtgcctcaaaccagtcattggattattacttcatctcacacattgacatgatttatcactgccctaaaggccgaaagagagaggtggggagggagagggagagggagagagaaaaaaaaaaggttattaggcatgttgctgcaccgggaaggcgggaactagaccggacttatgagtgagcgagcagctcatggattggattgtcaaaactcatcggccagactgactccataatgctgagctaggctcttcatgtttccgttctgtacgacattctccagcatgtcgtacttattgtaatttccatcgagtaattcctgttgctgctttgccagctccttctcctcttccaattgattctggcagaaaaaacacaaacaaaacacatcaatgccatgttacaagatcaaaacaacagcaacttggtcctggtaagcaatagcatcaagatcccaaaatactgtcctgctacaaacacaatacttggactaacaacgctgggcaagcgcataatagttctccagtcgcgcttacggttatagttactcgtgttaaatgcagaatgtgtactcaattatccatttctaaattacaatttacaatgtcccggcgaaaaaattagtggcctaccccactattctcctgagcaatggtctgccaactgattcataactgcatatcactacgcagaaactatgctgtttaaggcgtactgagcataaaacaaacataagatggcgattcttagaagcagtgaaataaatagttcatctaaaaaggagtcactaatttacctttatgagtgccatattttctacttcttgcctttttgctaggatcctcaatttcttcattccttgatactctgttccatcttcttgttttacccaccggaactctttcctgatgccagggtgaggagggcgctcccgaaacatctcgggctttgcacatatagctcttacaggccttggcatcccgccaattatgaaagggaaatcattcatcaagtctagtgcagccttagcttgtatttcgtcatccaattccaccaatgcagcagaaggaatgtcatacgggactgtgtaattaacaatgaactccacatcgacaacatttggacattgggcaagagctgctttaattactgagctcgtgacttgaggggaaagatgatcaatatagatcgtcctcttgaccttcttctcgaaatcagcatacgccttcttagcatcttcatcggatgtcaccatgggagcaggggcggatccaacttgagaacccccaaactgttacttgtattctgaaattaaaagaagagtctcttccagatctagaagagaagctagggttaacgaacgaacgcaagaattatccagacaaaagtagtcccgatgggagagaaagatgaatcagaaaggcgcctctcctcccttgttttgttcagctgcgactcgtcttggcggcgcaaggagcggaggagacagattttccttcttttatgccgccaaggtaaggagaagatactcggagaatagcgatggcgatgccgatgccgatgagaaggagcgatgggagggaagcagcggagattgcgcgattgcgcgtgaggggatttgcgatccgaggcattgttcgattacgcttagattcaatccggaccgggaataacaagttcagtaagaaatttatgatagatacaatgagagatcaggatttattttgggtcggaaaacaatttacttatgataaggacaataagagaccggaattagttccacacctcttgactagtggattgattcccggtctcttattgtccctattatgagtaaattggttcctggcccggaataaatcccggcatctcattgtatctatcataaataaatttcttgctatacttttcattcccggtccggattgaatcagcgtaaggccttgttcggggaccgagaggcccctcctttttcagttcggctaggggtagcgagtgtaggttgaggaactgggaatattagaagggatcgagggggtcgggcacgtgatctagcgggcgagacagaagggattataccacgtgatctagtgggcgagacggaagggattatacagattcaggccactaagaagcgtaataccctactcctgtgtatgatgatttttctgatatttgaaagcctctaaatctctggtgtacaagttagggttaagtgttcctattctaacttgttctcctccctctcactagacgtctacctccttttttactccaagaggttattatatgagttgggcgtgccgtccagcaagagagcaaacattctctatattaaatgtgtatcttgcgctacagcttggaaatcgtctgagcatcagctgtcgagcgaggccatcaaatcacgccggctgacgcaagccaacatggaggggggtccctgtcattcttcatttaatggttgtggaatggaggcttggatgcgcgggaatgacgttccggctgctgtgtctcccatcatcttgatgggacagggcatacctaccgcacgccgcctgacgtccgggcagagcagcttcagtcgacagcgagacgacgcgcttgacaacgtctccaaggtgttccactgatgatggatcggcggcggcgatttaggctgtgtttagattcaggggtgaaaatttttaccgtgtcacatcggatgtacggacatacatttgaagtattaaacgtagactaataacaaaacaaattacaaaatccgtctgtatactgcgagacgaatttattaagcctaatttaatccgtcattagcaaatgtttactgtagcaccacattataaaatcatggagcaattaggcttaaaatatttatctcgtaatttatatgcaaactttattttttttatctatatttaatactctgtccaaacatttgatataacggggtgaaaaacttcaagtgatctaaacaggcccttgggatttgtggagacttggggaaggacgggtcctagtcagcctcgctatgcacatcaatggatctacatccaccgattgattgtatagtagtactccgtatgtgctggtctggtagtttgcaacaatcattggcatatgtatactgacgactgtacacaaggggaaatctcgaaagataagcatactcagctcctgatcgatcgatctcatcaatctgcaacgaattgatcgtttggtataataacgaatctgactgggaaatacagtacatacatatttatggctgttgttggatccgcaaaaaggaaaaaagaaaaggaagaatgcacagatcagatcgtagagagaaaggaagaaagaagcagcaggaatggaggtgatccgaggagcaggtgataataatgaatgaatatgatggattcagaggtaaatgcaggacttgtcgagggagatgggcttgttgagcttggcggggttcatgaggaccttgcactcgatggcgcgtgtgaacttgggcttcaccagcgcccccagcacgtacgccctcgagtgcaccgtcgtcctcaggatcatcggcaccggagccatgctgccgctgcccttccccgccgtcagcgtcggccctccgccgtacagcggcaccttgttccccatcacccccacgctcaccgtcctccggctgctccgggcctggtagaacttgttgagatcgccggacgccagcgtcagctggctgtacgacagcgtgaacgggtccgccgtcacgtggatcccgaagaacgtgcccgtgttccggtacgtcagcttcaccgtcgagttggtcgtcgccatgtccgtcggcaccagcgacgcgtccgtccccgcctggattatgaagttgtcgaacgtgatgctctgcaatataatcaacagtaccattatttatttgtcatttcattctacgaagcactaatcaaatgaagaagaaagaagaatagttaccttgatgactatctgtggcttctgggagcggctggcgccccagaggacgagggcgaagaaggagaagaggacgacgaagccgaggacgaagatgaggaagtacttgcagcgcttggggatgcccctgcgctcgtcctcgtcgtcgaggaggccctcctcctcgatcacgccgatctcctgccaccccttccccgccggggcgcccttgcggccggagctggacttgtcgcccttgcgcttggggtggccggagaagcggctggacgaggagtccctgcccaccgagtgccgcggcgaccccatggggctcagcgccggcgtcgagtgcaccgacgtcgccgtcttctccccgtcatgcgagtccctcgacgggctctgcacgtagtacaccggccgcccgccgcgcgacgtcggggaccgcggcggcgacgatggcgccaggctcgtcacctccgagtccgtcttggcgtgcatcttcctcgtcttcttcttcttgatctgcttgctcctctgctctctctctagcttcttcttgatctggcagtggagctcgctaacactagctaagctaatgaccactccgtggtaggagtaatactaataactatagagaagagattcctaaatctaatacagtgatgactagcactagtagtacgtgacaaaggcaggaaggccgcggctaattaaagaataggaaagcaaaggaagcagcgtgtgttagttggatcaaagcgtcggtgctctttggactctggaggccaactaatttttagtttctttttcagatactagctagcagcactactagtggagtacaaacattgcactaccatgcataattagtatttagttttacacttggtttgtagcacattataccttcaaaaaagaatcatttttagtctatataaatgaagttatatcctactactatctattggaggaaagtactactggtatttattctgtaggattattaacaggctaatgtggggggtgaaaatgaaaatgcaaattttccgtataaagtgggtggttgcatgttacacggaagtgagcagagcactggtatggccatgtgacggtgatgtgccgggattcgtcggttgcggcatgagagagagagccggacggaccgacagttcatgcgaggctggctttcccattcccagccagctcaccatctcgcactcgctcgcagctggatcttgctttcctctcacctcttctgccctgccctaccctaccattccctcccagtcccccacatacacctaccatctactgcttgtaattacagagtatacatgtcacagtcaaaagccctcattgcaagcaaccacatgttgcatactcctatgtgtttaattagagtctcttcttccaaccaccattaatcacttgacacaaataatttaaagacaattgtgcggcaccaaccgctgaccataaaaaggtagtttatgcatctccgggctgcagg

SEQ ID NO: 80406 - DNA, 7007 bp, Oryza sativa
atgaatttatcaggacgtgacatgcgtccaggtccttcttgagctgcaggttctcctgacgcagctccaggatcttcaggttgttctcgaccatcccacggcgcaccatctgatggaagtcgatacgagccgcgtcgtacgcctccaccatgcgcgccaagtgcacaatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcgggagagccagcgaggatcactgcagtgacctcccaagcagcgtggggctctgcatcgtcaccctcctgctccggaagcggcctgggtatggttgttcaggatggttgggcctgagcagcatgggtgtgctgtttagtgttgattaaaattgatgattaattactctacagttttataattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaggagatctacagtgatgctgatggtgtggaggattaggtgtagccctggtcaagctgcctgtggagtggagtcgtctgcgccgtttatcttatttttccgctggttagatctttattgattgagaggaactatctacctctgtaatgacattttattcgcttattaattagagtaataattgtactctattatcaatttgttattgtgtgcctcggctgattcctggacgagggttcacacacatgtaagcatttggaattttggatagaaattccgggcgtgacaatattgataatgcttgtaatgaggaagagttgtgcaatgcttcacttaaatacatgccacaactagtgaaagaacacgttacttctatttctgaatatttggtttccactcaaaataaacgtgtctttgttattgctgatgaccaagaagatctgcaattattgtcttctttgtgtactttgggttatatcgaatttgatgttctttgtgatctaaataacttagagaagaaaatttatgattttccatgttattcttggaacaattatcatgtcattggtaaatataataatagaggatgttatatggtacatcgtgtttatatatgtttagatatgaatcctcctttaaatatgaaaaaatatgagacaccaaatgaatcgtacaatgttgatgctattggaataaattcacctaacgttgttctaaatatcgatgacaatattcaaggctcgctatcattttaagacatattcattcagtaggttgagttggtttcctcgtgatgtaaattggatttataaggattgcttgtttgctattttttcagttgatctttcctatgacgacaattgcaataagaaaccgaggacggtttccaaacaagaaggggatgatgatatgaccatcaagtatatgcatacatccaagcatgagaaatataaaacatagccaaagaatacaacgagtgaatggaggatctacaagatattaaagtccaatgagttttggcatccaattctgcctccggagacatcactgacttcaaacggacctagcgccttcatgccaatccgatttgggtgatcttggacttcgtggaaagcttatctcgctacctttcaaatgcatccagtctcctgtccaaattcatctcgagtcaacgggaatcgccaaaataagacagtgctattgctgaaaccgaacttgggctttgggccttgtaataggctaggcctatcttggaagtgtctccctccacctccactaattagcacataaccctagctttgtttttctctataaatagctttgtacatcctcaaaagcaattgggttttgtttagttgaattttgccaagtgtcattcaccttgtctctagtcctcgctcgattagtcggcgactattgatttagagccctcaatagttggtgtgatgatttgccgggtcgattggatctaccacttcaatcgcaactattcctttgtgcttaatcacctattcgcaatatttagattgcatattatcttgttcttgcagtgttctctcctttgcattacagggatcatcaaccgcgcatcacggttggtacgacatcgtttgtggtgtagcgattgcatggcgtcccagacttgttctggttggtagccacgtcgcaaacgtcgcacttcgatcaaagcgagatttatccccctcaccagaagattggaccacgagagagagcgtcatctcgtgctgtctagattacgggatatcattatttggggttatatgctgcggatgagaggtgggccgctgatggtgacagctcagtacgggtattcctccacgcgtgtatataatcctatgttaattccctggggagggtattcctccgtatttaaccccggttgtatggtcatgacgggctgtcgtaaggaactcggcagttaggggtggcttctcgaagtaccaggagggcatcggatagagagtattagctagtatatcagttaactagaatgtatgtatactatgtatactagaagtataggaatagattttttttctcttttctttccacttagcttagataatttagtatgagaatgagtagcttaatgtttgtgtgtcaccctacccttggattatcttaacccctgcttaggatatgattattacaagtaatatataaattattagtcaagttctctctacatgatcttcccacgggataaaataaatacgatacccttggaatactctcgggtgaaatgctacaatggtatatccgtgcgcttgcggatgaactctgtaaccataatataccaggagtatttctgcgccattgcagggaattatatttctagtaatgtcattaagaaataccaacaccgcctcaaccctttcggtcctagaggtttgtgcctccaccgactcgattctcctggcgagggccacggcttgtgccgaagcacttccccctgtcggcgcttcggcatcgctagcaggcggtggcgaaaggtgcctccttcgggcacaatgcgccgcggcgcaggcgaagtgggtgtaccatcagaagaaccttcgctgtcggtaaagccaccgtgatttgcaccacccctccattcttctttctagcgatcgccttttgtttcgccgcgaagctggaaatcgccaaaagcgtgttcgcgccagcaacatcttgcgcatgtacgagcgaaacatgagagctcactccagctttcacccgaattgggctgggggtatagccgtgcgacccaccgttttcatcgaacgcggcctctttttcgtcctcgtcctcatcgtccgcgtcggtgtcggccgcgtccttggtggagcgacgggttcgcccctggccacacttcgcaatgggccgcttgcgcttcttcgtcatcggtgaccttgaaggtgatcgatcggctagccaactcgccgacataaacttggttcaccctcccatcggcttgatgttggagcaagcggccgaattcggcggtggtcagacttccgaccatcttcgtcgcctccgcctcagcatgttccaatatccggactggacaaaaagggagtaagtcgaaacatatctacacacccagaaaaacggtgtgggaaggtaaaagaactcacgttcggcgccagggggaagaatgaggtgggggaagcccaagaaccttttcatcctcactaacacacaccccccattcgagggcgagcggagagatccgaagtaggcaaaactcttcacaaaggtcgtgggtacttagccgtcatgcaaccttgcaaagaagaatgagccgggactcgagtgtgccatcgacctccatgttcggcttagcgatgatagagatagcaagacgccgaaacctaagccagttcaccttaccatcctcgatggagtaaggattgtcgatgtagaaccacttctgcaaccagttgcggtcccactttgccatcgacacaggcaccgggcatgcatccgagcgctccggcgaagcatgaagttgacgcagccgaaaaccgttttctttgtccaagctggtgtgttcaagtccttggttgtggcacacgtcgtaaacaagacagcgaacaattcggcggtagggtcgaaaccgcacgtacagcacatccatgcgaagacgaccagcttcgggaacgctgacggactgagctggggacgctttgcctcgtacatctccagtacagaggggaggaaatcatcgcacggaaggcgaagtccagcggtgaggaaggcggcgaaaataaccgttcgcctgtcgccgggcgaagggataatggcttcacccccacaagtcacctggccctctacaagagcgccggagaggacgaattcggccaagttagactccttgacaagggacttgccaaggtagcacgaccacccttcaccgaggttgcaggggtcttcaccggttgacccggccttagtgggtttgcgaggggccattgaatccgtggcgaaagaagagcctaagggcgaaagggagcgagaaagtcgaggaagcaagcgcaggagcgtagcggtggcaaaaagctagaacgcaagcaaaggcaaggtgcacggagcacaactgcagtgaaagtgaaaagcgggggggggggagaagcggtaacccgggggggttatataaccacatcgcgcgacggttcaactaccagccaatcaggacccgacacatgtccgggggtagacaaaacggtaaattcccaccgggccaaggccaaacagtaaaaggccgaacgcaagaacagcaaggcccatggagcccattactattcagagtagtttaaagagcagcctagccccttcgccactaattggtgaacgcaggaagaaattttttcctcaaggatttttttaacacgagaacaagttatttgctttgcaggcgcataacataggtttcggcaagaccatcggccgaaaggggcgcctcgtggtataccatacgttttgcatggtctcggccgaagctccctactcacccttgcctatgaggggcttgttggaggtacaccacggggacattcggtcggacctaccgaaacccacaacttaggcgacaggcttagaccggaggcaaacggcgcaggtcgagaaggcaaccatatgggcgaaagccatggctcggaaaatgctgacttcgccaagcgaagacctcgtcaaagggccgcacaggcgaagatggtgaggcgaaagccttagcatgaaggcacgggtttcgccaagtaccgaacctcgccgtcaggaggcccagcaggccgctacgccttcggggaatttcgacaaatagatgggccaagccatttaagcccaataggggcccatacatgtaaaaaacattgtgtgcccccaataatgtccctatcataagggtaaccatgtaaatttccctgtaaaacctaaaccctaaagggggagcctgtaataggattataaatagccccctaaggccatgtaatacgggatccaaaaaattttactaagtaatgcaattgtctttcttttccaaccactgttgagataaccacgcctttcgacgtgacgcagttgtccattcgacaacaataatcatagctaattctctattattttagttatatttatggtcaaaatttgtctataacgaccatcaacaattatctacccttgccaaatcatgaaaaagagagagtttaggtattcatctactttcaagaggaaggaggaaggaaaactgatttgcagtagtaccaagggaggcagaggggagcaagctgcgagacgaggtggagtgtaccgtgcgcgatgagccggcaccaccgagaagcgatcaacggtgaactgcgacctgcccatagggcgacgagatgacagtgggctcgctttccgttccctgattcctaatttgccgagctaatttgcgggattaacgcctgattcctaatttgccgagctaatttgcgggattaacgagaggatggtagtggatgttcgacgcctcaagtcctcaacacccgcgtggattcgatgcaaggaacaaaaactaggagagtggggtcctcttatctgttgaactgggggcccatatgtcatacaattagtgatatacctgccagtattttatgagtggggtctagggcccccacaccttgtatggtaaatccgtccctgctgatgtattcagtacatactataagagtaaaaactgatactaatagtattattaatctgtatcacaaaatggtcgtatgaatgaaaaaattacaggctcaatcacacacaagtgataaaaaatagtcacaggtgaatcaaactagaaaagaaaaaatgacttagccaaaaatccatcatgaaactaggatccggatggctttgctggatcttgctataaggatggagaggctggtccgtgtcttgtgacaggtagtgaagagggcaaccggatggcaagtggtagtcgacgatggaatcatggaagggtgtagcggcatggtatagagatgggcgcaatgttgtgcagtagcagacatccatcatctagcaagcacgaaaaaaatacaaaaacattctcgttcatgtcatagatatgacgagtaaaagaaaaatagcaaacaacctccatcaccggcggacttcaccctatcctctgcagccagccacatggagcacgatgtgcaaatataagacctttgcagcccatcaattcagatcaagtaatattggaagtaatattggagattgcacgttaatttgatttgcaaaaagaaattggggcttcatgcatgaaggtaaaggagagtatgcatat

SEQ ID NO: 80407 - DNA, 23591 bp, Oryza sativa
cataagatcacgtacttcctctcaacccagccccttaacaaatctttaattatatgggcatgacccgttataaagcacggccatattattatcaagtgtttggctgtagtcggatgttggggtatattattattaagttttccaaaacgtatttaaaaaaatgctgttgaatgactagttagttaatgggaggtgaaagaaagaacatgagagagagagggggggaatgctgctactctagtagtaggagtagctaacaaccaagaggatgccatgtccttgttgcagggacagtggtggtaaggtaagaaatgcagcagtataagcagtaagcactccactcactcaccaaaagcagaaaaagaaagaaagaaagaaagaaaagggacaaggagattaactaagacacaccccacctacacactcttcttcctcctcattcaacaggatttttttaaatacgttttggaaaacttggattctattttactcctgtataaaatggcagtatattcaataatgtggcaattcaaaacatacctgtacgttgccaattgagacaaaaaagattcaatatgcctactagttacagcttgggctctaattttaaattttcgaatttaatttagggttttttttcaccgatttcatgagcatatgcctttagcttatataaaaatgcctccagcaaatgaaacgcgtcattaaaatcaagttactaccctcgttcattaaggataactaatgaaagtggttatctcttctagtgtcggatcgtattcctggttaatgaaaggggtgttgaatctaaaacacaacatgttttggatgactaaattaattaggaaaaaagtccaaacacccccccccccctaaattcccatggaagtccatctagcacccccaactttaaaactggatatccaacctctgaactttggcataccatccatattacaccataaggtggttttgaatgatggttttgcatattttgaaagcttaaacgaacaattttgaataactaatataacatatttgcatatcatcagttataagtcatcaatttatcctgatatagtgatatcctgctattattatgttggtatttgtttgtaagtgagagctaataagaagtggaaagaatgatttaagtcaaaattttaatatatatgtccaaagtgtataacatatgatcaaactcatctaacttatatataaattagataaaatccactatgtaaaaccaccttaggaggttatataaacggtattgtaaagttcagcgagttaaatgtttggtttcagagttgagagtgttaaacggacttccatccaaaatttagagggttatttggactttttccaattaattaactactacaagttccccctttttccttctgctattgttaacgaattttcaaaaaatatagatctcatttcagatcttttgatggtgccatctgtttattcattttaaaatattttcttcaaagcatactagacgaatttggaagacatgtttggtgcattgcaactaaggcaatgaataactagaaattaataacaaaatatggtaaaggtagtgaataatgataagggacaaaaaaaataaattaaataatgtacatatttatatcaccatctataacaatgcaaaatatatatttttagctgacgtaaacaaatatggattaaatttgtagtacgaatatgaaatggtttttatggagtaattgttttgcagctcagtctgttactctgtcatgtgtatttatgcaaatgtagatcaggtattgtttaaacagtcacggttgcctgaagttgaatttttccagcaaaatacaccaaaaattatgtatgcatgcagttttatgtaccaaacaaataagaacagaaataattggttgcagaagtcatattgaaccacaagtgaattgaattaagttatatacaaccaactgtttcttttctgacactaaaattaagagggaggtagcttgggcctgataaataattaagctgtgcacaaaatagggcccattatcctaccgatcgagaagaatctatctgtcccaatttctttcatggagagagagagagagagaagatgaacctctctctgcaattgcaatactaatttcgatctctttttaacgtcatgtccgcgccgaccaatttggcaatcattagcaccattagcgtaatacaacacccacggcgcaatgtcctcgcgtctgatcgccgattaaaaacacaataaagtcaccacctcatggaaaacacatataataaagccaataaataaatattttgtgatcaagggagtcagttaattataaatgtgccctgaagaataacattaggtgaactgtctaagagggtgctatgatcgacatattctttggtatcttgtggttgatgtggtggttaacaggttatcagtactagctaattaattaacaattgttaactgcaccggccgttgttaattaggtctagcctcttttgaccattcaaaccgtcttactagtgtcaatgtacgagtatatagtagcaactaattaaacttacatttcttcaactgattttgtatatgtcgccactgtcccttttcacaaggaatacaataagaaaatgttgtagaatctaacgagatgttgttagtgatgaggttgaatataatatacattataagaagatgcagttaattataagataatgtgggactaataatggtttttcagtctcttaaagattcccggggatataggtttggaatggagcagatgggcccatcaaatgattaccaagttgagatcgaatctcgactttaggcgccttcctgaacaaatccattcaacaaccacaaataaaacaactatataacgaagtgacggctgatgttgatccaagcttaccgacgaagcatataaatgttttttaggcaaacctaattaatttattataagcgggataacaattcacatctgatctatataacgttctgcacatctcaaaatacaagcttgatatatagtgagcatgatccgtcccaagttatgcgcttgttgctataccttaccgtaaataataaaccctgcaaaaataatctctaaaattatagaaacacataaatttaagaaaagtattcaaaaaacaagtaggaccagtactgagacaaacttttattattaaaatttaataaatcctttacacataactatttacgagtgctgaatctgtaatattggaaacaacactacaccagattctcacacctgtgacggcatatatgtgacgggcatgagtgttggtcagtgatgagggtcacctttgacgggtcctatgggatgccgtcatcggtgagccatcatgcggcgactcgtcacaggtaagcagtcacctgagacgggtcaaaaatggaacccgtcaaaggtgaggtaaagtcacctatgacgggccaaataaaaatatttttgacccgtcataggtgactgcttatctgtacatatgaggttcacatgtgatgtgagtacccgtcaaagatgataaaaaaattcgctctcattaaccccccccccctctcctccctgctcatcacgatcttatcctcttctctctctctctcccctcaacccttcttctctgagcgggcgtgcgggccggagggggaggtggcaccagcaggtgcacgcgggcacgcgggtcggagggagaggcggcaccggcgtgcgcggcccggagggggaggcggcaccggcgggggcgcgggtcgaaggcgaaggcggcaccggcggcacctccccccgcctcccggccgccaacgccatagacgcctccctcacctccgtcaccgaccacgctagccacaggatccggcctccacgaggccgggggcacgcagatctgtacaccaagtaccgcctcctccatccccacccaccgtccacctcggtgaggtttcttcttctcgttgtttttttacttaaatcttcttcttgttgttgttgttcatttgaggtgtttggtttgaggatgtaggctctaatggttgtttcttgcagcagaggagtgcctcttcgagatcctccgtcggccagtgtgccccttctatgaatgagatgatattgttgtatgataagttcttgccatccccttttgtgaatgattgctatatgagatctatcagtttgaagttttttgatggtgatgaatgtgactgtgatgagatatatcagtttgaagtttttgtgatggtgacgactgtgactgcgatgagcaaaccaccatagcagtgtgctccaattttcttgctagggttttcatacctgtgacgggctgcaatctatttttctttttttttggctgggttatagacatcactgacggctcacaaataatgggctatttgagataatagttacctgtgacgggttctatacatggcccgtcacaggggctggtcaccactaacgggcattcacccgtcaaaggtgagcagagtcatcactgaccactaatctctgacgaggggccgaatccgtcagaggtgatggtttaggcccgtcacaggtagcgtgatctggcatagtgtaagtacttaagtcccctttcaacttgatttctattagggcacgcacaacggcaattaatactaggcttttagagttgttaacaatgtatatttgctaatatgagagagagcgaaaaagagagaaatatcgatgttacggttaacatagactcttagtgtttataaaagaaaacgttgttccatgccgatggatcggagaaaagaaaaaatataataaaaaatgttttagtgcattaatttttagtcttttatcgtctcaattgtattgtcattaatcaccaaaataaacttaagtgcatagattgattttcacttagaacatgtccttatctcaattattttcagcacatctaaaaaaaattatgcatcagcttgcctaattcttttaagatcttttattattacactttccagtttaatatgatgtataaggaaaaattttagagattagctaaaaaactgtcgagtgctttttaagggggaaactttcaaatctagctatagtatataatttcactacaactatactataataataataacttatatatatattaaaataatatatgcaactttatatctaatttatatagagataacaatgtagtatgtagttatagtgtagttacactatagttacaatgtaattacaatgtaactacaatgtaactacagtgtaactgcaatgcaacaagcatgttactagaatgtaacttagatgtaacttgaacagatctaccataaacatgtgatgatgggactagcttgtgaaaagaggatttagatccgatagcaaaatatctcagcacaaatcttagcgtgaaatcaacggcaaaaaaaaaatgacagtttttagtcctgaaaactgtcacagttagctagcaaaaccgaaaattttattgtactctcccaaactattatattcttccatatcctcataaactactattttttgcctcagttgtactttaagttgaattttctctttaggataaactttatcttgagatttttaatcatttttttcacatgctagaaggagacttatttaaatcaaggggagcgggggtttctaaaacaacaccaagctgccatgacaactttaaaaaatattgttctaatgtaggatatacttggtcatataggatctataaaatttcaacttaaaacatatcaaggagaaaaatatatgtcccagtttaggggtacttttaagtagtgttggaggtaaaatgagataaaaatatatattttaaaaagtcaaaacaatttttttgtctttaaataacttttggtatctcaaaacttatagcaagtactgtggacatctaattacatatccctacatgacacatagaattaaatggtgaggtgaagggtagcagagaggagtgggagaaatagagtcacctctcatgtaagaggcacgctctacacaaaatcaaaaactgaaaatgaatagagtagttcttgtgtattagataattaaataactattgtgtatgcaattgtattgggtacaaatgcataattaaaaaaaactatattgtgaattggagttgtatattatatgtagcggtagtgtattgtatatgttacagtagatgatatggataaaattagaggcaacaattatctctactataaataaaacttcttactgaggtagctcagtgtttcatttgtctcatggtgcaattttaataacactaggatcacttcatcacctgcattaattggaagtacaaggacagataggcatgatcgatgaactacatcaataacgataatatagaacactctccatctctaacgtgtaattagcagctgcgctctacctagctgcgacgtgcacaccaagatcacctagccacccaacacctaaagtatgggcacaagcaactggccggatccaacgagatatcgatccacttttccttataccaactactacgtcgacgttcaatattcatctcctacgtcacgaaaaggcgaaaacgtaaccccaccatacatgcatgtaatagctatggagatcccattagcggcgcctcaaaccggtacggacacgactaatagctttgaaacaaaactagctagaaactacttggccggtggcacttttgctccactttattgaccttgaaaagcatgttgctttcgctgcttttctttgcatgatgttagttcagcgcacaaggtagctatagctactcgtatagttatcgtttcttactttcttaatttgcatgcatgagatcaacatatagttatattttatgctctgtcccctgcatatgtgtaggacacttgattacttaaagcttaatttggtggttacattagttaatttccaaagtgaacgggaaaaggaaacgattctgatgcgtactataagagcggcgggaaagataatgaatttgtatgtatatgtacccaccaactttagtacttctcatccgtccgataacaaacaaatctaacaactacaggatatgaatctggattagttacattatgtatcatgtttattttttatatataagactaataattcgtcgtgcatgagttatagcctggcatctatctatggtaagagatgcctatatttctgaagtggttaatttatgttgtttgagctttctgacaaggaattccaaggatcccataaaacccattaattaaacgagattttagagttgctagaatgtgttgtttataggggattgactcaagcttgggccaaggtttcgaccaggccaccctatttggcccatattactattaccttgagggaaaattaatttcagcccattaatccttgggccctggtgtcccaatccatgcagcaattgaagcaaaaagtacaccgaaggtccctcaacttgtcatcgagttacaaaatcgtcccccaaccgcaaaaccagataaccggcgtcccttaactaatcaaaaccggttacaatagatccttcggtggttttgaccccggttttgtcctacgtggtggctgaatcagtgtgggacccacgtgggccccacatgtcaggatgccacgtcatctctctcctccctcttctcttcctcagttccacctatctctctccgatgccgataccagccgatagcaatagagtttaagcaatcggctatatatccaatgtagatgatgatataaaggcaatcggttgatgatgatgtaataaaataacaatataatccagtataaaccaatcggtaaatagtgatatgataaataagcatcgatccgaaggttaaagcacacatcggctgaaggtccaatgtcatgaaatccacaagattagattaaacagtgaaacatttgttgtcatcggctaaatccaacttatatgtatatgcaatcctcatgagccgatgcaacgtccagataactcaccggctgaaactccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcaatttagccgataccggcagaaaccctaaaatgagaagcagttgatagagctaaactgatatgctaagactagattaacagagacatatgataaatagttaggcaaatataggatccaaaccagagcaatcgaagaggtcgaatgtactgatgcagccttgaacaacgccgacgtaaacgatacaattgtctgggccggcggaacattggacttaccccttagccggagatcgaacaccgatgcagccccgcgtcaggtgccaagtcacgctggacgataaaataaagtaaaaaaggtaaaaggtggcgatgcgccgaattatattgatcgtgaagatagattacatagaccctgggtgtacatatttatacccatgggttgatacaagtccttatcagacaagaaagaaactttcctaaagataaaaggaaaagataaagtccttatcggacactaaacacactttcctaaagataaaaggaaactaacaaactattcctaattaatggataacttgccatgccgcattctctttgaactcggtctcttctggataagattcctttagtagatcaatttccttaaccgaatatagcaagaatccgacaactgacgacttgacaaatctcatcggctaatttcaggacttcaaagccgatgctgactctaagccgatgactactccgggcttaccaaatttcactgttaacagcgcgttagctgtccccctagatttctcctatcttataaaccgatttcagggtcagatcccaggcttctaattgggccacatggcatctcttgtggagctctcctcctgattcttggttgtagaaagtgccacgtatacgcacctatccacagccgttagatgacgtatcgatggtgaaaaaccgtcctgtggacctaaatgtaaattacaagttatgagaggggtttttgtacaaacgtgcgatctcatctagaaaagttcgaagtattggagaaaaaaatcccagaaaacaattgcaagaaaaaatagattaatatctccatctccctactcacagtgccgcaggctgccgccggcacggtgtcacctgttttgggcgatgaggagaaggagggggcgatggctgctcgatctacgcggccggatccacggacacactatacaggtacacaagaacatcaagaatgcattagcagcaccaaccagcacgtatcttcagcaacagaaggcaagcatcttcgggagtggatctgtggagggacaagagaatacagccgagtcgggagatgcacgggcgcagtcggcactcgtgcggggaagccggggatgcgccggcgacggtcacctcctcggtccaggtctccgtcgggggatcgagatgagggagcgccgtagcggtgctgcggtgggtgcgctagatgcatccgtgtatgccgctatggctgggagtgtggaagttgtcttcccaaacgagaggcgatgtagaaagcaatggtggtgagttggtgacttgggtagagaggataccaatagaaagagagtacgtaatgaaacgtggaatgcatgcaggatccatcgcactgagttagcactctttttttggaaaaaaaaatctggtgcaaaccagatgcaaacagcagtccgtgcagccccgatgcggatgcatgacgcgtggatgaggcgctcatccgacggccggcccacacaagcgagtccgcatcctgcacggctcgactcaggtcgttctccctcagctcgacttgcgcggctcaggattacattgggtagggcgtgattagaggcggacgattagagcaaaacagattcgctacatggcaggacgaggagtccagcagaagagcacaggcgccgccgggcttctggtgccgtcgtctgatctggtgcagcctttgcctgccgtagcgcacgacatggcaggacaatcttcacatgaacacgatgtaatcgttggggatcgtggagccgatggcaagcagagaacgcaggtacattgcctagctaattgactcatgctttttcatcagtacatgcatgcatgatcgtgagtgatcgtcttacatgccctcatcgcaaatactgatgtgtggcttatacgtaccgatgtgtgatcatatcgtgcatgatcatcttgcacagatctccgagtttatgaccatggaagaagatgttgccggcgctatcgatgccaacgctaatggtgatgacaacacactctgtcgcatagtacctgaagagatggcagataaagcaccaaatcaggtaacgataatttaatagcaaattcgatggaaaacagaatatctcatactgtggtaatataactcatttatcgtacaacaggccaatgataaagttgcacaaactttgatcttgcctcaagttggaatggcttttgattcaaagcagaaagcgtatgatatgtacaacacctatgccgggaagattgggttcagtattagaaagagccaagcaaagcaccgagtcgatggaactatatactagaaatatatagtttgtagtaaccaaggacaacgatagactaagtcatcactagacactactaggacgagttgtgatgcttgtgttcagtttagtacgagtccattggtatgtatgcacactttaaatcgcattataatttttttatacaaacatctgaaaaaatggcatccacatcttataggtatattgtgcaagcatgcccttagagtcttcaatatgaatgaagttttcactatgccatctcaatatctactcaacaggtggacaaaatatgcgaaaaaaggatttaatattgataaacaaggaagtgagaaggaaactttgaaaacacatgctgcacgtatctctcgaaaggcaacatccatcgctttgaaatgttcagtttcgaaagaacttcttgatgatttggagaaagccataaataatttggacttggaggcagatagttctctaagcaagatgaaagaaaaaacatgtgaggttcctctaaattcaaatgactgtgttatggacacattaaatggtgcaatatcaattagagttcctcgattggtcaaaggcccaaagagtagatgatcaaaagatgcagttgaaaagaagaaacggaagaaaacaaaaactgctaagaataaaggtgctgatcctacccattccggcatgtttattcccattgtatgcttgtataattaatttttttatactcagatattttgtatgtttgaactatataggagaagatctaaataatgcatcagaagatgaagatgaagatgttggtgatgtgtgtgggcaatcttcgaccatggatgcaaatgatgtgtgtgggcaatcctcgaccatggctgcatatgatgtgtatgggcaatcctcgacaatggctgcatatgatgggtttgggcaatcctcgaccatggatgctcctttaatccaaggcggatttacaagtcttttatttggagttcagcaagattcggccatggctgctagaaagttacatttcaattaatagcatttggctcaacctacaatgagtaggctttttttgaatagattttcattttgcatcgtgttacactaaactatcattgacgctgtcagttctatccatgaatttggtagctatgtatgagatatgaattatctacattgtttctgaaagaccagcttctagacatcacattctagatttgaacttcaggatttcagatcacacaatatttcattttatttttgaaaggaatcagatgaataatcaaaattttcaatgcatcaatcacattgcagatttcagaacatccaacatgccatatgtatttcaaataaaagaaatacattgtacagattacatagcgatctgagtttccttgcaatttgaccaaaaatgcggtccaaacttacagcatctggactacaatccttgcatactcctaagagtgtacagactacattgtatggattaacagcgaaggctacattcatcaaactacaatccttttagcaccatccacttctgcctgctgcatttacaatccttttaggcaatcaattttcctcttttgtattttgcacaaggttacaatagttctcaggataacttgacatctggcaaaactagttctcaggatacaaggtgttctgaatctttacaaactcctaatagtgtatatactacatagtaggaattacaaagaaaggctacattcattatcttgtcattgattgttctatgtcacttcttcagcatcctctcgttcatgctcttccaatcttcaattgccattcatgccgcaccccatatatctcacctgcaattctgcattggcctcaagttgccagctgccaagtgtgccaagaacaaatatctgatttttgcaactgattgtgctgccatgtagtgcatataaaagaaaaaagagagaaaccaaatgtggttcagttcagatttggctctgtcttgtagtgacagaaaaagagaagccaccaggtggttcagttcagatttgtcagggggaagccaaagccttatgtttctctagttgtttcaactattttcagtggaagtgtcacagctgaatatacaacatgcaacatatcttactcctccactatgcaatttattcagtgtgatactcaagtttcagatttttgcctgttttctggtgacctattcctagtcaattttgatgtgagcctactaccccactttgcaaaatgtccaacaattttactgatatgatgattggtcggccaggcaccgagcgagttgccaagacagaatgtatgttttgtttatgcaaaacaaaaaccgattgtctcaaactagtactaattaacactatcaagctgcaatgatagatgctaggcttactacctaatcacatgaaaaccaaaactgagcaatcaaaccagaatctagtgaccatgattaactaccgcaatgaaaaccaaaaccgagcaatcaaactatgaaactcccaatgcacgggagggtgccgcctggcccttccaccgtcgctaccctgctccaggcatgggagggcaccgccactgccctgctctaggcacgggagggcgccaccactgccctagctgtccgagggagccgccgccgcattccgtctccacgcgcccaacagcggatgagaaaggggcgacgggataagaaacaggcggaggggaacgatgactgcatctcggactagatcgacccgatcggagcgagcgcgagccgagttgtggtgtgttgagatcgctcttgagctgagctgagattgaggtgcgatgcggactcgcttgtgcgggccggccgtcggatgagcgccccatccacgcgtcatgcatccgcgtcggggctgcacggactgctgtttgcatccggtctgcaccagatttttttccctttttagccacttaacgatctgtttgttgctggaggttctatctagaacagtgtgcacagaaaacggagcgatctattagcacgtgattaattaaggtggtgttcttttctcatgaagatgaatattaagttttttacgtaaaacgaggtgatactagattgtgttttaattattacaaacttaaaaattagattaatatgatattttagagtatcttttatatagaaagtttttgcatgaaacgtatcatttagcaatttgaaaaccgtgccacgaaaatcttaatcttcatccaactcttgttggagaaaagaatgggacctagtattagctattatttttttcaaaaatagatcaatatgatttttttaagcaactctcgtatagaaactttttataaaaacacatcttttagcagtttagtaagcgtgcgagcaaaaaacgaggcgggggagctggagctagaacgaacacagtcgtcttgtcacgtccggaatttctatccaaaattccaaacacttacatgtgtgtaaaccctcgtccaggaatcagccgaggtacacaataacaaattgataatagagtacaatcattactctaattaataagcgaataaaatgtcattacagaggtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaataaacatttcagaatttaataaaatagttaagtagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgttcataactgcgggcatggctattcgaatagttttactctggccagaggtataccactgtacccacaagatacagccccacaacatgtcaccatgcgcctcaataccaccacggtacctcagaaaggggctgtgacagtacccctcgcacaacacaatccaccacagtgcaccattcctggatcataatcacccccttataaacaaggcatgaactccccagcgacccccgtgggcttatcttcgccacttctcagtctggtgctccgcaatgaactatgctatacaaaaggtaaagccgttgcccacgctggcttgtggttggcacggttaatgtttcacaaccgaaactcgtgaaccagtccttaattgtcatgagcacgaccatcaaaaccatgtgctcacaacccaccattatcaagttttagttgacaaattaattaattaaccaatcacgattaactatcatgagctatcattaagccatcattaaacaatagtgagtcataagttatcccaatagtgtactaatgtttctaagcatggctaagcaatcgtatctaatatctagctgaaccaatatataaagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggatgtttgggatctgtgtgacttgccttgctggccttggaactcttcaaattcttctcctgcaaaaacggactctccggaaacgtcggaatctaaacagaaaggatcaaaatcaccaaacagcacataaacaagcatgaacagtacatgtggatatttttaacatgtagatcccaattttagaaaaatttagagacttgaaccaactaaatccgagctaagatgaattagttatgaattttcaaagattaaatcggattaaatcacttatatgggttttaattgaattatgacgcaataatgaattatttttgaaaagggaaaaggggtttattgtgtcagcggctagggtttgcggtggaccgggtgcacggcggcggctcacagaaacgaacggccgagatccatccatccaaaactgacggccaagatccatcggtccacgaccgggccacgggggacgacgacgatgacgtcagcggtgacgtcaccaccggcggcggctcgggcgtgcaagctcaccggcgaacgacggcgcgacggcacgaacggagggcaccagcacgtagagagcgacgcggcgaactaccggtgaccaaaacggcggcggaagatcaacggacggcgacggcgtcgaggaagaagcggcggcaaccttcggcttgacgacgacggcggtgctccggcggtctacagcaacgatggaggggcggacgaggacggcgacgtgacggcgaccacgacggcggccttcccgagcgacggcgacgactggagcgacggcgacgcacggctggagcggcggcgacgacggcggcacgaggtcccacgggtctagggctctacgggcgaagagagacgaaggcgagggtggcgacgggtagcggaggacctgggggtgcttaaaaaggggctaggcacggcggcgaaggcccacggcgaccggcgacgcgaaggaaaagattagggttcgggagagagagacgaatccgattcgagatcgaatccgcgaatttccaaagcgatttagacgatgtttccaaaagggaaaaggtagagtggatcacagggatcctttcccctcaatcaatttcaccggaaatggaaaggggcggccggatttggaatggcggcggcggtgcggcgcggctagggtttcgtcgggaggaagacgatgaccctgacaggcgggcccctcctgtcagcggcgaacgcgcgcgcgggcgggcggctgcgggccggcttgggccggggagagagagagaaggttttcggccgactttcggcccaaagccaaaagagactattaaaacattttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaccagatcttctcttctaggcttttaaaataaattctaataattccaatttagacaacaatttatatatttgggatttttagggtgtgacacgtctttcgaactcatatacacaaatttctctctttaatatatatatatatatataagcaataaaaatatgcttattttgtagtattacttttgaaaccatcaattttaataaagttattgaaagtacaataaattgtcatcaacatgattagcataaattaattattttattcatttagttagataacgttgatatttaaatatatgtctgaccattcatcttatttaagatttttatgcaaatatgtaaaaatatagtcatattcaaaataacattagtaacaatattaatcaaaacaaaacaaatgataaccatatattttttaaacaagattaacgatcaaatgtagatttaaacgcaaacataaaaaatatagttaaatgtacaatataaacatatccagaaatacacaggttataaataaaacgtgccaaacggcgcgcttattttctagtatatatcccttgtaagccgaaaggggagagtgcgacagcccaatatatcccctgcgtttgtatccaactcctctatactgatcattgtcaatcggtgttcgtggttttttcccacgagggtttttcacgtaaaattcgtgtcttcgttgtgtgtccattttcataacatcgatgaccctatagagcatggagatctttaaccatagggatgaaatggatgagtgtttgctgggagaatcgcagaactatgcagcgatggcatccgactagaactttttgtttgactgggatttgcatgacatcccgtaccacaaacccagagatcctgcagtgagaatcatggatatcagcaaggatttgatgactccatacaggaatcttgattagtcttgtagaggcgtaatttccaaagagattagttgccatcgacgctgcacggagtgattttggggaaaaatcatggagaggactagacagtaggagagaaaaggaattaaggtgttatttgccaatttaccggtgtatgtgtttgtagttttatatgaaaacgtccatcttacattataaccgtccgattaagatagaagggcgtacatcgcctgagtgcatgagtgcaccagggttggtgggtgcataggacacatcgcccatatcggtagcaacatccgcatccatatccatatacacaatacattcaccattgacatatatctcccaaattcccaatgcccaaaattgaaaattggagagtgtgagagtgtgtgtgtgtgtttgcgtgtattttcttttcatccggttgatagaaagaactcagaatcaaaccggtgaagggagtcccgagcacacccttccatcccaagcgtccttcctttttttccccggttaaccacccactcattaaagtggctaagtccggcgggaacttatcgaccacatacccactattctttcccgacgcctcctttctcttgcttgatggaatagttcaatgcttgagctcctgctttgcttgcattcttcactggggcttgctagatgtatcactcatcctgaaaataaggcaaggagtctgaagtttcttatgatcattacgggaatgaatcacataagttgatttagaattgctcgggaattcattgatagtgattttttttcagttctaggggggctagtgtactcctcttttttatcaatcgagctcctcattctactcgtccagccctcttcataaatttgtacaatcaatgccacgaagatagcaaactcgattgtcgaatatataaggaaagtggcgacgatttggcaccagatatccggttgtgtggaaagaccagctgtgatatacacaaaaaccatcaaacaacaacgattgctcgtgaaggtttccatagaagattccctgttgtgaattcaataccaccttagactggaaaaactattcagaaaaacagaaaagtgaaggctatacactcacatatccgtctagaaagggaaaggcgtcggtacgtcagctatggatatagaataggctatggagcagagacttaaagtatttaccaagactatacaaaggaaaaagtcagcgaaagtgagcacgtaactaagaaagccggtatcagaaaagaagcccttccaaaataaaaggcaaagaagtcaatgattgaagcagcttctctaataaccccgttgaataagaggccgaaggctttttcaaacttatttatagagggggggacttcgacttttgttgtcatatgacaaaaacatctgccgaagggcaggcttcactcaagcaggtggaaaatgtaaatgggaaaatgtattaatctctcaaaaattggatcccctattacatatccttgggatctacttatttacagccttgggtttacaaccctagggttcttctatactaatgaatttacactgcccttgtggtagggacatttacaaggacaacagaaatcttttggcctgacctaccgacccgtgggccctgaaggcccactcctaggctgcttattgggcttccttgagcaggggtcacatgtcgccgaaccggcttcgccactcagtggatcggcttcgctttctactggctgagctacgccaactgcgatccggcttcattattccgtgttctgctttgctattcagtggatgttggttcagtcgaatgtcctcatgacatgcctccaacaagcccctcacaggcaacggtgattatggtgcctcaaccgagaccgtgttcgacacctggcaggatatgaggtgccacctttaggcctatgttctagtcgaaacatgttaagaaaagaaaaggtgtgaggacccaaaataggacctcccgtgtataagtgttaatctaggatcaagctagcacacacagacacaaagataatatcacagccaacataacgaaggaaacctaatatttattaataaagtgactacgataagccttatggatagattttaccactacaagataattaagctattgccaccaaattattacaacaaaaaataatttgtagcaatatattacactattgcaatgataatttttctatggcaaataattattttttattgcaacgatctacaatcgttgttttatttagtacttttgttgcaatagaaaatgagatatcgccacaattttaatttttgtggcaatttatatagtacatggtacttttcactattttttgttgccacgatcaacaaattcgttgcaataaaaaatttatcgtctcataatttaacttaattttttcatatggacacggattaagacaaatttaatatggaaattatagctctcgacgatatctacaattttataggtgataaatttttcatttgaaatcttttagatattcaaatctcagttagctaggctcaaatggaacgatatgcattttccaacagaattgatgcgtaggtgagttggtaaaggagagcatgcgtgaaggataggtcttgagttcgaatcctagccaagacacaaaatcaaaaaaaataagtagataaatagataggatgatagattaatatttgaacttttaatttggtacgtaaaactaatgccacatatggagtggtggcaataatttttattgcaacaatgtgaagtgttgcaatatgaatttttgccacatccattccgtggcaacatttaaatttattaccacaaaataaaaatcgttgcaataacctattaccatgctgtttattaccacggctagcaacgattttacaattgtggcaacatgtatctattgccacaattttagtattgatgccatgatttttttcgtggcaacaaatgatttttctagtagtgtatacatttattttgctacgaagggcctaagaaaataataaagtagcagtagaaataagataaacgaatagaggttctattcaacttgccacaggcggccaactgggacacatgtcctactcatcttcagcaacaaactccttgggaaacagcggaaacatttcttctggaattaggggaattgcaaggtgagtatatggaataaaaaaagtacatggaaatatgcatatgcatggctgacaaagaaggcaatgactattttataaacaatttataaacaaatgtttaaaacaacatttataaatagtgtgtaaccaaccatccatccacacaagacatgtccacatcggaccacatagctatattcattaacctgcacaaagctcattcccagttttcacaaactacccctcatgagaaatcaccaagtacatccatgaccgcggatgtggctatttgaatagattaatttaaccatacagaggttgtacagcttaacccaaacgatacatcgttcttttaacggtcatgcgcaagtgtcacacttcaggttatgtgcggccaaggagtctgtaacaaggctctttagaaacttcgcctcaacatttcctttcgccataagatacatttctctcacacaaacaagaaagtacttttcgctaaccttaacacctatcatctagccacctgggccaacaatgccaagacttggaatcctattaggccaggttcttcccatgagaacatgtggttgcacgttacgctcagatcaatcgcttatgaaataaagtctttaattgatcaggacaacatgccaaaactacaatagcatagggtagcagcttaaggacacttagttggccctttgagcaactaaataacacacagcttgacagtagactcacacagagaccataccaggtaacaatcacacacatacattactacctaaccaggttcacacagaaccacccatcaccccaatccaatacgtttgtccacctgttgtttacaaaaagatagcacacagccacacaattcatataaaagtaattataagtatatgattaatacaaattatattttgcttgtaaaacaaccttcagaaaggctaagcataactactttactttgagttgagcccaatattcaactcataaagactaaggtgacaaagtatcgtaggtaatcaataattatcaaatgcaggataacaatttggacacgctacccattgatagtttataaacaaaaataatatatgtattaaaaacattttataaattgggttcaatatgttcaaagaatatatgttcaaagaatgcactgcatcttctgtagcgaactgctcctttgctccaacatctagacgatcacaaacgagaaacaaataaacaaaataaaatactaactaaataacatcaaatgaaatatcaaactgaaccagaaggtacagcatgttttagatgaatttaggaagaagaacaggtcaaatcggagttcaaacagaaaagttataacctttggagttggaaattcagaaaaaatcctaggataaaagaaaaggaatatttaattttgggaattaaattacttttaacaagaaatatttgtggggcccagtggacagtggctcggagtacggtggattgggtatatgaggaatcggctaacgtggacaaacacgtggcgacacatatctacacgttgcgtctatggatgacagggcgatgatgcggatagaaacgtggaaaaacacgtggcgacacatgtcgacatgtggcatctatggatgatagggagatgatgcggatggatctaggccgagctgacgtggcaaggaaaaggattttggaaatccaacggtggagattggatctaggggatcgagcagctgagattgcttgcggtttttttaactgcttgacccaccacgccatggcatgctccagcgcggcatggtcgtcggcagtgcggtggcattcggcagctgaagcatctaggcccccgtcattgattttggtaattaatgacaagcgctaattgtggactaactatttccttgagttatacattttgatttaggaccacgtaatgtgtatgcatagaggatcaccgaggactaaattcgatggcgcaaagtaaaaagaaggaagacggtaaaactagaggtttatttttaattgatcgaggagttgggcgatcaaaaatttgctagttttatttaggaaaaagtacgaattaccccccccccccgcgaactatcgcggtcgtccgaattacccccctgaaccacaaaaccggacattcttcaacccccaactatgcaaaccggacgaattaccccccctcgacccaatctgcggtgattttggactacgtggcgtacacgtggcagtccagtcagcattctatttataaaaaaaatgtgggacccatatgtcatacactactctctcttttctctcacaatctatctctctcctcccggcgacggcggaggcagcgagcgcggcggagaaggcggcggcggcgacgaggcgagggggcggcggaggcagcgagcgcggggaggcgagcacggcggcgaggcgagcggtggggcaaggcagtggaggaggcgacggcggcggggtacggcggaggaggagagtgcagcggcagaggaggcgaacggcggcagggtgcggcggaggaagcgagcgcgg

SEQ ID NO: 80408 - DNA, 10138 bp, Oryza sativa
  unsure (1)..(10138): unsure at all n locations
ttggcctccctcctccgacgtcgccgggaggagagagagtgtgtgagaaagataattcatccggtttgcatagttcggggtgaagaatgtccagttttgtggttcaggggggtaattcggatgaccgtgatagttctagggagggggtaattcgtactttttccttttatttgtagctttgccatactatcaagaggggtaatgacataaacaaagagatgatcaaaatgccacattaggtcatttgcatttagacttggtttgcttctatattcgtttgcattattctgaccagggtcggtctgaccgaggctgctataccggtcaggccggagtgtatcagccggtctgaccgatggatcggtgccggtctgaccggccccctggaagctggctgtgtgctggtggttgcactctagggtgaaaaatccgagccgctagagccgcagccagtcattccgagccggtggcggtctgagcaagcctaggccggtctgaccggccgctatattgcggtctgacaagccccctggggttagctcaatgatttccctttaatggctagttctctagcgaatacaaagtagttttgtctgaatgcccacactatggcaatttgatcggcagtgcactgagttggggattttgacccccaacggctactttttgtgggtgggagtataaatactcccccaccagtagcaaggggactctcttggcacttgcttcacttgcatacaccccttgcacactctctcacacactcgagtgcttgtgttcatccatttggagtgattgagggatgattagccaagagtcaagtgcatttgtttctttgtagagctagtatggtacttgattatctctgagccgggtcatcgcttgttactcttgaaggttgccgcctcctagatggcttgtggaggtgttgcccagtgacctctccaaggagattgtggagaaggcccggcaccgtttgtaagtggtttggagttcacgaccttcagagtgaaggaagaactacccctggtgaacgattcttgtgtagtccacttcgtgggccggctcccaccttgcccaccccttgacgaaaggggcttgtggtggcttcgtggttttgagcagagaagttgggcttgccacaacggggagtaggaaactggcgagtttccgaacctcaggtaaaaaactccttgtctcttgtctcatttacttatagcatttacatttgtgcaatttactttcaaagagacatatttgagcccatatcaccctaggattgcaaaacttaacttaggtatgcaatttaatttcatagagacatatttgagcccatatcaccctaggtttgtaaaacataacttagtttcttagttaactttgtacctcaccaagcctagcaacttatgttagtattgattaggtgtcatttagttttaaatcgcctattcacccccccctctagtagacatctcgatcctacagcaacgtcgacaagaagaggtggaggcggaccaggtggcgtagcacaagacttcaaggcgacgtgaaggcggtgctcggcgagggatagcggacgctggagctggggaagagaaagggacggtggcagcggtagcgacgggacgtctcccgacggcataacgaagcaacgacaatggcagctactcgcagcggcgatggtggcggcggcttcgggaaaggagggaaaaggggtggcggccggcggctatttacagaggaggggagagctaagattagggcggtgcatgacatgaatttttgaaggtggtgccggttcttatgggaggcggcggcggcgttagttgggctcgggtcgatggcggtgtaggccaggggcgacgtggaggggaggaaggtcgggctgagggcgatgatgagggctcgggcttggcctccctgggcctgtagctagagaggaggtggccgaccggatgtagaagaagaagggaaaaaaggaaaaagaaagaacaaggagggggctacaaggaaaatgggcaattagagaaatgaaaggaaggaaaaagggaaatggatagtgacatttctggaaaattccaaatgtgaaatatttggaattttcaggagatttatgaattaaggaattgaataggaatatattggatttgggcagaatttgattaggaattttagctccacttctgaaatacaaattaaatccaaataactccaactaagaacaacaaactgtaacatcccgaaaatttacaattttctaatcttgcatcatgctgattcttatgttcttaataactttttaaacctaggaaaatataattagagagacctcctgtcacaccctgaaaatttaaaatatataaattgttgtttaaatggaatttttagaatttattttaaaagcctagaagagaagatctatttttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacccttctctctctcttcggcccagtccggcccagtctgtagccgcccgcgctcgctgacaggtggggcccacctgtcaggcctgtcgtctacctccggccgccgccgcccgaaaccctagtttcgcgccgccgccgttcctttccaaattcggccgttcctttccgtttccggtgaaattgatagaggggaaatgatcctcgggatctcctctaccttttcccctttggaaacatcggctaattcgttttggaagttcgtggaatcgagttcgattcggatcggcctctttccttcgaaccccgatctttccatctcgtcgccggccgccgtgggcctttgccgccgtctcctagcccctttaaaaggttccccggtgtctcctctacccgtcgccaccctcgccttcgcctctcgtcgtccgtagcgccctagcgccgtgtaacctcgagccgccgtcgctccagccgtgcgccgccgccgttccggtcgtcgtcgtcgctcgggaagatcgccatcgtggtcgccaagtcgtcgccgtcctcgttcgctccttcgccgccgccgaagaccgccggagcaccgccgccgtcgtcaagccgaaggtcgccgccgcttcttcctcgtcgccgtcgccgtccgttgctcctccgccgtttctttggtcaccggtgggttcgccgtgccgtccgctacccgttggtgcccttcgttcgtgccgaagcgccgccgttcgccggcgagtttgcgcgcccgagccgccgagccgccgccggtggtgacgtcaccgctgacgtcatcgtggccgtctgccgtgagccggtcgtggaccgttcgatctcggccgtccgttttggatcaagtcgatctcggccgtccgttcgcgtgaaccgtcgcccgtgcgcccggtccaccgaaaccctagccgctgacgcaataaaccttcttttccttttcaaaaataattcattattgcgtcataattcaattaaaatctatataagtgttttaatccgattaaatcttcaaaaattcataactaattcatcttagctccgatttagttggttcaagtctctaaatttttctaaaattgagatctacatgttaaaaatatccacatgtactgttcatgcttgcttatgtgttgttttggtgattttgcttctttctgtttcagattccgtcgtttccggagagtccgttttcgccggagaagagtttgaagagttccaaggccaacaaggcaagtcacacagatcccaaataaccctttgagcatgttgatcctatttaaagctattgtttctattcaactattgcatttattttcgaatgtcattgggtggaattaacctattctttgttatagcctttttgttcttgattactttattccttgataccttgggttattataacttgatctagttgagctttatatattggttcagctagatattagatgtgattgcttagccatgcttagaaacattagcacactattgggataacttatgactcactattatttcatgatggcttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacatttaccgtgccaaccacaagccagcgtgggcaacggctttaccttttgtatagcatggttcattgcggagcaccagactgagaagtggcagagataagcccacgggggtcgctggggagtccatgccttgtttataagggggtgattatgatccaggaatggtgcgctgtggtggattgtgttgtgcgaggggtactgtcacagcccctttccgaggtaccgtggtggtattgaggcacatggtgacatgttgtggggctgtatcttgtgggtacagtggtatacctctggccagagtaaaactattcgaatagccatgcccgcagttatggacgggtctaacaatgtctttcgtgattagtctcacacttctcattatagtaaaagatgctataactgataataatttgattagctcctggtttggaatggtacattcctggttggagatagaactgtgcagccggggtggctgttcagaatggttgggcctatacaacagggtatgttgtatagcgttggattaatattgtttaattattactaactgttttattaaattctcaaatgtttgctaaatgctgcttttgcaaatgaaaacctattatgccatcctttgttatcttgagcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgactttttattcgcttcttaattagagtaataattgtactctattatcaatttgttattgtgtgcctcggctgattcctggacgagggttcacacacatgtaagcgtttggaattttggatagaaattccgggcgtgacacctcctaaaactaacttgcataaaaccacttattttatttaatctcttttatgacttttatttaaaacctatcttgaggtatttcttgattcgatttcgatttaaaactttctttcgctaaaacttcctttatttaaatttagtttgaaaaccctttttacctttatgaattatggtccaagcaaccttcccattttgtgctagaatttaaaccgaagcaattccaattttattggaattaattgttaaacccatcctttgatcttaaacctatccttcgattccaagcatatccttagttccctttccaaatttcaaatatctaaattcctccctttgatctagccatcattaatctctatggcttgatttcctattcggcacaagaatagcaatattgcaaatattgtgaatgattgctcttgtgctaagaagaatagatttttattttatcctcctcttccaaattgattccctattagccaaaaataattcttcaaatatttctgctatcaaatctaggattcaaaccctttttatctttacctccaaccattttcctccgaatatatatattgaggaattatattgttaattcccctctcatttgagtgctttgatatttagtccattatattctatctccaaaaacattgcactcaaataaattggaaaatccctcctttgctaaatttccttccaaaacttcctgttcaaattatttgcagccatccaaacctctataaaaattagacttcttcctttttgacattgggccgaattccccttttccctcctctctttcatgcggcccaagtcggcccagcctcagctgagccgcctcctctctcctcccttccttctgtgggcgccgccgtgcgccatcggagcgcgtgcgcgccgccgccaccttgccgtcgtcgccaaggaatcatccatgacgtcagtcgccgtgccgtgctcctccttctccgccgccaattcctctgcggccgccacgtgcacgcgccgccgttgccgaccaatcaggagacgaggccggcgccgttttctttttccctacgcagcggcgccgtgccttcctcgtcctccaccggcgaaccgaccttcatgaaccgacgtccaccggctataaatagccggcaaacccctgctcttttccccatccgagccttgagctcttcttcttctctctctcctaagtccggccgacgccgccatcggtcgatctcctcctctatagttcccctagctaaatccttgcaccactgactccccctccctccggcgaacccatttttcccgtttttcccttctcccccaccccatagcaaccaccacaaccacctcctttgcagccgaagagaagctcttctacttgccgttccggccaactcctcatctccctctgccggaaaccatcctccccagatgcgcgtcgtccgggaacacaagttgccgccgacgtcgctgatccccggccactggagccccagcgccccttctctctctctgttgttacacgggaagaaggagaggaggaagatgacgggaggaagaagaagaagaaagaagagaaaaagaaaaagaaagactgacatgtgggcccctgcacagtaacattttgtattttccctatttaattcaaatcctattatttagaagcccatatctcctaaaccgtagatccgattccagtgaaacttggacctaaatttatctaaattcaaacccaatcttttgaccccaaatttgctcttttaatattttatttgaatttattcaaatactgtttgaatttatgtttgccttttcaaatatttctttttaatccaaaataccctttagccactaaaaagccgccggttggaactttacgccttccatagcgacgttctcggtttactatccccgacatcggaccgttggttgtaaagccaggcaaaacccaaacccaaggtcgaagtgctgctcctggcaccccacgcctcgatgcgtatagtggtcggagcttcactattccctcgacctccacagcacaccacacagttagctcttgggctctgtgtgatcctagccgctccgccgccactcacggttgtcggagtaacacttcctccccactaaacccacacaaacctcctatccctctagccgttatactctatgttgacaccggctagagaagataccaattctagtcattatactgcccaactctagcaacgaccagcaaacacctaaaccctagctgatatttatcctacctcaatcagcttgctatccagaccccacgccagctagaatatcatcacaaccatttaccctccaactacctataacctatacatgaaatacgagccgatatgctatcctatttcagcatcgactcgagaacaagtaaatcctggccattcttctaccaaagcccaacttcagccaatactagcccaataatcccaagaccctataaaaaagataggctataccctaaaccctagcccttctaaccgtttcttgctttcttgctattttatggcttttattgaatttggttcttcttcttcttcagtagagtctattatatttggatggtaacctgtggtatttcgagcattggataatcaggttgcctatcttgaatttatttgcgttggagcaaggcaagttattattcctctcctttgagcattattatcctatattctatatctcgaatatctcatgcattagtcattcatgattttgaatgcataacctgaacatatagcaaaccagatatatgctagcttttgcttagccatgcctagttagactgcataaaaatataatgaacttagattggaacagtacggtagaaatggttgatttccgggtggctagtactgttccaaccgatataagacagccaagtacatgtgaagaacatatgagtacgaccgcaattctcgtatgggcatagacctagctgattaagttatctagcaaaggtggtacctctgtatagtggttcttcttaagtcctcgcgcaggaggcaaatttatgccgcgaagggcaattgtgatatttaccgaggcacaggtaaatatatgagatttattgacgtcaacttgtttgtgaaccctgattgcgatgacatggtgtcatacaatcagttctctttaaagacctcgggaacgccagaactcctctcgctgctaataacgttacgttcagagcgtatggggactagagttcatggaacaattaccactgatgttagtaaccgaaaagctttgccatgacaaggctaatgtgtttggcacgtcatggattgcgggtaaagcgtacatctactgcagtatgaatattcttaaaaactattcgaatagtcgtgctcacgggtatcgggcattgggactcacaatggcatcttggttagaaacataattccatattttattaaatactattgcattacaaacatcatagactttatacttctacattctcagcctttctgcaagtaaacctagctctacacagatgttaccatttcatgcattcattgttgattaatataatagcttgctgagtacgttgtactcacccttgcttcaacccctctttttcagagtctatttggagtttttgccgaagctgggaattcaatcacataagttagtttcattctaacttaattcgcaaatatagattagacagatggtttaagtctatagccaaacattggagttaagtcattctatagcttttgctgtaatagttagccacaaccttgtaaataccctattattttatataaagaaatctcctttggagccttgatcaaatgtatgcgataaagatccagattgtttaacctatatcaatctactgatttagggcttgatacagttaaacatgtcggtttccgaatcattagttctgggacccaacacaaacccaacagcataattcatcactttgaattgttttgatttaatgaaagttttattaagctaattttaggcaagcaaaccaaaggtgaattttcgcaaataggcgaaaagaaaggaaagtgaaaaaatcaggatgtgacaaaccttcctcccttaaatagaatctcgactccgagattcggactagcttgggaacaacttcggaaactctgccttcaaatcatcctcacgctcccatatggcttcagcttcagtatgatttcactgaactttgtagaaacaaatgctcttactcctcgtagttccctctacaatctctagaatcttgattgaaacctcacgatatgtcaaatctggttgtaactccactaactgcaacggtgtttcctcttttcgcacgcgaagacatttcttcaactaagataggtagaacacatcatgaataccagacatcgaaggcagcagttccaactgatatgcaacttctccttgatgagcaatgatctggaatggtccaatatatttgggggntagctttcctttcacctgaaacctcttggttcctctcactggagtcaccttcagatacacataatcttcctttttaaaggttaaatcccttcggcgattaaataaaccctattgaaataaaccctattgaaatgttaataaggcctacctttaatctatcccttattagagcaactctctttggcctcacagattacatttggtccaaaaaccactatttctccaatcctatagtagatttaatatgcctaaaattactctataaaccctatcgaaaggtgggcgagtctaacatgcacgtgtgaccacgacagattccaacaagccagcccacgtgctagtcggcccacctccttatttcgccc

SEQ ID NO: 80409 - DNA, 1312 bp, Oryza sativa
gaagaaaaattcaaaaagatcaaccacgtatacacttacatgtatggttccgatgaagaggatgaatccaaagtagcagcagccgagtgggtcaggagcaagaaggttgtgccatgtcaatgggtgagaagttctgggaaaagaggaaaatttgattttgatatcaccaaggttgataagattttcgatttgtgcttcgggaaaaacaaattcaacttcctgctggtcatgtaattccatcggctgaggaactaggcaagaggaggtattgcaagtggcataattttggttctcataataccaatgattgcaaagttttcagacagcagatctaggtgtccattgaaggggggaagattaagtttgatgattcaaagaagccgatgaaggttgatagtaatcctttccctgttaatatggtgcatacagctagaagatcagtcgatgaaaggaaaactcgaggttgtcagttgaattcaaccaggattatcaacaaatatcaaagaaggtatgccaaccagcaggagaggtattgcgaagaagatgatggtggatttgatcctcattgggactgtgggttctttagattttgctggaatgaggagatgaggttgccatccatcaatgattgcctgggtgcagtaataacgcagggagtttaagccgaccttacaatagaggcaatcggctgaatcaggaaaggatgtctgttcgttagagattgggcccggttaatcaagattgctaccaggatggatatgagggcaggaagactcaatgggtccttctggtatttttcacaaaaaatcagaagagaagggttcagagaataaggaatagagaacgctttcaagaagtagagcaggaaatcaaccatcggggttagaccataccagcagccgccaaggagatgcaaagtcgatatgctcgatgttgtcaaggctgaggttacacgtttatatgatgctggtttcatccgaccaaaccgatatgctgagggggtttccaatataattccagttattaagaaaaatggcaaggtgagagtgtgcattgattttcgggatctaaacaaagcttcccgaaaggacgagtacccaacgccggtcgccgatcaattggttgatgctgcttcagggcataagatattaagttttatggatggcaatgcaggttacaatcatatctttatggcagaagaagacattcataagactgctttcaggtgtcctggtgcatcgacttgtttgagtggattgtgatgacctttggcttaaagagcgctggagctacatataagagggctatgaac

SEQ ID NO: 80410 - DNA, 733 bp, Oryza sativa
ctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgttcataactgcgggcatggctattcgaatagttttactctggccagaggtataccactgtacccacaagatacagccccacaacatgtcaccatgcgcctcaataccaccacggtacctcagaaaggggctgtgacagtacccctcgcacaacacaatccaccacagcgcaccattcctggatcataatcacccccttataaacaaggcatggactccccagcgacccccgtgggcttatctctgccacttctcagtctggtgccccgcaatgaaccatgttatacaaaaggtaaagccgttgcccacgctggcttgtggttggcacggttaatgtttcacaaccgaaactcgtgaaccagtccttaattgtcatgagcacgaccatcaaaaccatgtgctcacaacccaccattatcaagttttagttgacaaattaattaattaaccaatcacgattaactatcatgagctatcattaagccatcattaaacaatagtgagtcataagttatcccaatagtgtgctaatgtttctaagcatggctaagcaatcgtatctaa

SEQ ID NO: 80411 - DNA, 6866 bp, Oryza sativa
ttttatttgagccgcaggctcttggatgcagagacaaggtattctcttgtggaaaagttgtgtttgtgcttatatttctcttgcacaaagttaaggcattatctattgtccaatgaatacactgtgatatgtaaagccgatgtggttaagtacatgctattggctcctattttgaatggaagggttggaaagtggatatttgctttaacggaatttgatcttcggtatgagtcaccaaaggcaattaaggggcaggctatagccgattttattgtggatcatcgtgatgactccatcggctcagttgacattgtgccttagactttattttttgatggatcactgtgcactcatggttgtggtatcggcttggttataatttcccctcgggggacaagttttgagtttacctatactattaagccctatgcaactaacaatcagtctgaatatgaagtggttctcaaggggttgcaattgcttaaggagttgaagccgatgctatcgaaattatgggtgattctttgttggtgatcagtcaattggcgggagaatatgaatgcaagaatgatacattgatgatgttgacgctttttcgtgtccaacacaaaatcaccgaatgatttgtggtgtaaacaatagagtcgccaaaatcgatagaccaaaatcggctagtgaaaccgatttcgagattaattcactttcgcggaatcacacgactaatttacaagcaaattagcaaagaggataaatatcgtacttcagtcaattggcgggagtatatgaatgcaagaatgacacattgacagaaaggctatgtgctctcggggggtgacagatactttgcccatgtatgcagctatgtagccagaccagccacctatggtttttgttttaaattcaaactggttcttggaattcatggtcatcggattggctgaagaggtgacatctaaaccagtgatcatgatgacatcaagcagagtgagggtcatcggcccttgattgaacaggaaggtgttgagcgtgttgaaccagaaatatgttgcagaagccatcaggggttcatccttagccgaatttgctaaagtaagtgcaagggcttggttaattccgagttcatcccagagaacttgcttgctttccgacacacgtttgtaccatacgggccaacttttctcaggagaacttttctcaagggaaggccaagacttgaatgtatttttccagtgacctagatttgggttggccaatctaaagggtatcctattggtttcttcgctaatgaacttagtagggtcggaatcgccgattggaccaaggaaatactaatgctcatgagataggctgggaatcgcaaccagattggaaagatgctacaaatgcaaaaaaaaaaagaacagagaagaagaaaacaagatgacacaaggaaaaaccgatctattgcataaagaagaagatctagccgatgggcacgtacctctgcatactcggctgatggcgcggcggacgggctagcggaagtcgacatcgctgcgggcagaagcttggccggagggagaatcgccttaagatcgccttgcgcaccgaggggatcgccagagaaagagaagacaaagtttgcttaagcggtgaaaacggaggtaactgtgtgaaatttctcgggggtgacggttagtatttaaagcgctgcggtaacggtcggaaaaacggcaatgagcaatattctaggagaagcagatatggcaaatccgaaatattaccaaatataccggacttggggggcatgtgttaacgaccaaatttggtaattcaggtatcggagatggagataaaatcgaagcgaaatccaagatagaacaagaatcggctaaagtccaaatcggctatgatcaggatcggaagagttcgagtcggactaagtagccgattgagccgattccgacaatgtgactcgatacacgttgtcgggttgagttaatgtgtttcatatggattgcaacgcacggattgagtcctgaaaaggcaattgtatctattaattaggatatttatgtaatttccttagagataagattgggcaaaaatctgtcgcaaagacttatggtatcttagagtttgttagagataagagtgatgtccgacaaggacgtattttgtatctcgggtataaatatgacccgaacccatgtaatcaaacaacacacgttcaataacaatctaggcacatcgccacccttttactttcgtttactttcgacaagttcttgctttcgggttgagctgcatcggcttcgatcttcaactagaggtaaaacttgttatggtggcttgcgttcacgggattagtgcttccatctttatgatactctaatcttgtttatgtaattcattgagttatcatatatcctatataatctctgacaatatcattatttaaccttcaatcggctaacatctatcattggaaggcagccgattaggttaaataccaatgttgacttaaattatatagggtattcaccatcctatgaaacatccaacagcttgattgtctagatattgtccttcttttcatacttatagctgcatcagttgagtttgaccttataagtcgtgattagaatctcaatctctagcctgcttttggttgccgattagggtttcatcggggtttcagccgatcttaccttatttaactacattatatcttatatgcatgattgacatgttaaatccgccctttatgtaagatcttgttgcatttaggtatattaagcttcctgtttgatatattttgcttgctttaatatcttaatatagagtagtatcggagtattagccgatacatgctgctatgaatgcctataatctccttgttaatatatatttcgatctaagtgatttatactatctcggcatggcgaccgatcaatcccaatcacttgatttaagtatatatcgacggaagtattatataccattagtatcttcagccgatcgaatagatttagttctttcttgcctatttacgactgccgatcgactcaaatatgacatcggctcaaagattaatgatacgtcatcggcgactggccgatcgggtatcatttatagatttaaccgctattttcctgtctttatttcttgttaattgcaggatcaaatcaactggcacgctcacgaacctaaaggcaagatttttggacctgcactgaagttaagcagatattccaggccagtgtgtgttttttgcatcaacaagggcagagccttcggcctccgagggcgaagccggagcggtgccgcccctgatggcaccactatctctcccgccctcggcttcgactgatgtagaaacggcgaaagcggcagcagcggcgaaggccatccaggtcagagtcacgtcttgtcatcccaagcaccaggggcgccttcgaccgccgtcttcgcccaaccagcttcgacgtcagcaacgatcaccacctcacaagccaacgccaacctcgaagcacaagccgaagctgatatggggctatgcgtcagaatatggctaagcttcaagacacgcttcgccagatgcaagagcagcagcaagcgtacgaagccgcaagacaagccaaggcccactcccagcaattctatgctcagccccaagttctacttccacacgctgtgcaagcaccggtgtacttcgccagcccacccaagccaacgccgcgcgtccgacacggcagatggtcccggcaccggtccgcccggcagcacatcatgcccagtacccgaagcccactcacaacccgcaagcaatgatgaaagaagcttcgaccttgcaagcacagttccaagcttttccgcaataactcaatcaacaccacaacaacataccaagagcttcgcctccggctcaggccgagggaagcccaagtcagggtgtatcggcgggccagctgttgggacagttcgccttgctaagtcaaattcaagggccctcgcctcaaggtccaccttcattgttcgacccaagtacaatggcccaagcaccaacgactttcgcacaagccgtacctccagagtacagaatggccccaccatcgattcaagtctggaatcaacccatgtccgacccagccacggtgatgcaagtcacttcgattgaccagcaaaaccaggcaatgatattcggcacagcacactagtcaacacccgcagctcaaccacctgttaaagctgtggcttcgccgttcgcacttccataccaacaattgagctggcctgctcaacaaggggatatggtcaagccgggggctgaaaagggtttgcccctcagctgaggaatcaagaatcatcccatcccaccctagtttaagtctctccagtcccacggtattcgggagagatggatccgaaagagttccagtccatctacaaatctgcaattgaagctgctcatggcgatgagaataccaaggcgaaggtaattcacctcgcgctcgatggcatagcgagatcttggtatttcaatttgcctgttgatagcatttactcatggaagcaattgcatgatgtctttgtccttaactttcgaggtacctatgaggagctgaaaactcaaccagaccttatgggcatacaccaaaggccaggggaatcgacaagggagtacgtacgccggtttttgcaggcacggtgccaggtgcaagatataactgaagcatctatcatccatgcagcttcggccaacctgcttgaaggcgaactcacaagaaagcttgcgcgcaaggagcccagaacaatcaaacacctctttcgcgtaattgatggatatgctcgaggtgaagaagataccaagcaaaggcaagagatattagctgaatatgaaaaggcaggtgcggccgtagcaaccaccatacaagccaacgcccaagctcaggtccaagcttaaattgtaagttcagcacctgtctaggttcacccaacacccatggctaaccaaggaccgtatccaaggccgaaccaagcacccatggaagaaattcaggaccgagcgagctagcaaggtggtgatggtggtagaagaggtacaggctctccacaaagagttcaagacccagcaggcaggcggacaacaacaacccttttgcaagaagatcaagaaggacctatactgcgcctttcatggacgctcttcgcacacgactaagcagtgtcgaaacattcggcagcaaggcaatgctgaagtgccaaggcagcagtagccaaggatggtaccttcacagtaccctttgggcaaagtgcttcgaggaaaagaaattacagggcgcctaagcaaatgggttgctgagctgtcacctttcgacctgcactttgtcgcccacacggcaatcatgtcccaagtcctcacggactttgtggccaaatggacacccacgtccgtcctagagcccaaacctgtcgaacaaccatgggtcatgcactccgacggttcgtggtctcacaagggggcatgcatcactgcaatcctgacttcgccagggggtgtaccaattcggtacgtagcaagactgcagttcgacacaaccaacaacacagcagaatatgaagcagcgttaatgggcctgaggaaagcaaaagctttgagaattcggcgtttgctagtccgaactgactcaaagcttgtcacaagctaagttgacaaatcctttgttgttcaacaatcgatcggctgagtcctggcatttcataatactctcaagcgaagcaatctctatattcttctaaaagctctataacttggttatgaattctgcagatagattcttactgatgaatgtcgacctaggtctatctcctggacctataccaatttcttccaaatcatcagccgacatgaaaccctgtccttgcttgtcatcgagatcatctactgtatccttggtgtagacgtttgaagcctccacgacgccctcaaaataataatttgggctctccgtcttcaattggctgtatatcacaatcgaaaacttttagaaaatctccatcccaaacttttccagacaggcaatcaatatcatccatctcccaaagagctaaatcggcactggcaacgttaactgacctgtcggctggcacgatctcaatcttgtcgccttgccattgaatcaagcactgatgcatggtcgaaggaatacaacaattagcatgaatccaatcccttcctagcaacaggctataagaacccttcccatctatgacaaaaaacgttgtaggaacggtcttgctgccgactgtcagctccacattcaaaactcccttagtctccgatgggttgccaccaaaatctttgagaaccatatttgtctttatgagatcatatgaatttctgcccaactttctgaatgtagcatacggcatcaaattcacagcagccccaccatcgaccatcatcttagacatcggcttcccattgacataaccattaatgtacaatggcttgagatgccaattttctgtcccttctggtttctcaaaaactgcctgctctggcgacaaaaccaatctagcagaggtttcctcaacttcatcaacatcggcttgcctggcttcaaattctgccggtagcataaaaaccatgtttaccgatgcagttgcaacacttttccctttcatttcacattatcggaggcttttcagaccttccattatatttgaaagatgaagtgaataattcaagtcatcaaacaagcataatgaaacatacgacgcctcgagagaggaatattggagacattgttaagcccttagcctgccaatcaacttcaggccgagatgtgcccgtcaaaccactccaaggcggtgaccagatg

SEQ ID NO: 80412 - DNA, 3814 bp, Oryza sativa
caccccctaacagttccatcatggttccttctatcaaagtactccgtatcaactattgtgttgttctgaaatttgagcaaagagctagctatagataagcacctaatccaatgcaaatcctattaataaagtcaaatagatcacaataaactaatcacttatcaaaaagaaattctcattaacacttcctatgcttctgttgatcagtaaattgctgcgcttgctaatgctccttgttacccaaaaaaaatgccgacttcgccagcatagcagagcaagcattccactgcttcaggctgaggaacacgagcggctgcctgtgctggccggatcctagatccgcccctgcgtctgccacaatacatctggttgcgttgacatgtgacatatacatacggttatacctaggggtgaaaacggtcacagaaattcccgatcaaccaggcgccgtttccgtttaaggggtaccgtttctgaccgtaccggttttggctatttttaaattttgttttttctaatttctttccgcatcgtattaatgtcgatactgagtagtttaagggtccctttgaatcgcggaattgggaaaacataggaataggaaaaacgtaggattttgataggaatgtaagtgtaaaacaaaggttgcaaaacgtaggaaaaacacagaaatgccgtttgattgaaccacaggaaaaacacaggaattggatgagagatatagactcaaaggaaagttagcaagaggttgaagctcttgttaaatttcctccaaaatctctatatgattgtccattccataggaatttcaaaggattagataggattcaatcctttgtttcaaagggcttcataggaaattttcctatagaattgaaatcctctaaaattcctatgttttttctccaaatcaaaggggccctaaatgataagggaccctttgaatcgcaggattgaaaaaacataggaataggaaaaatgtaggaattgaatgccatacttattggattcctatgggattttgaagcacaggaaagtcttcaaactgtcgtttgattagcacacaggaaaaacgcaggaatcttagacacatgaagaggaaaacatgaggtgagacctcatgcttattttcctccaaaattgctctagtaagattcattccataggaatttcaaagtaattgataggaaacaatcctttgtttcaaaggactctataagattatttcccataggataaaatactctagaattcctatggtttttcctttgattcaaagggagcctaaatatagtcaattaccgaccaatcgagcatcgtttccgaagatatgataccgtttccgatcattttcacccctagtgataccactgtgtacagtaccgctgtgcacggcttcgtggcttcagctatggctgcggcaaatcgaatcgagcatgtggatggattggactgcagtgtacgtactactgtacaggtgtacaggagcagtactggactagttgctccgatgcctactacagtactactactacaagtagcaacaggagtaattaccgcctaaacttctcggacgacggactctcggcacacggcagggtccacgcccgtcctgctgtccaaggagaataaaaaagctgtgcaagttcgatcgtttcagtggggctcgcactgggatcgctcatcgctcttccacaatgtaggagaacgacccgtcctgggcccgtgcggccgtgtcgccgctggctcctcccgtcgagtggcgcgcgagattgcagcgcggtgctggagcaccgaccacccagtcggtcaaaattagctcttgggatgtagctaacagtttgtgcgcgcgcgaccctgcgacgaagatacggagagaaaaaagagaggacaaggcccatttgaatcaaaagaattatgaagtaatttcataggattgaaatcttataaaaatttttcctatgtagccctttgatttaaaggattgaagttttccaaatcttacaaaattcctatggaatgacttgttgcatataggttttggaggaaacttagcaagaggtccaacctcttggtaaaaatcctttgagtttatctctctcatccgattcctgtgtttttcctatgttccaatcaaacgattattcatgtgttttcctatattttacaatcctctgttttatacttacatttctgctagaatcctatattttttctattcctccgttttttcaatcctacgattcaaaggggccctaaaactggcgtatccggcagaaattttactcaagcagcacacttagcctcaaaaatatatttaattctttttggaaagggtgatatatatgcagcatggttttccacaattgtggcgagtgatgacaaaatatagttctacgatgaatggtcaactctcagggaagtagaattgcacacatttttttttacaatatgcaggaaacgttttttttcgttgtagtcggtttcatttgaaatagtgcgtaatattatattcttggcgttgtaattagtatcttttttttaaaaaaaatgcaactagtgggcatacttcataccgtgcaatgaaacatttttgagtaagtaaaggaacactgctcaatatttttctagggctcgaaagttcgacccctagttgcatcgttttggagataagggatgaaagatctggagatttatttattggtagatgatacctgcgcggacatatatctatttaagtaaaatcaatgctagtgaagcttgtctaatacaaagttgtttttttaaagagattttttaatagaaaatttatattggttgaaaccaccttgagatacaattcatttaggtgcatgttgttatctatatagggttactctatgttgggctctgtgtatctaaggtttaaagaacaattaggtttgtaaaattatactgtattcatattgatggtagtaaaaggtatacttttttttttcagcataaagatattttcttacacatctaattttagaacgaaaagcaattaactgacgaatcttatcgattttgacacatattgcgaacaatattatcaaagacgatccatgaaaatgtagtgtctaacagagatctatcacaggaaaacaaaaaggcttcgtacaaaaatccacactcctcaggcaacacatcaaatggtattagcttgagacggatgagtacaatccttgtaccaacagacatcattacaaatccaaacttaaacatcaacagtatcacagaagatgggtcgttcgagagacgaaggttacggctacactgctgcgttgtgtttgtggcgctattcgttccaagcagccgagcagcccagataacacgaacattgaaaagttaggtggcggtgaaggagggacggctcgccgctcgccggcgttgccgttgaaactcggacaccaaatgccaacattgaaccaccagatctgtcatctgtgcaagtgtaagagagccagaggagagagcagttggcggttaaaaccaaggcaggacgaggctgaccacccccccagccccacccgcagtttgttggcccccacgctttccccacccacgagggcaaagagaggcaagccaaaggcggtgcgaatgcgatgcgtgccctggtcagctgccacggcgacgggcatcaccacctggcccccatccatccatcccgtccaattcatcgccaccgcatcacgcgcacggcgcggcacacacacacacagcacacacacacaaccgcagcgcagcgccgcgccggtataaatcccgcggacccaaccccggatagggacgg

SEQ ID NO: 80413 - DNA, 6755 bp, Oryza sativa
catgtagttatgggtaaacaattagaaagaaccatgtcaaatctgagacggtattctttaaatcagccatctcattgagtttaggccagatatctagaggaacaatataagttgtttatctgcactatattaaagtagcatttgacaaaaggaacactattttgcatttaaagattcgtctagattagggacacagcactctggataacagggttacatgaactctctctagccaaggatataatctggtctcaactttataatgattcttggatttccctttttttattgttagtcttcctttgttttattaaggggggagagggcgtacagaaagtaccaggacaaagataaagtaaatggcagagagtatcactgcgacactgtaaacacattaactccgaagaaatttaaagattaccctttcttagtgttcaagcccgttccaactgcagttccaccttgagcaagctgctcagcaaaaaatatgatcagaaatcattcaacttttgcatatcattctaaaaacaaatattgaacattagtgtagtacctgatacatccgtggtaaggtacaaacaattctatcaattccatatttcacctatacatggagttcaaaatagcttataacttataagtatttctgtcaatcataaacgcatagcaattaataaaataataacaaattactggaaaatttcctacttgtgtggcgtaaccgctgaactcttggccaagggtcaatggggtggcatcttgggtatgtgtacgcccaattttaattatgtcttgaaattcaacagactgttacaccaagttgaaacttttgttagaacagcatagatgctatatgaaggaacacactgcatatcatctatcttctggtgttgccaaccagaagtgctaaaataagggaaaacaataatcagctgaatggccagcatacattttctgtggatttattttattgccttcactgataagtaagtgaaccgtttaatcttaccaattaatttgcacgaaagcattcatatgttgcaatttcttgctcattatgaagacaaattaaagtaggttgtgtctaagtgctgagatcttgaggtaacaagtaaaacaaaagtctgccccagccatacacggatacgtcgtaaacaatatgaggttcaattgagagacttcatggagaatggacaaaatattaataatagaaggccttgaaatggatagaaaaacaaaatataaatcaataagaaataggatgatgtgatatccatgcattattgggctgcagttgtctgtctagcagccaaagacatgtgcccaagtaatgtgatccaatgtagcacaaggaaaaaaatagatataatatcaacttgtgatgcacttgatttgagtatcttagaaatagattcaaatgcacagttaatagcagaggtaacttaagaagattgctgcaaattggaattaagccaataggtgaaacacgcacccataaatataaaaggcacaagacaagaatggattttaatgttgggaaacaagagacaaaaaaaaatacctttgaatcaagtgacttatgcaactgttgcaagcttgggacaaaccttgaattgatctctgtggctgctgctatgtgcatgacctgaaaatgtcagcaacataaatcataacatcagcaaaggtaaatgcacattaaaatgacggccaaaaaaatagtgaaatcttacagtgggaaatgtatcatttgaggactgtgatctgttcacatgatcattagggtgtacaaacttctcgccacgcttatgtccaagaatctcagcggccctatttgcaataacctaaattgcaaaagcagatcagaaatggtaagatattacagtataataacacaaacttagctcacagtaatgttaacatgagaattaaacatgataaaataattcaataaagaacagagagatttagtttgcccttctattcagacatcaaagctttaacgcacattggcaggtaccacatttaattattagtaacaaacagtatagacaattcatacaatagtagtgcataatgggaaaaaaaaacctcattggcgttcatgttgctttgtgtgccactcccagtttgccagataacaagtggaaagtggtcatctaactgtccttcagcaacctcctgagcagcctgcattattgccttcccgattgttggatcaaggccatactccatattcacctttaaaaaccgaatgaacaagtgagatatacataacacaagtataaatcacctaagcaatatcatcaacagcacaatctgaaatttagttaaactaaaattcaaagcatggcaatgtgacattcgattagctgtcaactgatgtaaaatattagcagaaaactgaaacaattttgcaacaacgagatgtaacagggaaccaacgtggttttttaccccaaaaaacgtgagctccattgtttattaaatatgtgcacatcacgcatttgtttacatatgttaacatcacgcatttgtttacagaaactatccacagcacataaaaatcgctttccagccttgtgctccacaggacaacaaaataaggccatcaaattcatctactcgcccccacacacgcaggcactaaaatggtatagtctcgcttaataccttagcggcgcactttttgagcaccccaaaggcgcggatgatgggcaccggcatccgctcgcgctcgccgccgatgtcgaagttctgcagcgacctctgcgtctgcgcgccccacagcctacaggatacatacatacaaccacgaaaagcaccccccatcaacagatcaatcaaaaccaaccacggcatccgtcacgaacagatcgaaacacctcctagcaatccatgcgggaggagagagaaaccgaaaccacacgcacttgtcgttggggactcggatggggccgaaggtgtcgcgctcctcgcggaagccggtggagatcgggcgagccagcgccgggcggagcagcagcgcggccgcggccgctgccgccgccggcgacggggcgccaccggcggacgcgcccgcgaggcgccgcaggaccatcgccatctcgtgcgccgcctctctctctctccctcctactaggaggtgtcgtacggcggcgagggaagcggcggctggcgaatgtggggagagaagtcagagagagaaaggcaggcaggttggtggacgacggaggggggaggaagagaacgcgttgcgactttagtactgctacttacggcccattcttactgcacacccaactcatgtaggccggcacgagcgtgcggcccattttgattgtgccggatagctcagtatatcggtttgctttttaggaaataagtttattaaaggtccctcattttgacgccaggttctaatttttcgttctcgaaccatataacgcgtcccttaactttaaaaccagtgtacttgaggtccaagtaatatagtactcggttttacttgacgtgtcgagtggaaacttatatggccccacatatcaggcccatttcttcttcctccaacatcccctctctctctctctctctcctctattccccatcaacggtggggaagggacagaggtagccggtgggggacgggtgaagggaattagagtggtacaggtggccgcacggtagccagcatgagatcgccgctgacaataaattgatggacactttatatatagtattggaatttgatgatgaaatttaaactcctcgtcaagatgagaggcctaatgtgaacttatttcttgtttttataggttgatggagagaggctgcggggtctagctcacagcccacggcttgtttgtctgagtggccatacagatgttcaattatgtctaatttttgtctgtgtctgaggactctgagctctagacttctctccacagttatgtttaattttcttaaatcaccacgtaatttttagaaaaccatttaacacattaatttaaccctagcttaaccgtagtcttgatttctggccccactcctcctgaccgcctgaacagaacacttccctcaaaggtgagcgagcatcgtactgaaatacgtactccctctatattaaaaaaaaactcgtactgaaatacgtgctccctctgtctaaaaaaagataacacgtgacccctcctaatacaatgaatctggacggagggttatccagattcgttgtaaccccttataggttactttttttttttggaagatgaagtatgacccctcctatattgtcttttttttttatgatggagggagtatgcgtgtgtataaatcggagtacaagctttcaaccaactttgatgaaagtgatgtgctcattgttctgcggccacaccgaaggtgtctttttttattaattaaaaaaatattttcagtctaggatgatgttcatacaatcatacaagttcgtttctacattgaccacaagtcgatttcacggcgatgcaacatggtcggtatcaattgaatgcgttgttttcattacctaaataaaaaaatcgactggatacttttttttctgactgttgaaaatagtacactctctgcccggccaattttccactcacgaggcaagaaaaacaggggcatccagttcattaaattaaaattaagtttctattaacaataagtgaatatgcccctatcacgaggtacccaacaaggcaacaacagaccgtaatggcaccggtaaagcgacttgtgaataagtgaaggtagccggagagcttttttttttttttgcagtggtttctcttttaatgacgtgaggagatgttaggttgggagaacaaaaactgaactgatttttccctggaataaaaaaaatatttttgaacttatcccttctttcagttgttggtacgaatatcacaattgaattctgtttctcagaattttgcattgccataatttgttaattagtaaactgtgcaatactcttctttctaataagaaaaaaaaaggaaagaatctcttttattgaaaatagaacggatttgacatactgcttgtgacagaaaacaaagagaaaaactttcgaattcttggccatccaatttgctttaagatttgtgcacggatgaagaattaaaaaatcaaacggcccacgcaggtgttattccacttttgggctgcgagtgtgttttgtagttatattgtgactacactttacttacagtaagtttacagagcatcaagattgtcaggatcgggatactaggtagtgtcattttgcttaaagtaatatcgtatcatagtatcgggataccatgagattttctttttttaagtttaattaatatttatattaattatatatagtcattctatataaaaaatgtagtaatgatatatgtcatgcaaataaagacatttatcaaaagaaacatgttggttttgatatatttaactgatttttatataaatttgagcatatttatttatattattttcaaaccatgctattttaaataatattttatagtatcgtagagatcgtagaatcgggataccacctaagatttcgtaggatcatgtagtaatgaatagtaggatcgatatactatgaaaattaggatactaggtgggatcggtatcgtttcggcttggtaggatcgtagtatcgtaagatactaggatacgaatcgggatactgacaaccttgcagagcataattacatgacatgccaataaaaatataatattactattgtattatatttatatctgaaagttttaaagaaaaacttacaacaactacatcaaatagaaagggggatgtcggaatcgaatgatgcacgaacaagagacttgagagttggaaacatttacctcatcttaaaccaattagcattttttcagcaatattttgcatcatggtcatttacctcctcagacattgtcttgcttgaaaattgtcactactacatatgtagtaatactacataaatcactactacgaaccgcttgagtgactgttgatacgtgctatcagaaatttttttaaccagatcacccaaattcagaccaaaacctacaaaaacaagattatgggattatgaagagaaccacattgacaagatttatattggttcagacccctcataaagagaactatagagattacagtagagaataacagaaccgatgagttaccgattagacctttcttgagaacaacccgacaagatcaatcagcgagttggtttcgagttctccggattatttctgctatgaccgatggcaatgctatgattcgataatcctatacccttagggagccttgtatttatacctcaaactgccttggcttccaagtagaactcgaagaatcttgcacacactagatcacaaggcccaaatcccctccgaataggactctaacaccttccgaatagtcagttttctttcccattggccaaattccttaagactaaggtagcattcccgcatatttgagggtataccatattcatatactctgtaacccaaagaataggaaatatgccttatccataaccttgataaattactaaatttatcatgaatttattataataaaaaatataaattccctttttattataaattgtgtgcatccatcttagattataggatcatattaaaaaaaatcactttgtccggattacatgtaaattccgtgttgttttggacaaaatttgactccttggatttatgcc

SEQ ID NO: 80414 - DNA, 5060 bp, Oryza sativa
cctgtcatccttttcacttcggtcgtttcaccctgcttgagctctattgccgctagaagcgtcgctgccaaccacactgccccgctcgaccttcaccgttgtcccgtgttgccaccagaagcgtagcagcgctccaccgttgaaggaagagtggagagcagaggatggaggtagaagacaaggggctatttggtccaagaaaaatagaaaatgcagccaagggatgtacaggatatatcttcaacttcaataggcttcattctaatttaacaaatattaatgatatattttaaaaaagtaaaatttataatggcatggattgaattaacccaaaaatcactttactaattagactaaattgatttccttttattaacttatagaggtagaatttgatcttacatatttgtaaagtgatatatatcgtgtgttaatatatattgttgaaaaaattgtataaccctttgaatgatataaacaatggaacatctcctcgaagggaaaaaaaatcaatctccgagccctaccaagaaacatttcaagttgacaaacacaaaatgcgtgcaagttttgaaccgtaaattaattggtatcggtatacttaaatataggataccacacgtatatttattatatctatatatacaagactcaaccaagactgattgagatttccaagattctctctacaagtttctgacaaataagaaatgcatcgaagcatcaaggagtgaacaattttcctgaactgttcatgaaaccatgcatctctgatgaagattgtgaaacatctttgatggccttctactcttctagcatccgtgcagagcaggtttcagagcttggacagtgcagagtccatcacggcgacgaagaaatctgcaccaaacagaaaaaaaaaaaacaaaaccaatgattgtgttagtataaccggtgagctggtacctggtatacgacagtgatagaatatgaacttgatcgaaatatttgatcttgatggagtgtaacggcctaccggcatcctccttggtgaagcacagagggggagtgatcctgaagacgttcccgtagaagccgcctttgccgaccaagacgcccatctctgcatgtacgcgtgcaaaatccatggcgatcaatctcatcaagccacaactcgatcagaaaccacaagaaaatgtgtccatgaaaagcttacctttcatgtgctccatggcgcggcaaatctcgtctttcgccggcgtcttgagctgcctgtccgtcaccagctcgacgccgagcatgaaacccgtccccctcacgtcgccgataactgcattcatccatgggagacggcaagaatgaatcaaccacaagcagccatgctgtcgtggccatggcggccggcaactacttactttcgtgcttgtcctggagagcgcggaggcggtccttgaggtaggagccgacggcgtgggcgttcgcctggaggccctccttctcgagcacccggagcacggcgagcccgccggcggtgcacagcgggttgccaccgaacgtgttgaagtagcaccgccttgtcagcacctgcgcgatctccggcgtcgtcaccaccgcgcccagcgggatgccgttgccgatgccctgcacgccatgcaccgtcaggcttgatgttcgatcgagtcatcatgcatggtggcgagcgaagcggaacggattataccttggccatggtgactatgtcggggacgacgccgtgggtctcgaacccccagaagtggctgccgacgcgcgcgaagccggcctggacctcgtcggcgatgcacagcccgccggcgctccggaccgcctcgtacgccagcggcaggtaccccggcgacagctccacgatcccaccgacgccctgtatcgcctccgatatgaagccggcgacctgcccggtggtgccgaactcgatgatctcctgcacgtcgcgcgcgtacttttcggcgtcggagccgaacgcgcccctgtacgggtccgggttcacggcgtggtgcacgccgctcttcaagcacacggacgaacaggtgatcagaatcgagagtgttttcatcgatcggtgatggcattttgtatgtactgacctggacgacgctgaacttccagttcttctgcgcggtggcgcccatggtgccagcggcgttgccgtggtaggagttccggagcgatatgatgtcgtgggagccggtgtacagccgcgccatcatgatggcgagctcgttcgcctccgtgccggagttggtgaagaacacaacctacacgcaacgctcgcgcgcgcgcgcgccatcgatccggtcagagcaagcgtcacaagaatcggcaactggcaaatgccggccgcgacagtataccttgaggtcgccgggcatcttggaggcgagcgcctcggcgaagtcggcgatggcgtggttgaggtagagcacggtggagtgctgcaggcggccggcctgcgcggcgatcgcgccgacgacgtccgggtggcagtggccgcagcacacggtggcgatgccggcgaacgcgtccaggtagcgccgcccgcgctcgtcgaacaggtactgcatcttaccctccacgatgttcagctgcacgaaacaaaaacaaaaaaaaccacggcgatttatcgttaatgaacacactgcagcgagccccatcgtaactgaatcccacaaattacggaatagtttgattgccaagaatactataccaaaattcagggaaatttcaaaagagcacgaaaaattaatttcagcaacaaattagaaatgcacatactggtttggaataaaagtggaagagggacgggctgaggaactcggcgcgcttccgtgcgatctcggcggcggacgggccgtcgtaggggagcgggacgtggttgaagtccgccattctcggcggcgcgacggcggccgtctccaccgccgctgcgagcctcgacaaccctctcctcgcaatcctacccccctgcatcatcataaccacaacccaacctaacaattcaagaaaaccacaatccgttcctcctcctctatctcacgcctaatcgctgatcagtcgatcgaacgatctcctcgacgacgacgccggaggaagaggagaaattaacaggtcaggtactcaggtgtgtgggtgtgtgggtgtgatcagggacgcaggtgtgtgggtttatatgtaaggcgaggggtgcatgcaaccggcaaagagatttcgccggccggtgattgacactatcaacggagaattcgaacgttgcgacgagtgtatcatatcccgctcaaatcccgtaaatttttgcatcatctacgtacagggtgtgtgggaataaatcataattaggcaggcagcagcacacacagcgctgctctcccatgaatctggacctgcttcctttcatgggttacctttgcgattagttagtgtttggggttgagggcctaagtttaacctgtgaaccgggtgagaccatcacaggttcattgaacctagacgtgctatggcaagtaaaggggtaaatggaaagaaaaggtacaccagactagcccaatatacctaacccggcccccacacattggcaagtaaatgggtgagtgcctttttttttaaaaaaaaaagatggattaaaactaaaatatgtggtggaaatagaaacctgaaaattaccattggatcgaaaattaaaaatctgagattcgttcacgtcacttcagtaaaatttttactcatgagtgaactgggagtaaaatttttacttatggtgacgcggacgaatttcggacgtccatttttgatcaaacggtagtttctaagttttcactttatatacatatatatgttttacactacatattttccctcatatccaaacccagatgtacacatcctgggtgatgcaaccgtgaggtttggttgataactcggactgttttgataagtgttgtgaacagtgtataagtattgttagcttgttcagttgtcccatatcgatatttcattgatgagatagtacaacacttaagggtctagccagaccaattacccaaaaagcgtcgtaaggttatacttttacggtcctttataattaaacacttaaaaaaagcatatacctcgtagtgcttatgaatttttttttgatttttgtgttgaaaatttctattatttttttcatatatgaaaatgttgttgaattccgatcaggaccgagaccgaatttgtcggtcctagcatttttgcgttgaaattcggtcttcacttttcaaagaccgaaccgaagactgataccaaattttttggtcagactgaatgcccacccctatgtccacaaaagacttgtattcaacagtaacaacttgtacgtactctaatataagaagggatatttttttctatatttgcacataatagatcttttcacttggatgtattatttgattatttaaaacaagttaactagacagctcatgagagtagacttgtatattggttgagtccttttgttcttacttcctccgtcacaaaataaatatagttttgtactattcatctccaacgtttaaccgttcgttttatttgaaaaaaaaatatgattactatttttattgctattagatgataaaatatgaatagtactttatgtgtgactaattttttaaaaaaaattataaaattttcaaataagacggacagtcaaacgttgaacacgaatttttataactgtatttattttgggacggaggtagtacttcttagcgtgtagttgtgtacatgcactcttgttaaggacaaggacgaggacgcgctctgttgtctagtaatgaaacaatctcaaaggcaagtaacaactccttaaacaacttgatggatatcaatcaagccaatatggtatatatgatggtgattagggaacaaacaatatgatattgatataatgaaactgttctgtgagatgtaatgaaaaatgataacatatcataggaaaatgtcttggtctaatcagatgtaatgaatttgttatgtgacaatgatattgatattgatgttctataaat

SEQ ID NO: 80415 - DNA, 791 bp, Oryza sativa
agtaggttttcaaccctattttatttttttggttgctatgatggtttgcattgaacatacacttaaactttataggggctgatcggaaacactagctgctgcagcgctgcggctgtggtcgtgtttagctgttgcggcttgcagccgtttttcagctgtcgcagcagcaagcagtatcgaacacacctataaaaagtaatgtttcgctgtaattctctttatctctaatatttcgtatgcagggacggatccatgaaatgaacagagaggggctcctcctcttcttcctcctcctcctcttcttcctcctcccatctcccattctctcaattgtgatccagtgggttaggaaaaacttgagtcccccagcaccctcactggatacatcgctttttatatattacatgagtgtaccaactcttgtttgtatattatattagtgtaccaactcttgttatgaattatgacgacagattgcatgccattggctcatgagtagagcattattggttcagtagcagcagtttgtgcacccgtaacatctagttggatccaaatggagccacacttagccggttagcccacacatcttattgcagaatgcagagttgttgattagatctttttttaaaaaaaagcttttgataccagatgaggtgtgataaggaaacaaaccaacctgatgcttgctcggacatcactaagacaccaacccttatctagctaactcgtctgccatttgcatcatcgtatatatatgagtgagcatcactgaatcttaacatgaaaat

SEQ ID NO: 80416 - DNA, 1066 bp, Oryza sativa
tcagggacgttcggtgtactttttcctttttagaaaggattgggagtttagaggatgaggctattaactactttgtttggttgggatgcataggaattttggtaggatggggatgagtaattgaggaaggaactccctccttttcaatatctgggtagggggtgataattgggagggaatttctcctttactttgcctaaacaaatctcagccatccgtttattaatggcttaatctctaactaaactccctatcaatttccaccacctctactaaacaggatattgggattaaaattcaaattcccatcttagtctcaccatcaattccctcgtgtaaactcccaatccccttccctcgagttgccaaacaagctgtatgggcttttccgcgtggatatagtagagaaataagttcaccagaggtctcttaacttaacagcgagatttttagaggtccctaaaccacaaaaccaaatatgtgtacccctaaactcacacaaactgttcaaaagaggtcccatggcagtatatgtgggtggttaaactgacgtggcatcctagttagcaaatttttttaaagtatgtgggacccacatgtcagttaacatcgttttttcttttcttttcttctccttctcttctctttctcttcttcttcactaagtgagcacgatgggcgggcggcgggcgagcgcggctgccgagtggcggcgggcatcggcaggcgagcgtggcctgcgggcgagcgggcgagcacgacggcgggcgagcagaggagcgcgacggctggtcagcgcggcagccgagcagcggcgggcggcggcaggcaagcgcggctggcgggcaaagcggcgatgggcgggcggcgggcgagggcagcagcgggtagagcggatgagcacgacggcgggcaagcggacgagcacgacagcaggcgagcgaacgagccgacggtgggtagaacggatggcgccccatgccccatggcgtggtggtggagatatcggccgatccggagtccaggaacacggagagcgtgtaggactcgtcgatggcggggccga

SEQ ID NO: 80417 - DNA, 1282 bp, Oryza sativa
ctaatgattatgcataagatataaataaaagaggtgattatataccctacaaactgaatcgcgaccaccagtcagcaagatatcgattgttggatgtagagcaaggcagtacacccgagtcaaatggccatgataagacctaataaccttaaaaatgaaaagaaacaaaatgttacgataatgccaatatgccctgtatactgcaatctacatcgaactataagctaaccttgttttgttcaagatcccaacactttacttgtttgtcatcaccagcagaaaataaatatgtgtgccgttggctcacagcaagccctacaatgcacattgaatttatcagtaaatgaacttataacttatagagtaaaacaagtagcagtggaaggctgctatacagatcctaataaccaatgccaagaaaaacgtaccacgaatttgttcaatatggccagtcaatgtaagcttcaatgttcctgatgcaaggtcccagatctacaacaagacagaatcacatgatgaatgagctaacagcatttagaaattatagtagtgttgcttgttggggaagtcggtttgttgacttaatgtactagtaaatgtgaggagggaaagagagaaaagagatagcctcgtttttctatcagaaccataagatcatccaaaagaaacagctagtaaaaacttaatggccaaataaaccctgataataggacttcacgaacaactaataagcactcagtatttttctgaatcctcaggggtcatccacagagtaacagaacatatacactgttaggagtaacaagattgctagacttgaagaaattgcaacaaacaaacagaaaaattttaatagaattaaaaaaaaaacagacatctgttgtcgagctcaaaactagcccttaaacgaataaaagtgctatatacgagatgaaataaagttgtggtatgctgataccctatgatcagtgcccatactggatatgtatatcaacagaaattagtgtaaagaagaaaggggagtttgtattcatataaagagtgcaagtctcagaaaacaacactttgttgtgtcaaatggccctagcctcacttgccattatcataccacgtggtcttttgttgaagaaaatttgtaagggatgtatagcaatccagcaaaaaattaaatctatgaagatttcagatgtatgccacaaaacgttcacaaacagcttagaataataaaaagcaacataaacaaactaaatctatactcctctaaaagaccccaatggtggtg

SEQ ID NO: 80418 - DNA, 3046 bp, Oryza sativa
gaataattttattttaatttttgaggctttaaagtgtatggcggggttctcttttttaattcctgtcgcaaagcacgggcattcagctagtaacatgtaaaaatcccagagcatattggaacactactgcagaagaagagagcaagctcaccttaatcgtcctgtcggcagaacccgtacagaaccattcgttacttggatcaaatgcaattgaccgcacccatcccaagtgaccactgatcacctgcacacattttgagaaaccattagtgcaaatcataggcaaaactagaaaatccagcactaatgaggaaaaagttaccctataattcttccaaggagcatgccagacaggccgtggccatctacttggtatcctttccatcagtgcagatgtagagaatctgaaatgagatataagccatcagaaattcatatttcagttaaactagaaaattttcaacctgttctatcataaaggatggaatatatacgcttgctagtgtttctagcatgagaggagtttggttttccacctcactgccacatctaacaggagctagagtctaaattcttgcaatgcgtacccacactggtgatcctgttagaccccatcatcgacttaaagcaattaataatctattgagtggcttagcctctctccctccagtttactagttccaggttagggaggctaaatttcttagcctctcttcttggcatcaaaacacacatgccattaggagcctaagaagcacctatacacaatgatggtattgcaactcagtggaacaacattttctttaacaactactacttcaagttatcaaggctgcccacattctaaagacgaaaaaggttagctgatacccattcctgagcaccaagacccacccatatcctaattcacctaagcactagagccactcaaaggtggtgttcataaagggctaaggggaaacgccatgagctagttcaaagtttcaattgaaggcatttctgtttttggattagccacattggggcaacatcaagtgtttgagctgcatatcaacgattaaagcaaagataagtgaacaaacctgtcagatgaaccaggaattgttatagttgtattcttgcctggtatcgttgaatccctaaaaaatcaaaaaaaggaagttctcagtgcctacaattaaaaaaagagtaaacaagttacaggcaagcgaactatgaatggacttacggtgctttggggagcatatgtggtgcaggaacaatagcagtactgctgcctttgttatcagcatctttgacatcttgtgttcctgaaaagatatttgtgagctcaatgtaaaagtaaaatcagttttaaacggaagcttgctatgcttgtgtcaggtgtctcgatttttgcagcacaaacaatctacatcaatgtgcatttgcgtaatactgtaattgttcaagaataccatgagattttacctacggaaaacaaaagatgcaattatacaaaataaaagggcaccatattttacctggaagcgccaatgcagttgaaggtgccgcatcactcttgacctgtcctcggccctgatctgttggtaggttcttcaccgcgctgtactctgcattcacctgaaagatccgacaacgccatcaattattttcggggcttcatcaaccaagcaaataaaggacggaatcttaacaagtagagaacagagacgtgcgaacagaccttgcagccgacacgaacctgcttactgccgtccgccacaacaaccaaaccaaaggggggaaacagtttagcaaacagcgccgttagggttctagggtgaacgatgggggcagagaggggagcgcgcaggatttacctctccggatcgggagtgaagaggagggagtgggtgggcgcgaagaggtcgtgcgagcgcttgagcgacttgaggctcagcttcttcagcgactgcggctccaccggctccgccgtcgccatgacgacttcctgctgctgtggagggagtgagaagaaaaaaaaccagcagtcaggcagccatcgccatgaattccgatgaacaaaacgcacgcacacacgacagatttcagctaaagctcgacctagatggtactagatgcttagggtttgtcgcctctcaccgatgaacgccgccggagatacggcttcccctgctcttacgccgcgtgagccctgcagatccaagcccgcctacctcctccccgtcgggccccgcccgtcgccgccggccgccctgctccggtggtgtcgctgctcgccgaggcggaagagagagggggaagcagccgctgtgacggcgcttcgcgaaccgcgagtaagcaaagagattaggagaggcggcgcgttcaagtgggccgcccgcggagcacccggcccatcagtgagacgggcacgagttgggccttctgaatcgtctactataggaacaagttcaccggaagtccctcaacttaacagcgagatttttttgagatccctaaaccacaaaaccagaaatgtgtacccctaaactctcacaaacagttcaaaggaggtcccatggcagtatatgtggacggattcgctaacgtgacatcctaatcagcaaaaaaaaaaaaaaaagtacatggggcccacaagtcagttgcacatcgtttttttcttttcttttcttctcctcctcttctctctcttcttcacagagtgagcgcgatgggagggcgggggcgagcgcgacggttggtccgcgcagtagccgagcggcggtaggtgagcgcagctgtgggcggaacgacggcgggcggagcggcgtcgggatgcgggcagagcagcgatgggcgatggtgggcgagcggaaggcaagcgcgacgggctgcgagcagagcggacggcgggcgagcggacgagcacggggggcggaggaggggggcgcaacggcggaggtggccgaagcaggaacgtggcggcagtgggcgagctccgcgcggcttactctgccagtcgcgtcggcggcggcggcgagagtggcgcgcagagcggaca

SEQ ID NO: 80419 - DNA, 9046 bp, Oryza sativa
catgggacccacgcggggcccacatgtcatcgtggccacgtcagctcctctctctcccctcttctctatcactcttcttctcctctatggcttgggcaggccgaccgacgggtcacggcgtcacgccacgcacgagacgctggcgtcacgcgagacgggcgggtgcgctacgaggagggaggggacgaggcccacgaggcgccaacgggagaatgcgctgcgggcggcgggggaggcgaagagtgcgggtggcagggggaagcgcagtgcgcgggcggcggggggaggagcggcgcgcgggcggcgaaggagcgactgccgacggcggaggagcagcgcgccgggcggcggcagacgacgcccgagtcagggttcgtcgacccgcgccgccgccgccgccgtggccgcggacgacgtcgacgtcgacctcagcatcctcggcggcggaatgaactacatcagctagctcaccggctggcgtccggcatccatggccgtgacggcacagccgcccacgcgtgccgagggcgacgtcgtccgcagtcacggcgacggcagcccgggtcgatgaaccccgcctcggcgtcgtccgcgttgctgtaccgacgctggactacgagcaaagaatagcgctgcggtggagcagcctgtaccggcgcatcgtggtggggcacggtggccggccagtgaggcgcacactgaggacctgggatgagggcgagcgttgcctcggcaagtaggagctcgcccgccgccgctcaatctgacaatggataatcagagaaacaatcaacaattaggactgatatgtagacgtgaattgaaattgccaacttgtagtgattcctggtacgtcacaagcaaagcatgtgcaggatggccggagtggcaggagacgctgcagccggcgccggggatgccatcgctgcacgcctgcacatgtcgcttttgtcgtggaacaactctggcgcggcggaacggtagcacatcatcttcgatctcgccctggttcgagtcaattcatcactagagagagccagaggagcacgagcccctagccccgccgcggatggtgcttgcggaggcggcgttgtggtcgtggctggcggcggaaccacgggagctgagggtggagctgggccggctctgctcccgcgtcgtcgcgcgcagagtggagctcgacagcgcgggtgatgccgtgctggtccttcctggccgttgtcgaccgcgtggccgtcgccgaggtcgagcttgtcgcctcgccacggtctgctcccgggctcgacgcttcgcctcccctgccgcccgcagctcctccccctgccggcccctcgtgggcctcgtctcctccctcctcgtcgcgcacccgcccgtctcacgcgacgctagcgtcgccgtcgtgcgtggcgtgacccgtcagctggtctgcccaaatcacagagcgaagaagaagagtgatagagatgaggaaggagagaagaggttagagagagaggagctgacgtggccaagctgacatgtggggcctacgtgggtcccatgctgactcagccgccacgtcggacaaaactggggtcaaaaccaccgaaggacctaaagtaaatggttttgttagttcaaggacgtccggtatctggttttgcggttgggggacgattttataactcgatgacaagttgagggaccttcggtgtactttttccttctaaaaactacctccaaccaaacgggccgatatagtttcagcccattacagtgcttgggccgacgaggctgtaattggagtatttccatttcctctctcttcgcggagacttatcgtctctcttccattctgcttgaactaccgcccgcgccgccgatggccgccgccgccgcggcgacgtggcgcctctggaggccctactcctccgctctcctctctcgccgggtgaacccgaggttcctccgtactacgccgtgcgtctcctaccccggcggcgccgcggcttctgcggcgccaccctcgcctccgcttgccaccacctgctccgacgattggggcggcgggatgaggtgggagtccgcgcggaagaagagggtcgtgctccgcgtaggctacgtcggcacggagtaccgaggtttggtttgtacggccggatgagatgtttttactgctccgattctttggagttggctgtgcttattcagtgtgctatggcctccttttgtccttgtaggtcttcagaagcagcgggagctcagcgcggactcgagtaagctctgatttgtatgatgttgatgctaggtgctgctgcttcgttcaggtgttgagaagttgagttgcaatgttgcgatcaataaatagaaataaaaacagttgcattgcaaaagtctgtgtggtagaactagaatattggtatttagtttcatcctagctgcatcgaattgttaatcacttgttctatgcatagacgtatagtgccttgattgttctatgtatagacatataatgcttgctttgggcgtgtcctttgccatcaactaaaggacaatctaggtcgaagtattctaccgttaacactttttatgaaagatccagattgatattttcatatgttattatgacaagttgattgtgagcattaacactatataagacatgcatggagcatctcatctatgagatcggtggtgtaagcattgcatctctgtaaatgttgaatgggttttctgatctctttccgcagcaattgagtcagtcttggaaacagccatcttcaaggctgggggcattcttgagagtaattatgggaagctgcaaaaagttggctgggaaaggagtagtagaactgataaaggggtaggattttacattttgacctatagagttgcacaaatgattctaatgtgttctttctgcttctttttgtctaacaaatgcttgtatgcatgcttagaacgaactaatttcaggtacattcactggccacaatgatctctctgaaaatggaaatccctgatcgagcatgggagaatgatcctgatggcattgctctttcaaacttcattaactcaaatttgccagacaatgttagagttttcagtgttttgcctgctcaaaggttagagactgaaaatcattgatatggagtgattgattgagttatgcatggaaaaacaacttttttattcatggtaccacatgcattcaatctcaggagtttcgatgtgaggagggaatgcttgtatcgggaatacttgtatcttcttcctgctgaaataattggaattaaaggtggttgtagctctgaagaagtaatggaacacctgtcagaattcaatagcattctgaaaggttttgaggtatgtgtatgatcaagtatatcgcctgcattctgtgcttagactgtgcaaaagaacatgacatatgatctctttgataaattgtttgatagcagatgtgtttatggagacacccagatactgccacatagttaaataagaataaaacatgagtttgtatgaccagtaaatacaccagaggttataaatatatcctgtcaatccattgtggaccttgactttgaattttactcttgcgtgttcctggatttgcttagatccagctgcaattcgtgagatggaaaaaatgaagtggaaaaacttatttggcacattttagcatgcttggaatccaagagggaaggtcaagcaggcccagtagcatcactgtgtcctaccttgtcgatttccaattatttgatgatggatgtacttcagtgaagagtttaacaagttcatctaaatactagactaaatttaagtttaggaaccatgtaggggtggtataactaaatagatgaaggactcctggttcattacactcttgcataacagttgctggagtattggacccaatgtgaattgtgaatttgcaaaaaggccagcccagtttgatcctggtaataatttcaccttttgacatctgggctttttccccaagaaacatctgattggtacatagcccaggtgagttgttttgctgaaccatctgaattgtttgttatgcatttcctttttactcaatacagtaattatagacattgtcagagtatttttatctctcattttacagtttattctgcatgtgcacagtttcattaaattggttatacatgtagggaaaccatccatttcataattacactgctcgtgccaagtataggaaagttctagcaggaaggcatcgtaaggtaaaaggggcaagctcagctgtaaattccatgcccactgaaatgagtttggaccaaagctcctctgatgacggaactacttcagaccatgatgaagaagacttgaactcttcgtcgataattggttctagtgtaccagaagacagttataaggataatcccgaattttctgagaagcaggttcagattcgagctaggtggcttcatgagcctgatgaaaatgatcgactgaatgcttcacatttcagagatatcctcacattctcctgtggagagctccagatttcatcaggaattcaatttgtggaattgactatatcaggagtatctttcatgctgcatcaggtatgcacaagaagtgaccccactcatcaatgaaaactaaaattctgcaatattactatgctatgttcgaaactctttgtaggctaattaatagtgatgttctttgttgtcaagggaattgcacacttgataccaaaaataccactctcaagtctcaacaaactagtagtttaagctgtttgactgcttctaaaatccaaactgtagtgttttgttttcactgttaaatgtttaattccttctgaaactatgcataatcagcaaaacgtttggtttgggttcatggtgatctattcactggttatatgccttagtatgaactgcagaacgaatatttgctgtaacagtattaagtattatgcatgcatggaactagtatgaatatgccgtgatgttttttttttttttgacctcagatccggaagatggttggtacttcggtggcggttaagcgtggattactacccaaagatattatagcactgtctcttgcaaagttttctcgcattgtgttaccaattgccccttctgaagttttggtgcttagagataacagtttctgcctgaggaacaagcaagggactatagttcgccctgggatccaatcaatgaatgaatctgaagaagtcaagaagggggtaatggaattctacagggcagctcttgttccagagctagcaaacttcctggatgcatccatgcctccatggaaagaatgggtggagaacttggaccgattcacgagcataccagatccacagctggaggaagttaggagcgcttatagggtgtggaaagcggactacgaccgagtaaaaatggccagaaagagtgccagcagcgactaatttgttgccaagcccatcgcacagtgaatgatgggctaaataaaattcttagctgaagagaaccccatgattctatctcggatatttcttcatacaggagcaggagcagcctgactgtcgggcagagccttgttttgatcatggccagtgagccattgagactgagctattggttgatcggactactacaaccttcagatttggttcaattgaatgtttttgcttaccgttttgcctaagccaatgttatgttgtatcccggccactgcaaaatctttgcagagcaatactctgatcagttgttaaaggaaaaccgaaggtagaaacatcgttaattatctgacgatattcaggcactgcaaaatccgcaagcatcataatcatctggtgatctcgtaggggcatggatgatatgttcctggcatggacgcgcgtctcgtcagtcacgcgctcacgcgtcaaggcagcgtgacctctggagagcttcagtgccctaattgtcgccttccgagcagcagcagcagccaaatcccgtcgtccgagctggaaaagatgatggaagctagtatatcagctgctattactacgctacgctccacaattatacacatcatctgggcgccagagctaggacccccccagcccccaggctcgtccgtgcccccggcccgacgacgacgaccgactgcctcgcgccgcgcgcgcggcagcagcagctctcgtgagccgcatcggcgacgtaacgtgtgcgtacgttttccctggccatcctggccccccctccccctcgcagctggagcaccacgacgacgacgacgcggcttgtcgcttcgcccgggcacggctgtttgtgcgacgacaacgacaaagccacgccgtgtacgcgcgcgcgctgatcgatcggtggtctctctgccttcgctcggagcgcgggcgactgttacgcccatgaagaaactgcgaccgccggcaaggacgacgcgctctcgtctcgctcgctcgctcgcgcgcgcgcgcgggtgggggtgggggtgtctcgtcgatacgtccacgtacgcgctttgttgttttgcacacggggagggagggagggagacgcgtcagtgcgtgtgaggccgcggcccgctcacaggagaggagtcacaggcgggcgcgggaagaggaggggcaaaaccgacgggggatcacgcggcggcacgcatcgatcgagtccgtccgcgggaggggcgtcacgggggcatagtgggtgtgtccggtgtcgtcgagccgcccctcgtcacccgtgtcccctaaacaaacggcacggcagcccgctgcttcccctctctccctcccacgcgcgcgcacgcacgcacgaatctatatgtaatgtaacaccgtcaagatatttgttactatgaggtaggagatgaatttatagtcattatcttttttttgaaaaaattaattagatactccatatatctctatgagatacatcactctataaacataaaatgaaaaaaaaaactatttttagaggttagatttatttttcttcaaacgtttatgagttaaatttaaatttgcatatttatgaagtgaaatatcttaggcatatcttattaattttaaaatattttttatgattatttagatggtgtgtaaaaattaactagtgttacattcccctaagtaatgaaaacagtttacctactaggtgattgatgattgcaaccgatcactccactttgctccatgcatatccagtatgtcacagtatgtcactcgctcgatcttgggaatggatataaatgttatcaacaaacacacacagtgatatgatccgggaggtctaaggctagcttcctttctcattgattggccgccatctgcatgcatggctccatgaattttggaaccggagcgatacaccttttttttccatctggtggtacgctggtatatctacagtgtcaatgaacagtgctactcatgaatgggagagaggtctcgcctatccagctacacgatgctcacccactgggctccatgcttgctctctgctccagccactgtttcagaacacagagccacagatgcatgcatgcatgcaccaaatgccatcaatcaggagcttcaaattaactttcaaagatctttccatcaaaaaaaaaactttcaaagagatcagggtttcaatgttgtgatgcatgctggtcgtagcactgttcagtgagtcagtaatatttagagctacgtactgaagtacagaacgtatgcctctgaatcccatctcatatgttacatgatcttatttgccatagactacatatacatatatcaataattatgatgatatgctccccctaattaacagtagtcctattacacaggaaatgcttcggtgtacttcgtttcaccgaattataggagcctatcatgcatgcatgcgccgccatgtagacggcggagacgacagatcagacaggagaaaagagaagaaattaatgccgggggaaaatggagaaagaaagaataggacagactaatcattcgagcaattgctgcgatcgatcggccatgctcgccgccggccggcgaggaggaggagatcgaaattaacagagctcgatcgatccgcttctgtgcttactcgtcgtcgtcgtcgtcgtcgtcgtcgtggtgatcgccgccgctgccggagcagctcctgatcgcccgcagcacggcctgcttcacgacgtgctcgtccaccttctccatcaggttcttcagttcaggggagagcatatacagagacaaagcaaagaaaaagaaaaaaggcatgtcaaactcttgtcccagaatgtatgccggcctacagtgtttcttggtactgaatcaatcgaaacatctgcctttacctctcgaaagggctcaatgaattctacccaaattgacttgggcttaatttgaattttggccgctaatgatataatttgttagctgattaatataattacctcgctaccgatggcttctaggcggaaggtgtcggtgcaggaggccgtggcctcgaggacgctgaggccgagctcgtcgaaggcctcgaggatggagacgaggagccccgggcagctcttgccggagaagacgttgacgaggaacccgtgtcttagggtttccacggtcacctgcatgccagacaccattaatcacagcagctcgatcagctcatcactgatgagaccagatagttaattttcagacacaaattaatcatgcgtgtagatgcagacatgggagcattgattaatgaactgtgtgtgctctgtctgcgcaacagtgtgcatgcgtgtacgtactggagtagtactagctactgaccaatccaaactccattaactggctcatcagctatagccgctatagcattacaagtatctcgtgcatgtgaacttcgctagagccactcgcaggttggcatctagctagcgcgcgctgtcctctctctgctcgtagtacgaaattaacagaagaagaagagagagagagagagagagagagaggaaaaaaaaaagcaaagcactgtgcaatgtgtctgtgcagtctctctctctctctctcagagggagtttaagctaggtgtgtgatgtg

SEQ ID NO: 80420 - DNA, 10344 bp, Oryza sativa
tgcagacctgacgcacggtcgggtcgttttttttcaatcagtgacgacatgcatgcacatgaaaagtttagcagagagaaaaccttaataagaaaggagagggtgtgattaattacagcgtgggagtgagtgatggaccggaggatttgcagcttctcctgtagcgccgccgctttcttgcgttccctcgacgacatcatcttcgtcctctgtaagtctgtatagcagcagctctctctctctctcgctcttcttaatttcttcgcctctctctctcacacacacaacacaaacacaatcacagacacacagctgaagctggattacgatgaaggcctgataacccaatcgaattagcgagagagatattggcttgagaaagatagagaggagagaaagagaggtgtatagcttgctgctagctggtgagcaagagctgctgctatagtacagcagcttagctagctcaaatggggaacaccgagatgaaggccactactactccatatgtatatagtggcttctctccccggccgtggccactcacgtgaccatattgttgtatccttctgatcatttctctcatctaaatatcaattgaagggaaaaaaaaggaaatgtgtatgcatgagaattcagtgaaggagataaagaagaaaagaaaggaaatattggacgtatgcataatgcatgtctgccatatatgtttactagtataaacctctgaatctatatgagaagggacaaaataagatcgactaacctatacatcgtgctgcatacgacgtcgaagcaagtggacgatagggttcggcaaatattattgattgcttttgtgttccgttctagctttaattttgctactaatacttaatctagatgtgaaatatgaaactggcatttcgagacatggttttattacttcctgggagcacacatgcacatgcatgatatgtatgcatgctactagctaatttaaacaatataatatatatcatcacgcgttatatacagtggatactgaaattccgtaatttgaagctgtaggctgggctgttcgaagaaatggatgatcgatacaaaagttgaattaggcgacaaattgatccatgtagctagatggacgtacggatatggtttggttccagcaatgtgcatcaccagctagaaggaatctgcttgacaagatgcagtgcatcctccatcccgtgtggattaaacaactgaccattatcattttttttatgaaaactgaccattagttatccgaggactagtatatgaacaacttgctgtacgtagtgtgaaatatatatttatatatcggatcatcgaatacataggatgcccccataatggaacacaaatatccaaggtccaaacatcactgttactacatatagtacttagcatggttggtagtagtcctccggccggtaaactgaataaatttctttcccccttttgacagggccagggagaacgatgcgtgtagctagggtagccatgagatcaccaaccaaatgaaacattctgatatgaggtgcatgtatcatgtatggcagccacgcatgtgctgggctggtgaccattcccaacgagagcaaaaggaatggaagaccacggcactagctaagctagctagagctaggcgtcctcgctcaattattttactgctccctttatattaaaaaaaataagagttgctcattgaacataactcaagtagttagcttgtgtttgattatgggacgtactagctaggtaagatgaaacgatattatccctaattttgggatgggatgattctactcgtacgtttgatccataggatgggacgatcccagtttcttaattgatagaaggagggagagatgggatgaatgttgtttgcagttaccgtcagcccacgcccaatcccgacaacatgcttgaactcgacggcgatagactgccgagcggaggaggagcagtatggcccgcgagcgggtggaaggaggagcggagcaagcaggcggaggagtggtgaccgacgggctagcaaacggtcgggcgagcgagctgccagcaagcaggcaggcgcaggtggtgactgacagctagcggtcaggcaagcaagccgtcatgcaagcgagcaagagggcggatgtgggtgatcacacgaaggagaagcaatgtggctcatgccgtgcgcccaacccgttgagttcgtccgcttatttttatcggatggcctggacccggatctaaggggaatactcctctaatgggactaaggttaaaggaagggggaaatgtgggtgtttagcaggcttaagaggatggctagaatagtaatacttggccgggttgagcagtgggaggaaggaaacaatcaggggttagaaggcagtagccaaatgaaacagggaggaacggccaggtgggggaggcaggtattcgtttttccctcacaagctattcccaacagtattttctttcttgacgagattttattttgtcctgaacttgtatttttccttaattagatctaatccggtttctgatagtgagatgcatgagttcaatatttcacatggctcaagataccgccacttgatcttgatccaacaacccaaaatacaaagtgtgtattttatctgctttttttaataatataaaagaagatcatttagactagatttgagagaagaagaaacaagagtacatgttcccgaagggcttaaaatcatatcataacaaactgtgtactgcacatattgacacacatactatgactacatattccccttgtttgctgccctgcaactagctaggagagcttggcagctgggctcgacagaagagggcagcagatacgttcgtacgaggcgataagtttttaatctatttctcttcgagagaatgacgacgcgacggcctggatatatataactagtttaactacagcgtgaccaccgcgtgcgcatgcactgtatacatacgcgcatacggccgggataccaccatgtgagatcgatcacatatatatggatgcattcatgtataccaaaccatataaatctagctatctagccattaaattaacacctacatgtacatgtaaaacgttacgaaatgatcgtatccatgctggcgatcgacttcacatgcgtggcgatcgatagagagaacgagatcgatcgatcactatacagtactaccgacgccgttgacttttcgtccaacgtttaaccattcgtcttattaaaaaaattacgtaatattatttattttattgtgacttgatacatcatcaaatgttctttatgcatgacataaatattttgatattttcacaaaagaattgaataaaaaaatagtcaaatattggttaaaaagtcaccggcgtcatatattaaaatacggagagagtatatatatatatacccaaaataaacgtagtagtagtacatccgtgacggtacgtacttacgtgctaagctagtgtggtgttgttgagttgtggatggttgggtgtgggtgtgggggccgagaggccgacgttaaccagcgaggcatgcatgcagatgcagctagctgctgctgcaatgtgctgcatggagcagctggggaggagctgagctgagctagctttggcgcgggcaggagaggagaggagaggagaggggtgggggaatctgctcgtgatcgaggtgggaggggggaagctagcggccacagcacacaggcgcagaggctgcaggcaggcacctgcagcaggggcgcccgcgacggcgccgcgcgcgcgcacgtcgtcgtttcgaagtgggctcagttattagcaatgcaagccaccacgacgacggcgggcagtttagctttcctaggctcctagctactcagctagcggcacatcatgcaattgcatgcatgatgaatttgttttctttacgccaattgcatgacggatttgtttttttaggtatgtaaaagacaacttatagagatgaatacaaatgtttatccaggtttatccctagaagttagttttttatgggacggagagagtataggtgcgctcacaatcatatttaaatttaattgtttatggagcaatatattattaataatatatttctttaataaccatttagatgacaaactgggtatcatgaatgatcaatttgtgacagagatcagttgcccatcgtagagacaatcatgcaattgcgaggagacatctctatttgtgatatcctggtcccattagaacgagacatgtgtggcccatgacaactgtatacatgtgtgcatatctagtaccacattaattattagttgagcaagaatggaaccaacttataaaagcttgttcatctatatcactctcgggttaacatattaatacgaagcaaatgacgaaagtgtaagtgggccagcccatcgaaagggttgggctaccgcggttcatgtagattgattgatgtttgtatatacaaaacacaattttatcgtgaaaattagaggttaacagttgtatatcaaattcaactttgatttaaaatgtatttaaaacaattgtatcgcgaaaataggtgtgaagaaatcaaaccgaattctatttttaaatttagctccacacaaaactgcatgaaattaaaatcccgtaatttatattgctccaagagaggtttcaaaccgaaaaatccctacacaacgaaataatggtgttgttgattcaaaaatttaaaactaatggtttatttagattgatgccatttcaaaccataccattcttttttaaattatcaaatatgtgcatccattcgtttcttgccaaactttaataaatacataagaaatcctgccaaaattttggcattgtcaaaatttggtaaaatttattttggctacaatctgaacagcctctaaactacaaaatacgatcttcaaattaaatattcctgtgagatctaactaacctttaaatttaactatattatgacaacttgaggtcatgcatatacgcaactgcatacagctgataaattaacctctagctctagacatataaagacacgagcaattaatataatactggtgcaagaatagtgcatacgtgaattatttgccccgtatatatacttttctctgaatagctatggtctattttctagagcattccatgccgcctggctagctcgatcgctcactagcttgcctgctcgctagctggagcttttgtcattccatgcaacagcgtgcatgggagagagctgatgagcacgcataagtacataacgtgataacaatttatactagacactggagctattttgtttttggaagcgatgagagatgtgccgcatgccaaactagtatatatgcaagcaatgcaagggtccaaggagaaatgctctcacggggcggagagattaatttctgccgccgtgcgttgtccggtttccccctcgtgttggcgccagccagcccacacgtgccgatcgcaacaaatcgttggcagagcaatacgaacaaatgggcctttgttcatgagttagcacccagtttgttgccttgcgatgggggacaacgatcgaagtagtctaatcagattgcgcgcgctcgtcctctgtgtggacaagatcgatcgagctagcggcagcatgaatgtttgctagagtatataatactatgaatctgaatagaaatagaataaatatttagtaagtcagtaattaagtgaaagtgggaggggtcgagtagttcaccaagaacaataaatttttagtactaataacactaagacgaggcaaaaatacctttccgacgaatctaggctaaaacaacgattatggcatcaacaggcaacatctatccacaaaattaatagcttgatctttctagttacttcctcggtcctaaaatataagtgattttggatggatatgacatattctattataatgaatttacacagactctatgtccaagtttattgtaataacacctaaaatcccttatatctttgagccgtaaggagtaattttacagctctcttaataaagtgtccaattagctataaatagacagttgcttaagagtcacccggcccgtaaaaacttttaaatatctgaccgtcaaatcacatcgagattcgtgcgtgcatgggaaaggaaataatcaagagtgtaacaggatgaggacttgaactctcagtttcagccgtaagggtgcacgccgctagccacatacgagcttaaaaggttatatataaaattatattgcaattacagtttaatgacgatataattatgctattacgtactcgtattatactccctccgtttctaaatagttgacacggttgattttttaaaaacatgtttgactgttcgtcttatttaaaaacttttgagaaatatataaaattatatgtatacatataagtatattgaataatgaatcaaatggttaaattttttttaataagatgaatggtcaaacatattaaaaaaagttaacggcgttaaatattttgaaacggagagagagtattacatttgaaaaaaaaaattaaaaaagggcctaataatataactatacccccgaccgttagcttacagcaagactgattatattacacatacatgacatctggaaagcgacatgccaaaagttgatgttggaattaatgaatgggccttagcccactcgaagattaattctttggaaaatcacaaaagcccacctcatgggatggcatgcatgtggagtttagtaccaccttgcttattctaggaaagggggacctccttaaaagggaggatgccctcctagccacttgaagcatgtgtggtggagagaagagggggaacacgtgcgcgctcgctcgccaggccgggcccgcgcacaacgtacgacgtacgtagaatggtccgtcaaaattggttcctcaccttgctgcagatgcagcctccttttgcagttttgttttgctgcaaattcagattcgtttttgttttggaaacgcagttttgttttgctgcaaattcagattcgtttttgttttggaaacgttccgaaaaatccggtgtgtgcaaacggtgtggagtccggataagttacgcgcgacttattcggttcggttacgcgcagtggagatggtgcgggcgccctgatcaagcgacccttctctatataaaccgagccgccgccttcacgcaacacacgcgaaatcaatctagggtttgcctcctactctgtgttgcgccgtcgctcgtaggttactccatcccgctcgccggcgtgcacctgcgatcgggagagcaggtctccggaacctctgccttcgatgtcctgcaccgggagaaggcggcaataaggttttttggaagcgcgttgcgcgactgctccctgttcgtccgcgacggctcgtcttcctcttcgctcgcgtgctgcgtgccttcgtagacgcctacgaaaagtttcgaccgagcagccggcctttacgccacctcagtacgtgttcaatatgttgcgcatgtttgatctattcatgttatactgtgtagtttacatgtgtagatctaatgatgcgttcgtgctagttttcatctgtaatgtcatgatttatttatgaaatagattaaatcattatatgcctataatctcaacagttgacgcgatgcaccgtggattcgtagctagagactacaaccagtaccgtagcggtacaatataactaatctctacctatatatgcatacgaacgacaaccccatcccgggaaggcatcatacacacacaaacgtcgtacgaatcgactggacccgcgcgcgtccatcgatcgatcgatcgatcacgacgacgacacagcacggccccaattttcaaatcgcccacgtacggtcgctcgctgtacacgttcgaacatactccacactccgtccagtggcggtggtggctggccggcgcgcgaccccagcgcctgcacgcgcgcgtatactacgcccgttaccatatatacatgcatccaaccggccgcgaccgtggccatctcgtacagtcgcccggcggcgcttctctcgatcgatcgtgagacgatcgagcaggctaaatcgaccgcgcgcgcgacgacgtgacccaccgatcgccgatcggcgacggccgcatgcctcgctagctagccacctcagcgcctgatcgacgaggtaacgcgtgtattgccgcgtgccgcccgggcggacttgcattgccatgcatcgatatgacgatatcctcctcgcgatcgactcgatcgcgaacgagcagtacgcgcgcggttgagtaaacggcatgcagtctcgacagtttttaactctcgatcggtcgggctactattacatactccctccgtttcaaaatgtttaacaccgttgactttttagcacatgtttgaccgttcgtcttattcaaaataatttgtgaaatatgtaaaactatatgtgtacatgaaagtatatttaacaatgaatcaaatgatatgaaaagagtaaataattacttaaaattttaaaataagacaaatggtcaaatacgtactaaaaagtcaacgatatcaaacattttaaaatagggggagtactctactatatacttacatgcagtaccgtcatgcaccgagaaccaagctacaggcggttttttattaaccagctaaacctaagctatctgccggccagtaattaagttgccacatatggtaggagtaataagttcctgttcttttctccaacaaaagttggatgaagattaagatttttgtggcacgtttttaaattttcaaacggtgtgtttcgtgcgaaaactttctatatgaaagttactctaaaatatcatattaatatattttttaagtttgtaataattaaaactcaatcaatcatacgttaataccatatcgttttgcgtaaaaaacttaatctttatcttcatctttagaagaaaaaaacaccacctaagtaagcttaagtaagtaagattctattatgcctgatacgatcgatcctggatcgatagatttgactgttgcccggtccggccagatcggccaccaagaggggaagggtcgtgtaggttttccaaaaaaacaaataataaaaaaatgaaaagaggggtcgtgtaagctggctgaaaagctgtttgtgtaggccgccggagagaatcgaatgtgacgcatatgcctccgccatcccccttccctcctttcctacacggctacacatatctaatgtgatgtttggatttagggactaaactccctgtcacatcggatgtttgacactaatttaaagtattaaatataaactatacttacaaaactaattatataaatgaaagctaattcgtgagataaattttttaagcctaattaattaatctataattagagaatgtttattgtagcataaaataggctaatcatagattaattaggctcaatagattcgtctcgcgaattagtccagaattatgaaatgaattttatcattagtttacatttaatacttttaattagtgtctaaatattcgatatgacagacccatccaaacaccccctaactatacctcttgtgtgcacagaaaaattttcacatccatcgtctatcaacctgaggtgacctaagctagctttgtatcactgtctttgatggcatatgcgcagcaacattccacatacacattcccctattttattgggcaaacaacccttttcatcgatctctctctcgcccgtgttagggtgcatgcagggaatatgttgctgagctgtacatggttttgggccacactaggcatagccctcctagtcttcacttaaaatcaagacttaattaattactccaagtcgtaatcgtacgtccgttaatgaatcttatcgcctcagatcacaacacgtacgtagtctctacaataatagcaactatatattagtacgcaaatgtgccaatgtgcatgcatgttcagaactactcctagctaagctagatcattgatcatatatcgtcgtacatataatgtacttttcctgctggtttacgtcattttctaactggattaattattattccacacatatgttctaacttcagctagaacgtgttggaccagctacatactccagcatcttgtatgtggggctagcttactaccaatatgatgataagctattggtgataaccatcgatctctcttctaactctcaggcagaattgaagctctctcgattggtagtgtggtgtgtaaccatattaatgtagagagaaggtacagtaagggggactgatttgggggagagagagagagagagagagctggcag

SEQ ID NO: 80421 - DNA, 1958 bp, Oryza sativa
tatacatgatggtctgtaaattaaataccatggaaatagagcaatttccatatttgtctctgatggagccccactaacatgtagtaggcctgtactgttggcacttagctagataccattgtagtaagaataaataagaggcaaatgaagaaaccagtaaactttaggggagaaaaggaaatttatatgatgaaaattaataaccatgcatgcaccataacttgctaatttgcttgttctttgtttgttttttccagggtaacaacttaaacatggccttaattagtgaacaactgctctcggtcatatgcacgtacgtagacaagcatgtacatataacaataatactagttaagcatgaaaagccaacatggaactcctacatatatgaaaaattcaaatgggtactcaagacagatctggaatggtcgaaatatatgctggttttgtttgcgacatacatgaacttattgtgttccttgaatcctcctcatatattctaagacaggggcaaatatctttcacacaagtagctactcctagctagtagagaactagagatagctagctagcggttcccaccaattattgcaagcacaaacacaaatcaaggtgaaagacgaagaatgccaaatgcaacttgcaagaaagagatgcgcgtggcttgtcgtaatatagttttttgttacagcaaatatctgtccttactaattaagtccaaacatgtacgtacgcagctatatatatataggagtagatcatactatgtatcgatcagtacatatacaattattattattattattattattattattattattattattattattattattattattattattattattattattattattattattattattattattttcagcttgctggacgtaagtatatatatgaatcggagtatatatattctgttcttgcaatctagctacctagctagctacctccatttcagaaggtaagatgttttggttttatctcaagtcggacttctataagtttaatcaaagaaaatgtaataacatctatgatgtcaaatgaattttattaagagattgttcactttgtttcatttttaatgttaccaagttttcgtattgctaaattttagaagggcaacaaactaaacacattcttgccattgctactataccaaattttgaaaaaaaacggaagcttccactcaaaaaaaaaactttaccaaaatttagtcacactaaaacatccaaaatttgataatgacaaatattggtagggttgaaaatggtaacaaagtgaactaaatccaccattgaatatattaatactcctatatttgcttggtgttaaaaatattgctatgtttgtttttttaaaaaaaaattgatcaatcttatagaaggttaatttatagcaaaatatagccatcgtcttacattcttaaatggagggagctaggtgttttgatttaaagaaaaagattattctcgaaagcaattaatattccttttaggtattcaactagggaatggagcaattaatttcttgcacaacatatgtattactattagagtacacgacgctgatgtaatggatcaacactagcgtcttaattatatggggaaaaatacgtaaattaaaccatggaaggataattaaaccatggatgacgcctacggtaccgctcaggcatggcaacagaaatacagaacaaacaatatttaatatgcagcttatagctatcacacaagtcgagcaagcacgcacgcatggcacgatatggatcgagacgccgtcacgtgggtcaccatggggcatgcatgcaatgcatgatcagtttgtgacgaagactgacggtcactactacaaaagtgatttttctatacgagaccccatgatttttgcaaacggaccataactagtggcgcctgcaaaaatcacgcggcattttc

SEQ ID NO: 80422 - DNA, 10695 bp, Oryza sativa
ccaaattggatgattctttttcctaaatgtttctaaaatcatgctctatcatgttatctgtgttgctactgttattatttaggccattttttcttgtaactttgttttatcaatttaaaatttaaatttcaaatcttcaaataatattatgaagcaataaacgatttcagctgaaaaagtcaacaacaacaaagttgtataactcatcgatatctataatttctattttggtcatttcttcatttgacaaagtgatactaacattttcacaaaatttacatctctctcttatagttataaaactatataatagatatgtacattttgtgaataatcttacaaatcactttgtcggatgaataaatgaccaaaataaaagttatagatattaatgagttacaccaatttgttattgacgactttttcagttgaaatcatttagtatctgaaaatgttgtttgaagttgttataatttgaaattcaaattcagactgttcaaacaaagtcatatagaaaaatgaccaatacaaaagttgtagatcttgataagttatacaactttgtttttgataacttttccatttgaaatcatttactacctaaaaaactatttgaatttcttatattttaaaatttaaattttatatagttcaatcaaactcggatagagaaatgaccaaaagaaaattggtagatctcaacgacttctacaactttatttttggcaactttttcatatgagtttatttaagaccataaaattttattcgaagttctcacatttttaattaattttttaatgcttatttttacatgcggaccacttaaggagccgcatgcaaaaattggtccacatgcaaaaatatcaacagttttttcagttttttccctcctcaccacttcaaaaattttcatctcccctcctctcctctctctctgtctcctctctctgatatcctcacccctctctttttctttctcttcctctcactctctttctcttcctctctctctctttctctcctttgcgcgtggccaacgagggggcgccgagcagcgggcggtaggcggcgtcgagcagcgggcggtgggcggcagcggctcggcggccgacaacgacgacggccgcggtgggagcggcgacggcgggcggcgggagcggctacggcggcggcggcggctcggcggccgacaacgatgacggccgcggcgggggcgacggatccgatgctgccgccgacggatccggcaccggtgacgacgatgggtggcgggggcgatggatccgccgccggcgacgacgctgggcggcgggggcgacggatccgccgccgccgacgacggccgcggtgggagcagcgacggcgggcggcgggagcggctacggcggcggcgggctcgcagcggggtcgcggcggcggcttggcaacctcggctcggtggccgacaacgacgacggccgcggcgggggcgacggatccgatgccgccgccgacggatccggcaccggtgatgacgatgggtggcgggggcgatggatccgccgccggcgacgacgctgggcgacaggggcgacggatccaccgccgacgacgacgccgagcggtgggggtgacggatccggtgccgccgccgacggatccggcgccggcgacggcggggggtggcgggagcgatggatccgctgccggcgacggcgtgcggcgtggatacggcgctccggtggcgggctagggtttggtttggggttttttcgattttattttttttgtttgcttaatttattttcgcatgcggccggtataagcaactgcatgcgaaaataggattttcgcatgcggttgcgccggccgcatgcaaaaagggtgatttttacagacgatttcgtccatgcggttggcacaaccgcatggaaagttggttctcagctgtatggaaaaaccatatctgtagtagtgggtgtcagacgagttagcgtgacaacgtacgtacggctgatccatacacatataggcagcctgtgagcctggtatatatgagtttaaatatccattattccttacctagcttataatccgatctttaatcagcaatactgcaatatagctagtattccctccgtttcaggatataagacggtcaaaatcaaattgttttaagtttaaccaagtttgtagacaaatataataatatttataatactaaattagtttcatatcaaatcaataattgaatattttttaataaatttgtcttgggttgaaaatatttttatttttctctaccaacttagtcaaacttaaagcagtttgactttaaccaaaatcaaaacgttttatacctgaaacggagatagtacggtataacttcaattcgatcctataccatacacgtccgtgtgtgtctctaattaatttctttatgcgaaatgctttcaaattaatttcgacgtacatttggcgcatgcagcgcgtgacgtaggtgcaaatcgtactcaggtagtcaggtataggtacgtggtgtatcgatctgacccatcaggggggcgtcggtcacatgcgtacatacgtacatgcgccattgttcgtatatgcaggctctgtgtgtacaaaacggtgtctaggattctcgggggcggtaaactagctcccaaggctcacgtgacggcggcgagggcgcgatcgatatgaatatgatcgagcggtcgatcgggagagagccgagcgctttggaaagtacactcacatgccattggcagaatgtaccccctgcaggctgcagccatactactggtagctagctcccctgagcataccgatcagatatggactttcatctctagagaaaatatcatctaaatagttatcaaaatatttgatattccctccgtcctattttaaatgcaatcataagtttttcgtacccaactttaattgttcgtcttatttgaattatttttataattagtatttttattgctataagatgataaaatctgattagtactttatgcgtgacttatgttctcgaatttttttaaaacatttttaaataagatgaacggtcaaaatttggcacagaaaatcatggcagcacttacaatgggacggagggagtaataaagagtaatacatagtgtgaaataccacaaaccgctataccaaattcgatttctacaaattgcaacagaaaaataaattaaactgaaaaaagtaatcgtacatttataattatatttgttatttttgttacaacttgtataagttgaattttaacttgcatgtttatagagtaatatattttatattaatttatcttgctaattttttaataatttagactagtaatatacccgtgctaaacgctacggtacaatatcattgtctttaataacttttaaatttcattttagaaattttctatgatctatgcatcgtatcgattcacctttctatgttttcccctccatgtccattcacctttcaatttttttttcttcctaatatttttctctctatctgttcagcttccattttttccccggtatatttaggttgtgttccctaaaagaaaccactccctccactcgtaaaatggaacgatgaattaacacgtgattaattaagtattagctaaaaatacttttaaaaggattaatatggtttttttaaagcaacttctgtatataattgtttttatgaaaaataacacgcttaatgattagggaagcatgcgtacgggaaacgaggcagtggaggttggaaacctcaataaacaaacgcagccttattgatatttgacctcaaataaaatttataaataaaacacaatacagtactacctcagaaagaaaataataacatcgattttcattattcatacgtgccatcatctctcacaagtacaatacatagatcagatcagaaaacaggtactgcatagatctcagcaccttcagtttgttctcagcacatcatccagcatgttttactgaaggccaacattttttaaaagcactgaaaagcataatcatgtattaatcccttgagacttctcttcataccatcaagttttggcaataaagttgtgtagattaaccgaggagataaagtaattaaccatgcatttatgcataagtgtgatttagcttgcacagaaacatgtatcttccatgccacagtacctatctttagaggtaggaatgaaatgaaaaattgaacaccagttagcccctaatgtaaatcagtaagatatagtccaaacgtagacaccaaacgcggcgagttacggaatatagaacctgcaatacaagaaaagatgatatcaaaatacagctatatttctttttcttgaaaaataatgttctgtaaaggtcaaagcaatccaacacaatcatggtaccccctatagttacaggcccttcccgtcaatatcatatatatgcaagccatcgagatgacattgcaaaaagttattggaaatgccatacataataagatgttggaggagaaaagctcatatatgaaaccaaacaaggacaggccgatgaccatataaaaaacaatacatttcgagccgcatgttatatttttatacaaagaaaagaggaacgaagatttaaaaaaataagggccaaaaaataaccccacatattcgggggctggaccccccattcatataaaaattggatctatcactatgctggaggtaaatatataataaacatggtgtgcataagagtagcagtcccgtataagagtagttgaaaatcatatggccgctgtatctcttctcacgcacaaaaaggatccaaaatatcttgttaataaaaaacaccactcatgcaagatacaaggttgcaataaaaaacctaaactcaatttattcatccatggtagtgcagacatattatgattatagagcaatatatcagaattatctgttgtttcgcatgagtatatttcaggaaagtaaggcaaaaacagacaaacaacaggcacactacttactccgttgatataagaaatttcagcatcgttatcactataatatgaaattttagttatcctgagcaggaatatttctgttatcatctaattaaattttgcatccaaaatggttgaactgtaatgccattattttgactcacaagcaatgagaagatattttcagacagctaggtcaaagttctcattccaccaaaaaatacagaagaaaatccaccaactttctttaaatagttgtgaaataaacaaaaacaatcatgtactggtacgacatgtttcccttttacagagttccaggaagtgcatcgaactatctaagtacaccagcaagacaatgcggctattttgatcattttgcctgaagaaatgaagttttatactccactaaacaaatctaaaactcatgaattagaacctgatgggctgcagacgagatcgagctgcaaacttctagagcccctgctggaattaaactgctctcaagaaagaaaagaaaagacaaacctttgttccccttctgtagttctcaacaacaatgttgataatcaatcaccagataaacaaaaataatggagtacagtgtaacagtgaaaatactgtaaatatatacatgttgaattatctgatcccatacttccccttttgacatacatgtggccaatgtaaaataataatcagcaagaatagattcattcttattttcaactctctctttcagtcactttcgaacaaattctctgtgatttctgagggaaggaatgtttcctacttgacattttcagaaaaacgtattgaagtacaacatactgaaacataaattgtctagaacagcatcatttagtacttgtagttataaactgaaacatgtaactggtaaacataaattcgctgcgagggagactttcctggatggtcgtcagtgacaggcggaggtcgaggacggagatgcagtgtggtcgtggatgacaacatgggcagcgcaggtgaaatagacgttctacggtatcaacggcgccgcaagatcggcgaggtggaaattgatgtccctgccttatccaatttagcttgttgtcccagacaactaagcattctgtataccaagccaaaaaaaaaaaagatagtagcatgcagattagttcgtagccttttaaattcattcatgcacagaaagcatcaaatacccctcacaatctaatttcagccgacaatatatctgataatgcaactacaatttgaaaatttctaccttgtgcacagatagagtacaaaaccacacattgaggacaaaattgtttgatgaactgaatgtaagactgtttatactgcatttaatcgagcacctcccggacatggaaatttgaaaccacacattcagtgaaacacagagaaagaaaatgattgaatgctgcaacgatgaatcctaggcacgcagcggcggaccccgtcgcgctgtaaatgaaagatcggtggcggggtgactgattgggtgagaggagacttacatattagggatgggggagagagagagaagggagagggggatgggggacgaggggctctgtaccttccaacgacaaagggaccgcgtgagtgcgattcggagagacggcgggtggtgcttgaggcggccgcgcgttgccggaggagatcagcaaggcggagggacggcggcgcgactgcacgcctcggccggagaagaaggtgcgcacggctcactggcggcggtgggttgagggatcgggtggcggcggtgggctgagggatcgggaggaatcggcagcgacggcttatcgcgagcggcggcggcggtgaggtgcggtcctgggagggcgagagggggagggatgcgcgagatcgtgggcggaggcgccgccgtcggagaaaatttcgggcggaccgcggacggagagaggacgcgggtctgggagcgcgagagagaggtgggtcgggggtggatttggcaaccgtacgtgaggagggcggtggagtccatcagatccgttggttcaagcgcggatgatacaagtcgttggatttgatgaatgaagtatgaagaatgtagaactgtgttggtgaattatagggtagaagatgacatacacgaaacgaggtatatcccttcaaggaatgaaacactttcccaatagtatgcaacaaaagagtcaatcaaaccgcagcgtagagtaacgtaatgcaatagtatgcgtgtgcccgcatctgctccgtagcgagccggcctatcgatcgcgccatcgcccgcctcagaatcatttcccatgtgattgatatacaatttaactagggctgtaaaaaaaaggtttgggggctcagctcataagctgctcgatctgactcactctatgcttgatacgagctcagctcgagctccagatgagctgagctcgagcctatatatatcaaaacttgctagctttgtcgagccgagctcttgacctcctgtcaagcctaacatgtatattttatttattatttatcaaatcatatttacatgttctttagtgacatattttgaataataatttattacatgctatgttttcaatgaatatgaaattagcatcacatgaaagtacttcaaaacataaatctagtgatataacgtgcataataccttttttagataatacacatgcacaatatttagcatagatattaatatgatcactagtaaaaattatcgagttcgatttaagaaaatgaggcgtctataatttaggaacgagagagtaccatttatatgtatccatgcaatgaaatagtttatattggtatcatgtatttatctttttgtacttattcattaatatgattgaattaaatgagttattttttttattgagaatcatcctcaaaatataagtgcaccacttattatgagctaattaggcttgatgatattcaagcttgaactgagtctgcttggaagctcggatttttcacggactctcgattcgttgataatcctacagataacgagaggatgttaatttcaagagtttagaatatatatcgtcgcgtccccggcccgcgcgacgatcggcgcccgcgcctgcatggctgcgttcaacgcgcgcgcgtcccgacccgatcacatgcatgcaagctccgacgcgcgcgaggggcctcgcgtcgccggccggaggaggcgctggcgcgatgcaatgctgccgtagtcgtagcggtgtgtgcggcgctgctgcgctcggggggagagggaggggggggggggggggttgatccattttggctctggctgctgatgagtgatgatgcatgcgcctgctgctgcgccgtactagcggcgagcgatttggcgtgcttcgtcgtagggatgatgatgatgtgtggactggtatagtacactgctgagggctagtactgccatgcaagttaggtactccgtcgtctagcactctagcacaggtgtataatccctccgtaaaaaaaataaatatataattaaatataacatattttagtacgacgaatttgtataaatatatatctagattcataatactagtatgtgtcatatctagtactagattgattttttatgggacgaaagagagtatatacatgaagctaattaatttctccgttagtttaactacctcttcaaaaatatttaacattaagatgcacttgatagtgttgtggcaaggcgtgtgtcatttcaacccgaggttccgtgtttaatccctaaaacactcacaatttctctctctccaatttttgtttcttttaaaaaaaatttaacatctactagtattagaataagtcgatagcttattttaagcatagtaaaaacgcaggccttcatataaacaagtactccctctgtcccataatataagggattttggtgaatgtgacatattctagtacaatgaatctggtcagacagtctatccagattcattgtactccatccgtcctataatataagagattttgggtggatgtgacatatcctagtaagcgatatggcacaaagcccacctatatcaaaattacttgcatgataatagagagaaaccactaataaaaaccgttgtacatgtccttatagtcagaatgttaaatatttgattagatcttatcctagtaatcaaatattttttactggaagtttaaaaaacattacatggaagatatgtagccacacgcacgtaaaattaatttcaaatgttatttatggagttcaaatattataagataatattgtgatcaaagatgttcactcgtaaccaactgaaaatcgtaaagcttttgttgcgatatggcacaaagcccaccattcgcaatttcggtccattaatattttgggaggatcagagcagctcatcaggcccacgcccaccacaccggctcatctgcgtgtctttccttctctccttttcctatgacgtgaggcgttcttttcttcgtgtcgcatttcgggctccttgtgccaagataaaaggaaaagttcaatgggctttcaaatttcatttcaaaccttacgaatgtggccgaaaagaaaaaagaactaacgaaacgtacgtgagggcttgcttttcttcgtgttgcatttcaggctcgttgcgaagataaaaggaaaagtggcaacgatttcaatgggctttcaaatttcatctcaaaccttacgaaatgtggccgaaaagaaaaaataactaacaaaatgtgacgaaaaaaagaagtgcaaaattgatgcgcatccggggaatcgaaccccggtcagtaccgtgggagggtactatgataccactacaccagatgcgcttgacgcttgaaattaaacgattatttatatattctttacaatactcacttcaaatgacatcaactaaaggcacacttcattgaattttatatattcttctggggaaacaagcttgatttcatatcggtttaatttctgactgttgcatagcactgtcgacgaatttacacatccaaattcccctaattccctctttaaaaataatttgggaaatcaacaagctcgcactgattgccctctgcacaggccggcgtgttgtgtggacatccccgtcaacagtcaccctcctagctgctaaatgaattgcttccaataatgatttctttcatcatcctggcctacctaatcagcaatcaatccggatcccatctgatgtgctccatcgaggcatcgactcaccgcgcgcagaaagcgaagcgcatgacaccatcgacctatcccctgtcactctttcagtactgacgatctctcatccgattcgccaagcaccaaccaagcagttcggccagccgagaatgcaaatttaaccaacacaacattaagcatttgcacatcatcatcacgcacgcagtttattatactcgtatatatatatatatatatatattataagtgctcctttggaacattgagaagtggagagaatctatgaggctgaaatcctatgaaaaataatcctaatcagttctttgcaacaaatgattgtgtggcttccacaaaattctttagaacttatatggaatgacccgtttcgatataattttggaggaaaactagtaagggcgtgttctttctggtttgattttggcttattatttgcacgtaaaacgagatacattattagcatataattaaattgtgtactatatatttaaaactta

SEQ ID NO: 80423 - DNA, 2842 bp, Oryza sativa
aagataaagtactatttgttagaattttgtctttttttggttagggctaaaatatagtaatatatttgaagatgagacttaaaacatatatgcaataccattgaaagtacatgcatatttttttaagaaaaataatatcatatttgctagttggtatgtacgaagtatgcacatgattcgttccctatttggacatatgtttctacaagattgagcagttctcaaaaatcttgcgaagtttatgctccaatcagcctagagtgtaactcagacacggagagtagcacaaaaagaaaagtagaaacatattttttttaccagtttttatatgaatatacacatttagaaggaatttgcaaaagtatatcattgtcgcgaaatgatgatgcaaattcacagcgagtttatacgggaagtacgcaaactggtgacgtgtacgagatgtcaacgctgtgttcggcatttggtgttgggagctaatcccttctgcacgtaaatcggagtgactcaataatgcattatcaattaagtattagctatttttttaaaaaaatggtttaatataattttttaaagaaactttcatatagaaaatgtttacaatataacacgtcgtttagcaatttaaaaatcgtgcacgtaaaaaaataggaaggaaagtgagttgggaaagtaaggggaagaacacagcattagtagcgaacggcgattgcatctcctcccttctctctcctttgccttttgcattttaggtcccagctcgggcttcaacgtctgcgacgccatccctctccccttgatatccccgaagaacgtgtgaccagtttttgctccgcgttcttcacaacaccacacgcaaggaggatgtggcagcgaatctttgacatggatagcccaggctgaatgccaactgtatgcattgtgaacgcccttatttggccattcacaacgcgcacacgctaggtgtggtgatgttggccacgtagacaactcgcttacgtgaagaagacaggggagtggtttcttcaccggatctgcatgaccaaagttggttactagaaccttgcagcagtttggtaaaaaaatgtgcttatctggggatggagagagagagagagatagagatggaagaacagtgtcagacagaaaagaaaagctcaatttgagccggagtagagacgctcggggaggtcgccgctgttgcgtgggctcggggaagccaccgctgtcgttgcgtggattcggggtattgaggcaagaagctggaaaaggaagggaaaagccctgcttccgccgccgccgtgttttctcctaaacagcgccaacggtggtgtgtgtgtgtgtgtgttaggggggggaggatgggggcaccaaatctgcatcgccggtgggagaggagagggtggaggagttggggaggtgtggcagattttgctccgaaggtgcaacattttttgtttttgtgctgggctagcgtgaaaaaaattggtggtgggccccatctaaagctacgcaccctggggagatgggagccccatttgctttttctatgtggacgcttaggctgcatggtgagacctaaaacatttctactatccttagggtgtgttcgccgttgctcgttcccaaccgggaagagtacgcacagaaaacagagcgatccattagcgcgtgattaattaaatgttagctttcttttttcaaaaataggttaatttgatttttttaagtaactttcgtatataaacttttttaaaaagcataccgtttagcagtttgaaaagcgtgcgcgcgaaaaacgagagagaagagttaggaagaggggcatccgaacacagccttaatgtacgactatgtatatttttacaaattctttccaaacatatatattcctataaaaccgatgaaaagaatatattttaaattttatttcagagtagcacgcggtaagaacaaggacagccactacgtttcaccatcgctaccagaatagactggcgaatggtacaggcattgcctttcggcagctgccaataggaccaaagaaggaagtcgaaaaggaaaggcgctccgatgagcagaggatgaactgccttttgatcagaaaagcacaatgtgtcagttcttgtcggaaggagaaatcagaaagtgatgttctcggtgtcaggtgatgtaatgtgagcagactgctctgctgtgtgcaggtatttaagttccagaattcagagctgaaacaaagaggagctgatccagtggtaatttgcacggccacacaatccattttgtcatggtactgcggccattgttccaaattggaccggggaagagagcaatctgaatattcagggcacaagataataatgggagaaaaaaaaaaggaaagctggccttagagagcactattcacacacttttgaccttcggaatacagaaatttcattcgagttaattcactttgcatagaaatcgacacaaaaagttctaacatccaagagaatgccaacatagcactattaaagaaaaagacgcatttaccaaaccataccttcctttggtagagacaaatgggattcaagcatcaagcaaagaacatcaaaatagagcaacaagagaatgcttaagattaagctaacatattcccccgattttttcttctttcaagttaaacttaaggtaaaagaactacaatggtataattagttgctacccattagccttcttggcctaactatagacaattgaggaggacaagagatcgacagaactttacatggacgaatatatatgctattagaatcctcgcatttgcgctctcctgaggttatgaaaaaagctcaacctg

SEQ ID NO: 80424 - DNA, 4850 bp, Oryza sativa
cacatatgcatggaaggttttactgtaaaaaaatagtgattacattcgtgcgattttaaaaaaagaacacttgagtgacatatagcttgccccatgcagcttagtacttagggtgcattcgaatatgcttatgaactgagctttttagcctcacgcaaaacataacaagttattaccgtataattaattaattaattaagtattaactattataaatttaaaaataaaattatttgatttcttttattaaaatatgtatatataatacttacaaaatgtagtttaggaaatcgtactcagggaaacgagtaagtaattaattaaccagaaatgggagccttaattaccagtgagtacaaccaggtcggtggggctgagccctttcccggcgaagctagtgacgaagttacccaggtcggtggtcggtggatggaggttggtgttcgccatggtttggttcgtcgtcatcccgtccctcctcccgagctccaccgggtacgatggacctcctagctgcatccatgtcgtacaatgttaatggctgctctcttcgtctaaaaaaaataaatctactatcttatatccagattcgtagtattagaatgtgtcacatctcatttgagatttgtcttttacaggacggagagagttgttgcgttcaattaatttgagacaagctagcaagcttgggatcgacgtacggcgacgacggagtcgcgggcggcgacagcaaggatgtcggcgcaggagacggtctgcctgcaagatgcctcgagttgcatcttaatgctagagatgacctcgaatcccctcagcgagttgacattagggaacgcaccctgctccccccggaaggtggcattgtcggccagcagtatcgacgcgtcgcatccctatgaaattggtaagaaaattaagtctatgacataagagacatgctattgaaaaaaatgtgaataagccataacggttacactgaacaaagtataaagtatatgtctaataaactgtgacaacaaaaaaatgtggtgtggtaaagtgttatcgtgaaccaaacaccctggcctgtaaatcacaacatcctacctagccaattcatgttagtagtatatcccaatagaatttcactgagatcaagaatatatctctttaagcgtgtgttatgaggacacattcgtggatatataagtatagtgttacgtgtgtagtggcatgtgtctatcatgtaatcggaaaaaaaatcatataaagcaatagagaattaagtaaaaaaatcatataaagcaatagagaattaagtataggggcaggagtaataattaagattttaagactaatggatgagacttgcttggacaaagcagtcgtggaagtggagcctgagcagggaggcgcccatgcggggctccctggccaccgccgcgttcacggcgctcctgatcgtcgacagcgcggtcgggcacgacgaggcgtagaacgtcgtcgacagctggcccgacgccgccgccgccaacgccaccaccaaaacgctcaccgccacggcggcggaagagtaggagtaacccatatggtcaaaatgaaatatcacaacttcacaagctctctctcgttgctgtggctttgcttaattggtgctgtactgcttaattacctgcattggcaatgcacacccacagtcacgtatatatatagccacagagtcacttgacaaagccctcgagagctcagcttatagctagctactcccttcgtccctaaatgtttaacgctgttgacttttttaaacatgtttgaccgttcgtcttattaaaaaaattaaataattattaatgatttttttatcatttaattcattgttaaaagtatatatacatatagttttatatatttcgtaaaagtttttaaataagacgaacagtaaaacatatttaaaaaagttaacgccgtcaaacatttaagatggaggtagtattaagcacttgtctttacatgctaattattgtacggctcgtgaacagaaaaccccaaggctctgtggccctcgggctctgtggcagcaactggttagttagcttgtcctgctgcatgcatgcatgttctccttctgcagtgcagtgctgagggactggaattctggaaagatgtagtatatatacggaacgacatcaatattactatcgtggtctcaatcaatgacgacctgtaataactaatcatgcacgcacgtatgtttccataacaacacaggtacgcataatctttggccctaattacctgaattagtagcacaaactgtattgatcgatgcctctaagtatcttcagaataagccgtgttaatcaactgggactcctgaagtgaccgaggttaattgatcttagtggtgttggagagcgctatgtacctgcttgactgtttaattaacgtatacatacgaacatatgcgataaatcatgatatcaaataattcagccgaaatcatgatatcaaataattcagccgagataattaaacgccaatgatattattgttggagcggatatatttatgatttcaacacggcttttcttatctgtttacgaacaaaacgaaagagtgtagtgtgctctggtcctgtcatacttggataaattactcacaaagtttgatcatgggaacaaaatgtacactgtagcagggaaactaatcatcttctagcggttgtggtcagccagctcagtgttagcctgtatcgactaacaacgaacaaattaataagacagcttaacaagaaacaatattcatacccatcagcatagggacatcctttgcggcacatgcatttgcatggatgcatccatcgctgtaggcctcaagaccaagagaaattaaattaggttacaaggctgaaattagatagctcttgtttgcctctaatcatcaatcaataactcccctaaccccaccgtttttctcattttcttgattttttttggctatctggatggtttacccatcgctcctcctcattccggctcctcgtgcacgcctgcatgaccgctcgtaagcggtcactggtccaacgatttttttgggcgctatgggggcgtgcgcacgcgccggtctcgacggcgggttggaacctgtttgattaaaaggatattttgcaaaaaaattccttgtgtttccacgaaatatcgtatacgtccttggacaggttcacacccgttgtgtttgttgcgaaaaaaccctcctatttcacaaatatacaatgtgaagaagagaaaattccgttttaggggtaacgctgtaaatattaaaaactaaggtgttttttcgaaaaaaccaccacatataccctaaaccctaaccagggctgttccccactccctcaccacgcggccgccgccccacccacgccccgtgctcggcgccggcgccggcgcgggactcccctcgcctccgtccgctctccccgagtcacctccgtcgtcgtacgccctccacccgccgccgccgacgtcgtccgtcctccccccgctctccgttgcctctccttgcaggccgtgcgacggcgcggctcgtggcctcgtctccggtgccaccgtagctagatctggccctcccacggctggatctagctccgccgccgctggatctagcggccggaggagacggcgcgacggaggaggatggccgcgatagcttcggacgacgaagcggcggaggccgacaggtgcggcaccatcgtccgccttccccgcgaggggttccgctgccgccaccgtcacccgtcgcctccgcatgcccacacacaccacgatctgccgccggtgcctcctccctccttacccctccccttgtggtgacgtcaacgggacggaaggcggacgcgtccatcaaggcttgaggtggcggcggagctgaccacgcgaccgccgcccgtcggagccggtactccctagccccttcttcatgcgccaccgccgcctcctcgttcttccctagccgtcgtcaccgcccgtactcttcatctccccaatgccgccgcttcctctcttttgccctgtcgtatagcaggccaaacgggcggcccggcccagcacggcatggcacactgacggcacggcccactagggcacggcccgttaggcacggctcctatagcgggccgtgccgtgctggcccacgtgccaaggcctcggcccaagcacggcccaaggaggtgctgggtcgtgccgggccggcacggctactgtagtggaccgtgggctggtagccggcccactagtacatgtggcccataaaaattgaaatttgaggggaaaaaagaaaaaaaagacagaaaaaacattataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggtcggtgggccgtgccattccggcacgctaaagtaaacgtgccgtgccgtgctggcctacgggctgaggcgtcggcccaaacacggcacgggataacgggccgtgctggcacggcccacaggctggcgtgccgtgccgggccttggccggctacagtactgccgtgctcgggccggcccggcttggcacggcccatttggccaggtataccctctcgcctcgctcggtggggtgtcggatttgacgagcaaggtcagcggcgaggagcagggccagcggatgtggcaaggtggcgaaggcctcagcagccggcggtgggcgctcaaagcggacgaaagcgaggccgccggcggccccatcaaccgccctacccacca

SEQ ID NO: 80425 - DNA, 7067 bp, Oryza sativa
aacgaaacaatagagcgtttaacagcgaatgcaaggtatcctgaaaacaacatatcaagtagcattttatcctgaaaacattgtatcaagtggcattttatctggtttattctagtgggtgacatcttgttgaaaccttgagtatgaagtggcatattatccgttttatccccgggcagagaaaacagacatccgggtaccgtgtatgaaatcattcagatttttttttttttggcaagcagcagcttgttaatgccaaccagtcaaccgattacacagaaaacgtacggcttgatatacaggaggttgcagatattctatcttgttgatcaaccgataggactcatacggaaacagcattgtaatcctgcgatgctttctgcatactcctacttgaatactatgtagtcctatcactactgttcactacataatgctgctatagtatttttcactagttcatacgcgatcaaatgattagtcctcgggatcgaagtccctaaccttcacatctgcgtctaccccatactggatgcagttgtcgatgtgcgacagcacatactgaatgctggaaaaagaaatcagggccagttagagagatgaaaagaggagcacacggtacaaacaggtatctgtacatttacaaacttgatgttaagtttttatttcactaaaatattttgcttgagacttgcgctataagttcgaccgttgacttataaaacaaaatgttcactgatggaatgcctaatccccacccagagtagggagtcgaaatagcagttcttgaagccaggatatatacagcacagacactaccatattatttttatggagtaggatggacatgtgtcttcaagagatgcgatacatgaaaagttggcatgcatgctagtagcatgtgtaggacttatagggtaaaggctcacgatcagtcaagtccaaaagagttttgcaacaaaatatgataaaatttaggcatccataggcctgaaattcagaatgtgaagtactgagattctaaaggaaaacggcattacctgctctcttttcttaaatcaagtgggatgaaattcaccatgctgtaatcatcaacctacatgatagtattaagattaataatgattactgatagcactgcattagagcaaaatatctttgaacaaaagaatacattctaaataaggtaatgggaagatagaatatggggttactataacttcgtaacaatcagctcagacagtcaggcatatattatctaatagtagttgattcagaatttcagatatgtacaaaagataaacagcatgagtatacccttttattcaaaatgctcacacaacaaatcgatggttctaagcctcctgttaggagccacacacgcacaaaaaaaaaaaaggaacactacagatggtggtggagataatctcatgaaagtgtcggaaaactcaatagatcagaaactaaaatggtaatagcattaaggtaaaggggcaattgcatctgtgcccccacttttgatgccaattgctgttttacccccattttttagggtttgcagttttacccccattttttgaatctgaaacagccgtctaccctcacttctaacagccggttttaatggtgttagttatagagaaaatgacatttatacccttggtgcaattgtccctagataaaaagtgattatatgaatcagtactccaattcacctcctttttcttttcaaaagtcactagatagatattgacttaatttcaaggttttcatgatctcactactcaatgtttatatgaatcagtacattcctcctgaaggttatacactgatacatagcaaaacattagatcgatttgatatcgaacaaacctcaacgagcattcaaatcaaatgagccctaattatgattcaccttctctccagaagataattaacaaggttttcatggataggtaggagataacgcagaaattagacagagcatcttgtcgatcttcttttttccggggtcgccgatgaacctgccgccggaacggagggaggggacgagtgcggaggcctcgtcgctggtgcatagctcgaactcggcgaggccgtagcggctcagcgtcttcctcacctgcccacgggcgctgccgccgcctcgcgcgcggccgctagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttctcggaacacgaaaaccaattcaacttctaatagaaacaaatatcaacatatataattagctcattttatataaaatatagtataatttataaatatttttaaaattttaaataatattaataatgtggactagtgttaagagatgaactactattaaaatctaaaaaagtatattgaaggtcatagagttataaagaaatggggtatgtcttgtggcttctgcggatatccgaatagcactgttcaccggatatccgaattattatccgtatccgacggaaaccctgataccatattcgtattcgtatccgagagaaaatatccgtattcgtatccgtatccgaactatccgagaattatccgatccgaaaggtatccgtattcgtttttatccagagcggacggaaactatccgctccgttttcatccctcgccttgcgctcgcccgcagccgccgcctccgcgcgcgccctcgtcgtcgcaggcgtcaccccacgcgcacgcccagcgctagggttttgcccgaaaccgatgcagggggtgggaggacagactcaccatcctatccattccctcaggggtacataggtaatttcatatttcctaaaacctttttttaattttcttttgtatttctttaactcaaaacgcgggacccaccaaatggctgtcacaactgagggtagacagctggttcagattcaaaaagtggaggtaaaactgcaaaccctaaaaagtgggggtaaaacagcaattggcatttaaagtgggggtatagatgcaattatccctaaggtaaaaggggaatatgggtaaaacgaatgcaccaaaaattgttaagatactgtcatgtttgattcaccacagctaaacttggtggtatctcccttccaaatcatcaatatggctaaagaaaagaagagctgctcatggtacctcgtatcacaaaacaagtgtgtgatagaacttgaaacaccaacaaatgtttaatcaatatttaagtttattttgttgttgaaaaaaacaagtatttcatgaaaatggtatgtttcttgatacttagaataggctacagtacattatagcaaaccttaataatgtaggtaatttgcttcaaaggaataacgatttttttaaaaaaataatgctatatgtccggcatttatgaatttgtgagtctgtgacatccttgaggcactcatgaccagtgttattagattcagactggactggcggtttgaatcggaaaaaaaaggaacccagtgctttccccagtctggtcaaggctatttgatcatttctgcagccaagccactctggacagcaaaaacctatcaaatcagctgtttttttttgtggcctggtgagagaaccaagcccagtgagaaccaactaatcagaataaataggaaaaatagcatgatcgttaggctttgagcacaaggcctccctaccctactgaaataaacgcacgtagtggccaccaggccatgctcttggctgggaacagcagtgaaagcatagacatttgaaatacatgtgctgcctgaatgtataaagaaaaacctgcagttcaacttcaaccagtgaccaatgacctgagacctgaccgggtcagtcacaggttctgacaacaggctggcaaccacatattttgacaaatataggcttttataaaggagtaacaatatacagaagaatttacaggttcatgtcatgcgtaccagttcagctaacgatttgtttaacttgccaaacttgggtgccatctgtcggttcagctgtgacaagagaacctgcgcctctggattcagatacctagaaaacatcaagagattaatacaaagcaggatggttgaatctttaaataaaggagaaatgaaataaacatactcttccacatcctttttgttggcgaccaggtccatctttgaaagaatgttgatatgaggaagttcaagctgaatcatggcagaaagagaagccatgcaaccactgatgtattttgtcacatcactaacaaacttaaccaagaaaaacaaaactcaagtcagacttgtctacttgtgtttggggccagtatcttttttcaaggataaatatatttggttagtgatccaagagtccaaacctgtgaatcaagaaagtacacggcacaaacgttgaaattttttcgtttcaaatgttcaacaaagttacgcagaactgggacatgagtgaagagttcaatctggcctggagaaacaagatgtggtctctcattgtcatgattttaggtgaagttaaacaatctaaaatatttcagaattcccatgcaactacaggggaaggacataatatctgtattgctagagaataacatgagcaataggtccttgtacaagcttatcgcacaagtataattcgttagatagagatattgattaatcgttggttttttcaaggccatgtatggtaagaatagtagtcaagctctacgtaacctccaactacatttaaagcacacaatcatgaaataaagaaagttacctgggcaatcaaacacaagatagtcatcatccaaataaccatccagttgctcatccaaccaatcatccaaattgtcttcaaggtgcctatggttttcttaaggaacaactgacagcataaaatcctattaaataaaaaatatacccataacatcctctttagattgacatgatattaataccaagggttttttattggatcctagtacacatataactctacagaacgttcaaacaaatgaagagtcagcataaattgtacactgctagcctgcaagtaatgtgaatgggtgaactaaacaagactaatcaagtttgcagtgttttaactaacatagtatggagaattaaaaggtggtgtctgtgcaaatgtctcccgacagatggagtagcaaattgaacatatgatagcaatgacatagtttctaaagtatcatatgcatatagcaaaactacttactcttgggacatctatataaaactactgctaatgaatggcgaaatagagaaagaagttagtaaattatagagttaataagcatgagcagtccatctcaccaacattcatcagcatacagatacagatctgatgattgcatggccatagagatatataatccagttctgattccgagtttaatatatttcaggtgagctgtctcatcctaccgttgattgctcaaaacaaaaaatgcatggccatagttgagaggaaagtatggcactccagttataatggccaagcaaataatgcttttgagaccaatatgtactaaatctcaagagcggagagagccccaaaagctagttgcagagcaattgcggaaaaattgtgctaaaagaaaagtttctacccacaatggcctgatgttgcccctgcaacccaattagctttcgaaacacaacaacagcacattgcaaataatttaccacaaggatcagttaagaacttaaatagcttggaaagaaaagggcaataaaattaaaagactcaaaacaggatactccatgcaatagataagcccgccatttggtcccatcccaagttcctccatgacatcatccaatgatatgagctccctaatatctacaaaattttaaaaagaagccaagtataagcgagccgggtggcatttacatgtgagcagaagaagcacaagattcttacccgtagatacaggatagctgaagtgctctgcagcaggatcgagattgaccatatgaattgtcctacccacagtctcacaatgttgatacaaactggagcaatatgtcgactgcacagcatatacaacagattagggggaaaaaacaattaccagcatctcattttagtcactaggaaaacttgcaatacatgcttgtaaattctctgataatgttatcatgtgccaaacttaatactcccaaattttaccggaggtggtaggcatcccaacaactagtattacactaaccaaaccctagtgaaataagaataaactcaaatacaatcgacaggaatcattccccactaaaacagcacggagacaatcccaagactcgccccgaatatcctaaccatcgccgaggaaatcccaccatcatatcaaaccccctccaaaaccgaaaaacctaaaagcatgaaacgaagcggatgggatgggggagtcggatagacccattcaccttgccgctcccggcggggccgatgacgagctgcgcgtaccccatggcgggcgagaaggactagggttttagagaggggagaggcgggggaggaggtagttgctctggaggaggaggaggaggaagcgcgcggcgcgggttagaaggcggaggagatggcggcggcgagcacagcgtcatctgggttttggtgcttgcggcggccttgtgatggaggcacatgcaatggagcgaacagaagttgctcgatactggcgtgcaggcttgagcgccgttgggtctgaacatctgcagcgctcgaccgttggatggcgagcgctgggtatgatggacaccagcagcccgttttccgggaaatttaaatatttgccacttttagattcgataattatccaaatatccttattaggtttgcacttaattttttccttttaagagatagtctcttaactatttgccacttttttcccctcttaagaggaagtctcttaactatttgccacttttgccaacgtggcatactcgggtgaaaaa

SEQ ID NO: 80426 - DNA, 6449 bp, Oryza sativa
ttcctcttccccattgacgtcggcatcattgtttctccactgcgcctgcacccgtcaacattggcggctcggcgccgttccgcctcatctgccgttctacctcggccgccgccctctcccttcgtcgttgtcgcctcttcgcttcttccaccgccacgaggagtccttccggcggctccgccttctcccgtcgaagctctgcctcccccgccgccactgctccacttcctccaccagcgccattggctctgcctcctctatcgccaccttgcctcctcctccgccaccgccgtcgccgctccacctcctccatcgtcgctgctctgcctcattcgttgccactctacctccgctgccactctgcgtcctccacccaccatgaggagtctgttcggcggttccgcctcctccgtcactgctcactggcgttgacaggtagaggcacgatggagaagagaggcgatgccagcgtttatggggaagagaaagaacggggagagactgacgagtgagtcccacaccatttttcacccgagtttaccacgttggcatgccacataggcaaaagtggcaaatagttaaaagaccacctcttaagagggacacaaaattaagtgcaaaactaagaagggcatttggataattgccaaacttaaaagtggcaaatagttaaattcccccgtttacccctagcccactagaccacctccctcgccctatcacgcttctagcatagcttaactcagctatagggttcacagttgaattcgattcggattttatgaagtcgggactttttgaaggacacaaattgctcggcttttcagtcatgtccaaaaacaatttcaaactgattttttttttgcaagaaagatgatgttttactgatgagaaacaaagttattacaatagttgagaacaagaccttgaatacaagctatcctattgcaacctcttccaagttctaacatgacgaaactttacctcgctagcaactcatttgtgataatgtgcaatattgtgattttttttgacaaaaaattatccggatttcatccgttttcatcgtcattttattaacggatttccaatgataacgctcgtgaagtcgtttcaaattgcagcatagatcaaaaccgatgaagtcgtttgccctaagcaaattgcagcataggtcggcgtcgtcgtcctccatgggagtcgggaccccgagcgccgtccggcgctccctgcacgcaatagctaggcccgtctcgaactgaagcgccatcagtgagtcgcctggccaacataattttgccatcatgttgttgcatgtaccccgatatcacactagccttcccaaacgcgatcacataaaattggatccactaactactaataggcacatagcagccctgtaaacgccaccacatttcaccgattcctctcactactagccttgccttcgccttactttctcccttcctctctgtcgccatagaattggccgtgtaatggctgccacctccagccttccacggacagcttccgccgccaccaacggtgaaaacagttcaccacatccaggagcacatttcgacacctcaacatagccaacgtgttcctggatacactttccccaaggctccagaaagattcaggttaagaacatgacgaccaatcaaacaccccatgccaagcaacgtctgtccggaattttacggccactaatgcaatcacttagcattggtacactaccggatggtaaagacgttaatttctgatcaggcatgaagaaattgaagcaaacaaattataaggttaagatcaccatcaacctttgaaaaaacaactttgcataagcatctactacatccagcagcatgaaacataatgttcaaggtatcagactttggaagatacttaaatactaggccaaacggttcgtatttcaaaattcagctaacacctccactggtttcactaagacgaccacacttcaagccaggtgttcacttctttgccttcttaggtgccctgcatcattaggaagttgtggaccataaaacttctgaaaataagcaaacacgggttgaaatggaaggtgtcatgatacttacgctgcagtttgagcaggagctgccgctgcaggagctgctggctctcttgggccctgtttgcattcagagaagtattaaatcacatgatcagcaaataatcaaatattaatagccaggaaaatatactttgacaatgaaaaaattacttaagatttgacagaaaacatattgtaaaattgaaatgtgtcagtatgatgtgaggaaaacatcaattaacatatttcaatattgaatcatgagtgttactaactgaagaaaattaaactatagaaccataggcaaaaaaaatctcacctgagccaacctctcctccctcctggcaatcttcctctcacggcttgccttgctcttggcacgcttagcctcaaactggtcagagagtgtcttctctcttgccttctcagccttagacttgtggatactttccataagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctcccttgtacccctacgcttacctgcaaaataggaagaataaggaatatgcagacacacatgtttgcactaagataacagcaaacttaaatggacccaacgcaccatagccagagtgacgtcccttctgcttagcctcatgggctctccgtgctcgggacctggagtgaatcttctggggcttcttgatgatgaatccatccttgaccaacttacggatgttctgacctgcaagtaggaaggaacagaacatcagatagctttcccagcatttcaggaacgtgttatagaaatcaaagttcatcaccatgcaagcacatatacaagtcacagggaaataaaaccaagtatctagaacagcttttcaagacgatagtaaataattactagaccatcggaaatgagtatttatactccaaacagaacagaacatagactttgtttatgaaagtatgcacgatacccaacatagcatagcaaacaatatatcttataattagcacaacaaaacttgcaagtaaacaaaccacaatgcatacatttacacagtatcatactgcagttctacaaatggtgatgaacaatcgaaatgaaccgaatgaacttagatgttatagaattgtaatttcaacagacaaaggaatgttcccctattgataaccgtgtgggcattccctattaataatcctgtgtgcatgaattgcagtcttcatcctacctggcatatgtgacgaacaagaataagtaatacatcaagcatcacatatcatgtctatatcatgtctatttttcatctaatggaggataataagcacacacatccccagaacagcaccgtggatttgacagaacccctaagatcaatctaaaccctaaccctaagttccatgtataaatcatttctcgaaacttttctacctctatgcatccatcacaaaaacgaacctagaaaaactgcaacaggcaacggtttaagtcccatgaagcaacttcctccgcaactaaattaaacaacacactacctagaacacatcaaaactactccgactaagcgaaccaaacgaaactccacatcggaatcgccacggcaacagtttcgcgccgcagactagcactatagctccagatctaaaggaaatcacgcgcaacacaaactaccaatcgcacacaaagatgatatcaaacgggagttgaggggagttcttacgggagttggccatggagatctcgttgacctcattggggtcgagccagaccttgcccttgccgcacttgagcacgctggcggcgagccgcttctgcagcttgagggaaaccatctccgccgccgccgccgccgccttcgaggttcccttcctcctccctctccttacctgggtgggagtgtgtggtggaggcgcgagggggtgcaagggttggcgaggggcggcgcggagggcttatatagcccccctcctgtgatggggctagggtttcagcgcgagctggctgggctgggccgtcggcccatcagtggttggtgtaggttccaccgcccagaaggctcgagtgagtggagcgtgtcgctgtcggggatgggatgacgtggaggacttggatttgtcgccggctttttttttttgacgaggtttatttaggttttaacgaaaaagctttttgcggaatcatggagaagagaatagtctagcatactcctgagtgaattttctgaaactctggacgccggacatttgaagctttcataaatgagtaaactatattgatgatttgatggctccaatttctgtgagatacttaaaagttttttctgaaaaaaaaaatgaaaagagatacttaaaatgtactctctcttttgcattacagtatcaggatcagtgtgggttcagaagcgaagattagaaacttctctaacgtgcacattaaaacgaatggctcattaacagatcagtaattaagtattagttataaaaacttaaaaattgattaatatgtttttaaaactgtgacactgcgaagtgggccttcaaaattctaaatttagcacgggtattcacatttacggctaattttttttcagtgatagacaatacaatcatcgacaacgagacgtccgtggtaacttcattaatcttaagatatgcctagcctttcggatgtgctcatagatatatctagtcttctgaatgtgctcttagaaggttagcgtgtgcctttggttagcgtgcgcgtgttgtgagtgtctgcgttgtccttaaaaaaatttataatatttaacagtttgaaaagtgtgcacgtgaaaaataagaaagtagaagttgataacatgttttattttgttttgtattaaaaaggttgctatatttctcgtaatcttaaataagtttaacttttgaaagttataacgtcttaacatgaatcggagggagcatttagaagtgagcgtagattagtcaaggtgatatcgatgtagtagtagaccagtatgtcattttctgcccatgcctgtaactcatctaaactctaaattgtttgcaggattagtaactaatcggcagcataagttttggtacctcaggtgcattttactacacattgaaccacacctgcattttatactagcttatattcagaaaagtgaaacgacagacatagaaacatataatccttggttgtgtacatccactatggttgtagaggcaggtttaatctattttcttaaaaaataaacataatccaaatatatttcattcatttgttctcaagtcaaatgtgataatatttccacgggcatggttgctacattaacttattacatgcagattcgccattgggaaaaggatggcatgccctagaaataaaaagcatctacttcaatgaatcaaaatatactgtttactatttcagtaacaggaatggaatcttgttttctccggcaccatttgcagtgcaaaaacaaactcttcaatacgataaggaactgaagatgtaaatgtctggcttgctttatttacgggtgagctagagctaggaaatccacaggacaggaatacattagtcgctatcaatcagaaggaccaatcattttctctggaacaacaagctcatggaattctgattctgtcaatactccgaggtctagagcagcttcctggaaagatgaaaaagagataaaagatgaaaaagagatatgatccacaacagtaaatcacaaaaagattaaaagcgcacaacatcaacatattgcaatttatgttgatacactaatatgaatggcgaccaaaaagatcagcgcaaggggggaaatgatggttgtcctaaatctctatatgtagcaccttatcccaatagcatggatttatgccttagaatattgatggttctgacaatcaagccaaaatatgaaattatgtttgcacatatcaccttaaggctaacgcagaccattgcacatcagtttcgaatcaaaacaactaaaataaatggaataatcaccttcaatgtgcttccttctttgtgtgctttcttagcaacagctgcagcattgtcatagccaattttctgcatttattaaatagaattaagtatgcactcacgaaagcagatgtaatagaaaagataaatgtaaggctacaaaatggatgaatttcacttacagggttcaaagatgtcaccaacatcaaagactggaaaaaaaaggatacacaaattaatcaagcaaatttgttgaaaaattgtatatgcatttttttcctacagttcagt

SEQ ID NO: 80427 - DNA, 5039 bp, Oryza sativa
cccctcagccaccgcccgcctctatcatggacgtcaagagtggcctccgccaccacctgccgccatcccgccgccccaagctccgtccgcccccgccgccgttcgttccacgcgcgccgccgcctctccgccatggccaccgccatacgcaccgacgcttccgcctcgtatgcgtcaccctcatcccccgccgtcgccgccttcgtgtcacccgccaccgccgccgctgctctgtcccccgcccgccgcccgtgagagagagaagagatagaggaggagagagaggaagagtgaagaggagtatgacaagtgggtcccacaaattttttataaatagaatgttgactggactgccatgaatacgccacgtaaacctaaaccaccgcagattgggtcgaggggggtaattcgtccagtttgtatagttgggggtgaagaatactaatgtgttcggggggagggggttagtcgtactttttcatttccggctttcatatagggagttgctataagacatttgacagttttgtaaaaacttccaaacgtaactagctgaagtataattagatcataataacttatatgtaattgcctaattcgtacccccatgcactcttgttcccaaggttgcggcttagaaccccatcggtgcatgtcacaatagatgactcccttgcacgaatctcaatgtcatgcaacgatccacaaaattgaaagttttaaaagaaaaaccgttaatagttttttttagctaatccatttcatacatgacgaacctatactaatataaaaaacatcagttcatcgaactcaaatgtttttttatccttatatttgttcatccaacggtccatagagttggatttacccctcaattagcgatccccatctcaagtacgcagcagttagcgcaaaaataaaagaaaacaattagtctcccacgtctaaacagcagttaggatcggtcaaagcaaaaaaaaaaaaaaaaaaggaacgctcccttttgtgcgccagcccgccgccgcctcctcccgccggagccgctcagctcctcctagcgcgcgccagcccgctgccgccgcctcccgccggagctgctcgcctccttcacgtgctcgcccgccggagccgcctcaccctacccaccgctgcctgcttccctgctcgcgccgcgccgtgatggagaggaaagagaggcggggtctgctcgccctaccccgccgcctcctcgcgtgcgcaggccggacatccaggcgtcgccgccggaaaggggatatgaggtggcggagattcttgctaggaggaggagagggggccattggaggagggctagaggtcgctgcgcatggcccgtgggcggtggagagatgaagccaggaggacgtcagcgtcggcgaggttgactgggcaagaggcgagcgtcaacagacgttccagggaggagcagtccgctggcgcggtcgcatgagagggtgccgaccggaggcagagccgaggacccctaggaccgcacccgcgccaccactgctgccatcgtcaacatcctatatgatttttcgttgttgttgttatcagggatgcgctggaacaagggcacaggaccagggccgctggacatcatcgatgctagcagataaggacaccaacaacagttgaggttgatgttccatattcatgcttgcaatgtgtttgatgaaatgtttaactagcactagcatcatctcttgtttacaatttgactatttgtattgatgtcatactaaccaaatttcaggttgattgtttactgctttcaaattaacaattcaatggttcttgatgtgttctacttaacctttgcatttgtagtagtgtaattctgaaggtacaaaacactatttctactgaacttcgtcaatttaagcaaaacttttgaacatatggtcatccattgaggctcccgcaattccagtttgcatgttctgccaccattttggatcatattttccatgcttatggaaggacttaatgaactgaagtagtttgtgttggcagtgatctccattggatatcccgtctcttcagccggtcgtcaatgatacaaccaggtcacgcatgaggtagcagtccactccaacccacctactgaagacttgtctcatttggtttgattgatgcgtggagtgaggcacatgctgtccagatcaaggtacaggcaagtcggtttcttgcacttaattttttttcatgctatttgtgaatgttggggatttctattcatggagaaacaatgtttttattttccttttatcagtgtcatagcgttcttcaaatccagggtagtattatacggattttatctattttgcatacattgtgcctgtaaatttttgcatgaaaatgtatccaagagcacaagtaatttcgagtgtagtaaattagtacaggtttctcttgagaaataaaatcttttctctcaagaagtccaatattagaatgtctacttagataaatgtgtgttttcttagaaaaaagttaatttgtaatatagtagtaaaatcaattaggattgtcaagtcaaggcataatagtaagatttagttcgcacagctagccctcttaatttctattagtgccacctacttcttaatttcttacgctgatgtctgacaaaattctgtttggttcctttctgcagtagaacatcagcttatgagatctgaaagcaacaaaagggtaccaattttacacccatgtaaaatccagtgatttcagtccattctttgtggctattttcatactgcatcttggcatttgctatccgtttaatatgcttggcaaatgaacttgaattagtacaagtggatctttagatttgtatgtagaaggtcgagatgtttgcaaatgacatatgagttgagttgagtgatctagaatttagttcctatagtggaatatggatagctccagaaattgatttttttagtccatttattttaagctctactatttgttaagtttattctcaaaatatttaatttatagtattatccacaataattggagggcaaaactgaccaaattaaagttgccatatgttcatctggagtctgaaagctggccttggtctgcttcattttggtgttgttgtgactccaaccggtgaccggagcccgtactcaccgctagctaccatccccaacctgccccaatctttctccaggttatgttgctagcacttgatctgtacacgctgtgggataattgcttgttgacaaggaagatcaaatcctgatggtggaagaatggcaccccctgtgctccagctaacaatctgattagtttcctagatgcttgattattgattttatgtgtgatcattttattttgtttttgtatcagggctgcatagagtataaaagctttgcccccctatgcttgcactgagagactcttccgtagctgtcatcgcatatagtgttgcaagtatgttctctattatctcaatgtgattgcacgggtagcatatgtattctcactaactgctcttacactaacaatgatgaatcagactagcagagagagtttccaagcaaatttgatggcacatgtccacgaattgtgatttttaatagtttgcattataaatgctcatctttgtcctgcctcctttttcccttaaatttatttacatggtgtggcaggcagtatcctaaacacttaaaagtaggactcactaaattgaagaaaaaacaaatagctctaccttgcttatgatggtccttcatattggagcacatcttccatgggtctgtagcagctcatcctgctcaaggttgactataagttttggtcagtgaaggggatgtaattagtaatggaattagaacacaggtaacactcgagttaattagtgctttgcttgcagtttcaatgcttacaccacaatttcattctctgcaattacattcacattttaagcttggttttcttctctactcccaatcaccaaactcgttttttttaatgaaaacacaacttggtatttgcaagttttctatctgttttttgcaataggaaaactgttacatgttctagacaaaaatatcataacaagcttatggatgaactttgacaggttccttgacgaaatttgaagatgtaacccgccacccatgtttcgcagccatcgcccatggacttgccaagtttctggtggtgcccattgtggatgaaattactgattgcctgaagtactcaaagtttcatgagtataacaaagattacagcttgggtatctgtaaagtggttatgttgagataaaaggacaataatttgagatttctgtttacatctcaaatgttccatttaatttttttacgctactttataacttcgcctttcagtttaaatctcataatatgcattgtttcttttatccaggattgaatcttctagcctctacaaaactgaattcatatttctttcctcttcattgttagtgtaaacaatactcttcaatatatgttgacgtgcctggcatgtgcacgttaactagtatccaaactatgagagcaagggtggcattggcaaactgccaaccaggcaaccatgtattcagcttcctgcgaacctggaaataaatgtgtcgtgcaaataaatgtatccattccaaattgtaaggatttatattttttaggttctttagcaaatattatggttaggtcaaacgatttttttgaatccattttagttgtggattttaaaattttgaattgcttggattcctcaatgaagaattgtgtttggaatccttaaagtgatgggaattatgagaatgggagtatttcttttcttttccttttttttaaacaaacgtacatccaaggtaatgaaacgattcctcagtcttaacgttcataacacccgctggcaaaaaaaaaagagagtaaatttcacaaaactacatgttttatggttcaaattgcagaaaacattttatgttttatgtttttttacacattttgacacttggcactcaagtacatatgttttggtag

SEQ ID NO: 80428 - DNA, 9335 bp, Oryza sativa
caccgagaccgtccggccttctcggcaccgtgggctggggctgggaggcggggctcgatcggtcggatcagaagccgcagaagtccttgtcgctgggctggcccggcttgccgatctgcgtgcagccctgggtgcaggcgtcggcgcagtcgaacttgttgggcgccgcgcccagcgtcatgcactggttcttcatgcagtcgcagaagcagtccagctcgccggcgtcgccggtcgtctcctccccctccgcgccagcgcccaccgccgctgccgccaccaccgccgcgaccagcagcagcgccgccgccgcggctctcctcgacgccattgcgatcccggttgattctcccgtcgtgatcggatcggatcgatccggcaggtttaattggggaaggcttgtgttgggccatggcggaggggggctattatgtgttggcatttcagctgggcctacctattcttgggcatttggaaccattggtcaggagtgaagcttccaagggaggcaaatcaccgtaggccggcgttagcaaagccgcgacaaaatcatgggcacgcacacacttggttgcaccgcgattcacgcacgtacgcgtgcgtggaaatcgtgcgtgcaaccctttcaacacgcgcgtgcgtacgtacgctcttgcacgatcgggacaaaccgctggtaggtactatagcatatctgcatatgcattgcttgcagaggtagagccgggaaaaaaacgcgtcccgtcgtgtccgggttaagcttggcctgatggcctccatccatctgcagatcgatcgatctgtcccggcaggcaggccgtcgtgacagtgtaggctcgctcgcgcgctctcccggcaagtcgatctcggcctatacaaatgtagtacaaattatcgggataaatggaccggaaaatcgaaccgaaacgtactctcggctcgtcgccaacgatcgagcagccgcgacgcgcccacttccaccgcgcagccgcacgcgagcaaaatcttctctccggcgctagctgtcgcgacgcggcggccggcgaatccgcctcgttgtctggctagcgcgcgccgatcgagacaaggcggccgctttgattcgggggattgggtgattggaccctgtcgtctgcaatctgcatgcgtgttggtgggcacggccggtggcatacgtactccctcggtcaaaaaaaaaaaaaaagacaaactctgtttccgtgtccaatatttgaccgtccgtttcatttaaaaaatttataaaaaaaattaaaaagacaagtcgcgcataaaatattaatcatattttatcatctaacaacaatgaaaatacgaattataaaaaaatttcatataaaacggacagtcaaagttggatacggaaacccatagtttaccattttttgagacggatggagggagtacggggcaccgtggcaaacatggcgccttcacggaaagctaagcatgcacggttttttttcttttctttttcacgctggagattatcatgtccctagctagtaccccttcccatcatggatggaccgatggagtacgcgtacttgtggggtacgaatctggatgacatcccgattggtctctccatcatctgggaggacggaaggcgcacgtacgtacacagtcagtacacatcgatctctatatcgattgagagattttttttctgtttgttttggagaagtgaaatgatcgagagatcatcgatcgtgcgcgctgacgacttctctcttacgagcaggaggacggacggacgcagggtgcacccaacgatcccgtcgcgtcatccttgccggccggtcgcgaccaatgggcaaattatacccatcgattgatggagcacgtacctaattacgtacgtgtatctaagcgctgtgctgtgcttgtgcctgactgcctggccgtgtatgaccagtgacatgcgtgttatgtcgacatccgcatcatatccgtgatgttgggtgctggtgtgatgttatgttgtggacttgtgttatcagtgcttaccccatgcaccctccattcctccaaacatactatggaataatggattattgtttcatgaggcagttgtaataagccgatgtattgccatttctaacaggcgattgtcttagacgcctgcatctaaacatttcccagaggtgatttgtgaccatgatcacattgatttattgcacaggcgaatcatttttctgacagccagttacactgatatagggagtgtttgaaaatcgtttttttttaagtagcatgctttgtcgaatttacaatgcaatttttcaaaagaaatatatgttttggtctaagtcaatatagtttgatggaaaatccctaaggcgggccttaaaacctcctgggccgagtttattagggccagcctaataaatgtattggccatataaaaaaaataagtgaggccatatacgacttttttttcttttttcttttctaaactcttatagctaattttgatgtccattggatccagttctatcaatctaaaccaatggctctattccttataaattggacccccccccctttcgaaccctagtcccttctccattcctcccctcttagacaccgccgctgtcaccataccaaaccctccgcctctagcaaggtcgttcactatcccttcgctctagccacctctccggcaagccatcttatgcttcccttcatcttgttgggtgagggtcccttgtcccatcatcttggttggcgttatcaaattctccatcgttgattcttgttgtcctcgctaattctatcacctataatttttcttttttgtagatctatcaatgcttgctttgccaatcgatgacgatcaccacccatagtccggtaaggtacctcatgccatcctcctcatctttgataacactggtaggttcaacaccgctggttcttgttgtcctcactaattctatcagctaccgcttgcttttgtttttgtttatagatccagtcatgcccatctcgctattgcacgaccacaacggaccatagtctagtaaggcctctcataccaccctcttcctcatcttcaatagcagtattagattcagctccaccaattcttgttttccttgataattctatcacccatcgcttgctcctttttctacagatctagcagtaacccacttcaccgtccacgaccaccaccgcgtagtgctccagtctggtaaggctccttgttccatcttcttcctcatcttgaaaatattttgggatccaacaccgccgacttttcgttttgttgttatcctcgttaattctatcctcaattgctcgctttctgatatttttaatagatccaatagccccaactcaccgttccacgcctattggcacccgtaacttggtaacgcctctggttacatcgtatatcttattttagcaacatcgttagatccaacaccacttgttctcgttgtcctcgctaatcatgtcatctatagcttgcctttttttttctatccaatagttcctaccttaccgctcgacagctcgacagacatcgtcgctcatagctagattgctattctgtgatgccccacacttttaccgctatagataaaagtgcaagattgtgaactattaataaagtattgttttatccaataataacccaccatgagatatcgcaatggagaaacaggtagaactacttttaatccatccctacaagtctgaaggccatctctattccatcttatccttgcaaagacatatacaagaggaattatataacaacggtgagcgcatccgtactcagcaagtcattagtaacaaaatataaatgcataaacaataatttatttatcaatttatattctataccatacctttcgtaccatcatcaccttcacttttcatcaaaagtctatatctatcttgtacaagggttttcaaaaagaagatttttgaaaaaactaaaatacactcgtaacattgagtaaagtttacatcaacttcccgtagcctccaatctaggacgtgagtcacaatttaatagagcattgcgcatgcttgtatcattgtactcatatacactctagatattactgtacatattccctcaatcttcctatgaatcaaggggtcattgatgaaatctacgtgaccatgaatcgtgatatctgatttaaggcttattttggggagtttaagattttgagaagcaactggttggtagccagcttttgagaatctggaaaagctgggttttccagcttttggtttttagttctttttttggattctacaactacagtttgatataatcttaaccaaaagctaaactgtttgggggagttttgattctgggagaagctgtagcagcttcttagtggccaccgcttcctcccaatcgcagctaaagagaaaagggggacaatgttgcccgaggacgaacatgttttttaattgactagtaataaaatatctatttttttaactagtctctattcgcacatgtgagaaattcacctcttattcctactcaaggatttcactaaacagtttttgcaacgcttgcagtataaaactttcctccatcgcaagctttttgccaaggtgatcaccagctgagcctgtaagcgcacgcccacacaaacactctggtctgtgtctctgccgcgcaccagagcgtggtgggtgtgtctcttgtctcccgcgcccccagcccacgcacgccacgcgatgccagcctcctcctcctcctcccgctggtcatggttgcacaagctgaagctgcggaggaggaggaagaagaagagcaagcgggcgagccccgcgtcaacggcccgaccctccgacgcgtccgccgtccccccggcggcgccacgccagccaccggcggcggcggcgccggccggcggcctgagcccgtgctgctgctactgccccaacagggagtcgtactacctcaacagcgccgaccgcgcgcgccaggaggacaggcaggacatgttgctcccgtgcgacgacgaggtggaggaggaggaggctctcgacgtcggcgtcgacgtggtccaccgccgggccgacggcctcgacgcgccgccagcgacgccggagctcaagctgaggcccatcgtcacgagccggcggcacgccgccgccggcaagaacgaggcgtcggacagctcaagcacctcggcggccacgacgccgtctaccagggcgcgggggttccacgtgagaccgaccgccgccagcaggaggctgcgccgcgtcggcagcagcggcggcggccacgacagcaacaatgccggcacaccggtgtcggcgccggcgccggcgtcgtcgtcgtcgtcggtgagcgcggggaggccgagccggcggccgcggcggcggcggatgtggctgcgggagagcgaggcggtggtgttggagtcgacggagccggagctggagctggtggacagcatgatcgagatgctgtgcaccaatggcgtccgtcggctggaggacctgcaggacctcctcgcctgctacctctcgctcaacgccgccgagcaccaccgcaccatcgtcgcgctcttccgccgcgtcgtcctcgtctggatccacctcggcagccagaggcttcttcccgccagtgatcaaaccagctcagtgaatccattgctcaactcgatgcatgcatggtgatcgatcatggcgtgctcaattgatcaattcttcatggttacttccatccgagtgatgactgatcaactcgtcatcagttactgttaatttctgttcttgacttcttgtacattcttgagacatggcgcttgtgttaaaagagatcgggttgcttgtcaggttaagtaaactaaacatagttttcttttctctttcgttaacctgtctctgttacgtttctgtactgtgtttttacggttggtgtttgtggttttgtgaggttgttggagagaatagaaagcgggcgcagcgcaggatgtgcgcaacccactttggcgtcaaaagcgagatagatcttagatgccgcctttacagctcgattggctggacaggaaagcaatagggggaattcctcgctgttcgtctctcgtcgccggtggaaattatttccacgcgtgtcattcggtgtcatttgggatttgggaatgataatatcagaatggaagcctgcggtttttacctcaggtattctccccattccaaaatagattattttttttatttttgcacagatcaggacataggctatgttggtgtaggtgttagttgaaaaaaaaaatcagggcatcacctatcactcccattaaaattctagttatagattgttcagaactagggttgtacttttttccctttgatgaacgaattatttttggacttgaaattttggggttgttagatgcatattgcatcaatgctttgtttctttttttttccagaactttttacatagccaaaaaaaaccatgatccatttatgtggaaagtggaagtgtacttgtagcaggatatctccttcaaaatgtagaatccattcatgtggtttgcacaacagtaaagaaatcacatgtaatttaattgtcatcactacaattaggagccatagaattttgtataaaattaggtaaattcaggaaacacagcaaaatgagaccaactaccacttcccaagaaaaaaatgttggtcattgaaaattcacattgggatctttgcagagtagaagatttacattcttattgtaaatccacatgctccacgcctccaccccctttttcttaatggggagctcatatgtttggtaattcatcatgttgtctctaggttgttttttttaaaaaaaatcaatttttttgttgttcttgcaaggtattaagaggtagagatatctcgcggtaccaaccaagtcgaagatatctcataatgttaattttgtaagctttcaagggccgttaagaacctttggtctgattggcgcttgccaaaatttggaagtgtagagtcgcttcaatcacttgcttggtttcctaccaattagatcaaagatccgaaagatttgcattactacgaaataaatttaccaaatattgatataatccaaatggattgccaaatacctttcaaacaaagaaataattagtagcgaaccaaaccagctctttaattttaccgattgttcctacacatcaacatcaacatcaaacaatggtgtagccaagtaaggccaaaagtaaacaccgattttcagaaaaagttctgttcaccacccaagaatacctcatgcacctcctaggaaagttggaatagaagtgaaatgagctaaaaccatttatcttggacctcggataggctggcaacccaaggatggccgaatggccacatgtgtcccctctgccatcggactcaggagacgggtgtgcatctactagcaagttgtaggtacactagaaggctttgggtgtcgctagcaatctggacggcttgcgacctactaaaccccaaccactggtgacatgcttcgacagttatagaatggtgggagaacacagcaaacacaataggagctccgaaaaaggcgatgcacaccctaacgctgttagtggcctgggagatatggaatgaaagaaaccgcagaaacttccaacacgaagagcttccgatggccagcttgctgacaaaggtcaaggagaaggccaaaacttgggccttggcgggcacgagaagtctccgcgattggcttaatttttagttatcccagaccaaaggtccagtgcatgtacaacttctttcttttgtacaatttactcctatattcaatgaaattggcggctcgctgattcgtttaaaaaaaacatttaacttcattctccattctctgctagtactactcttctactggcagagcctctctacattctgaacactttcgtgcctccgcttgccactcacctctcacaaaaatgtgccgctttccaaaccgaagcagccaacacatccacatcaatccacccctccagcttcaatttaagaaagatataatgccaatgttgaactgccattctctatttctctccacacattattgatgtatatatgaaccgattttctgacggaatgattcatgcaaaattcctatttataaatgagcgtttagttgtagcttcttacatataaaccgtggccaccaaagtgatgtggttttattgtctttgagaaggtatacagggtaccacaatttataatgcaaatttttatacttctcccatatacaactttgctatgattacacaagagaagcgtatgtgcacatatcactgtatacgcacaccaccagcgaatgaggccctaaggacaaaacatatgctcaaagatataaaaccatgcagtaaatctctaacctcaattatccttgggcaccaggttaaaggactttaaccttgatgaatagggccatgcacccatgatacaattgccactccttgctctagatctagcccgattcatcttcatgatagttggagccgccgatggctatagccaggtgtgtcgttgtcctttgtctttggccttatgagctcgaggcaggatgcgcacatcggcatcagctcatgtgcttatcacctccaccaggacaacctactttctcttataggtaccaggtgcaacattctctcaccatggatcacctctttttcccttaagccacccatatccttttcaagccactatgccacactacaaaccactcactcctcccccctcgtccgcttgctttgtcctacacggcagatcactgctggcgtggagccgtgagaactgaggagtgttgtaaggtcattcacagtccgtagatgtggcattcagcgccagggtgccagtgaggagattcccctccatgcgagtataggtcatgcaataagcaaacccctcaaacccccacgaagatgcatgagcctcgccagggcgtgttagggtgaagtatgtgacgtgcggggcgatggcttgaagccacgttggggaggttgtgccctcgcgatgcccatatcacaccacggcgtctcgctgacctctagtggccagagaagaagctccagatcattgaggaagaggaagatgaaaactcacctcgccactctagatccatacaaccgcccacgcgcgtcgccatcaaggtcatcgccccgatatgccacctatgtgggctccgaattggagcttggttcacagccccaccgttgagcttgttcgtcgtcccgccgcttgatcccactgccaccgagctccatctgcatcgtcgaagatcaattcgcccccatcggagctcgatc

SEQ ID NO: 80429 - DNA, 923 bp, Oryza sativa
gttcaggtttgctatcaggtccaggcatagaaactgagggttgaaactaaacaagctctgaataccctgatagaagggacatcccttctgagattttctgaagagataaagagcgtgttagggcatgtactatggagaccactactataagtggtctcaagtcaccggtggaagcgctcccgttccccttcactgctgcgcgctactcttccctttcttcgcctctccctcctctctgcccgctcgagctcgcgccgcctccccttcttcagtcaccattgtcgacgaggagtggcccgtccagctcgtggtggtgaagaaatctccggcatcgaatttcgtacttccgtgtggcagagggcgacgagatcggtgacgctcgagctcgagctctccggcgcggatccggcatcatgctcgctggatctggcgagctcaagcgccaaaaaggtccacaaatccggcgtcatgctcaccggatctagtcgagccgtagccgtcggcggtgtcttcgcggaggtggcgtcgatatgttcggagccactaccgtcggcacggattgagctggcttccactgccaagctcctctcctccctccctagcggtgcgggccacgacgaggcatgggccaactgtggcggcgatgaccaccagctcggcaactcgtcggtggcctccatttcccctttgttttcctctacaacttcctggagcacataaatcgtattctttctcctagaaccatcgttcaatcaccatttcctctgtaggcccctctgccaccctgcgagaccactccaaacctccagcgtagcatccgaacctatgaacttgagaccactggtctgaggcaccgcgttgtacataacctcaaagaaacagcaagctagggtatcaaggaaaaaaaaggtccggcaaaaaaa

SEQ ID NO: 80430 - DNA, 1279 bp, Oryza sativa
atttacttctgcaaattattcccataccaaactaattcagttgtgtgccttcttgcttgcagtaaggaggtgctccatgtaaggactttggagttgctggcatagcagagaattgaatgactctgcttttctaagtgcaagcaattgtgttctttgggttttatactaattctcaaacttgatgatattgggctggtcgcctctatatttgctaactcaatagagcccttttccgttatagcatctttactttccaaattttttaatttgtaatttctttttatatgagcaattggtactatgaatgtacgagacatatggtcctacatcctgtatgtctggggaacgggaattggttgggaaaaaaagttaccatgtggacttattttttgttaggctcatgttgttcaactagccctgatagtttcctaaaactttgtttaatttaagaagctatgtaatgattctatttttggtgtacaagatattggcattatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagttccatccatgcccatgacaggagccacttatccgaccaattcaagaccagcacataatttaactcgcctgcttatgtggacaaccatgaattgattgataatccctgtcaaattcaggacttgacccgcctgtaattcaagtggaataatcgagtctattggcatgacaattttgctcccaggtatagaaacaccatataggagtattgagcataaattttaagagtaactttacaggatgccgcactaaaatttgaagagtaactttactgaaacatacaatacatgaccggcaggagttctggtgtcgccgctccacatgtcaacgcacgtgcaagtcacgtgctgattaaagccctataggggctttacatccaacgataggattatattatccggaagctatgtgaatgcaatgccctctccaaaaaaaaatgaaaagaaaagaatagaaagaaaaatgcaatgctgtgccacaactatgggcaaacccagatatgttcgccaagaggaaactcttctaatatatgaaaacttcttacagtcaatattctgttcggtagataaggaggatttgcgaagcacggcaaaattcagacaggtccattccatggcgatgcatggaat

SEQ ID NO: 80431 - DNA, 6316 bp, Oryza sativa
agagggcaagagcatcgatttctgcagggcaaattggctcccaggtggaagtattgagagcacaaggcccactctcttcagctatgtcaaaataacaggcctgacactgcacaaggaactacagaatcacacctgggttcaagatattgatggcacgccttcaaacagagtgatctgagagtatgtgaatttatgggacgccattgaataattgatggcacttttctgtttcctctgcatacaacatgttctgcacggccagaagaaatcaagctatggtaaactgatctggaagacgagggcaccttcaaatgtcagattcttcatgtggttggcgatcaacggaagatgtggcagacaattttcagaaaaggggtgccggctatgcgagagggctaatgaggattgtgcacaccatttttgttagctatgttttcaccaacagagtatgacgattcttgagttgggtgaatatttctttccagctgccaggggacatttttactgaaatcactaccaggcttgctcagcagttaacttttacaaatatgaaacaatgactgtacaataggagttacaaaaaggggaaagaaagagaaccaaaaaagagttatatgtcataaactttgtaaccagtcaagcactgtctgacatagaggtagaactcttttgtcctacaactatgtaggagaacttctttcttgaacaaggcaaatctatattgataccttgagaactgtgcctagatcggttggtatgggttgattgctttcacccagcagacctaggtttgacctctcgacccgctcatattccacctggattaaatgaagggttggaaaaatatgtggcttctcctatcttaataccattggatgactagctccttctaggcatcccaacattttttttttatgttgataccttggaagatcattttgttaggctgtttccagatatgctaacatggcaggaacataatctctagaaaaccttttatttttacataatttttaataattttctttgacataatctagaaaaaccttttcgctggaatgcaaactgagtccaagcaatcgtctgaaagaactctagatttgtgttccaccgaaatccaatcctcctccagcattgtttgctaaaactgcatagaaagaaaaggtgtaacagagtttctctttgcccagatgtacaaattgcacatgttagacggcattatccggagcataatgcctcttgtccagcatgtcccttgtgtttaggcaatttgaaaatagcagccaaataaatacttttatcttcatcacacactttcatttccaaatgaccaaatccaaacaaaaggcctcttgaaataaaattcaattgtaaaatctttcggatgtatacgcaagattattccatgttaaacatccatttatctcccccgaagatgcaaattatcaatctctaattgcagctgctggaactcagtgtaggcttgaagagacagggaggtagaaagattgctctagtggtctagagcaaactaccttgaccgattccattctgctctttgcatgagaacactgagctagatgtttggtagtatgtctcatatcacaattccacatatcgtcttagaaaaggactgttgtacccgaagttacaaagcattgagttattccgctgaatatctcagccaagttaatcttaatcatatctcttcaccaaaaagatactttattcaactgcatatgtggaacttcactgccataattacttctttcatcccaaaatgttataacctatgacccatcctaggctgtaatattttgagacgaatgtagtattccaggtgagctagctttacccatggaagatccatggccatgtaaaacttaattaggtgcttcaaaagaagtgcattttgcaacctcaagttgatcactcctatacctcctttattctttggcctgcggaccttatctgaggctgccaaagatttccttttgaaattaggatcaaaacccctccttaggcaatgttttctagctagatcaattgtttctattacagttactgtaagcattatagactatagtagttgtgaagagaggacataactgaatttataggttagagcatagttttttttttcttttttgctctcaagctctcgcaaaaagagcgctatattaaaaaattccccacttcagccccttttccttctagactccgatggcttgcagccgatgtagggaatgagaggggtcgagcttctcttttctcctgtgtcaggttgttcctgtttctcaagttagtctcgtagtattgtaaagataaagggaaccactgtcatacagttgcccttattcctcttgcttcgaatatggatgaaatcgttggtctttgttccaaaattcttttcctgctcaaagtctattaggtattacttcgatgccttctatgggagtgcgccaaatctccccaggaacaggttgtgctggccatggatctgcttctgcatcgatcttcctcgttgactccggtggtagacatacaagatatggttggtttttttcttttcttgctgaggcctcaaccccccttgtgaggccctgtttgggttcgtgccaaggcatgatcttctacaacttgccatgatatccctgctttcaccgtcattgtgtgcatcgacggcctggttgcttttcctatttcttgttaaatccttctttgcataattctgggcctatatgtaacttacccatcttcactgggcttttatgtaaaactggttgtaccccaaggttctttacatataaatcctcagccagtagcgtcagcttgtccctaaagaaaatactaaggttgttcttcctccataattcaagaaaataacacttgttatgagccttctctccatgctgtctgtcaaatgagcatgatccactacccatgaccttgggaagatgatcctttgacttacttccctcagactttaagtcactgacataaaggtctactgggtagagggcccatatgtcagtaacacaggttagagagaaataggttagatgattttaatcccttgaccttgtagtacaaggtaagggtatagatatgtaaatggaatagttcctactacacgcccaaaagtaccagctagttgttccaccttttacttctagtacattacgaggtattacactttgacttatgaaaattcagtttgaggccagtgggctgagcaaaatattcaacaaagctttaaggcaaaaaaaaagttcattatgtgaagccctcatcaggattatagtatcacgagtatattgactaattggtaatccgcctccatcaggctcattgataggtttgcatatcagtcccatttgacatgccttgttgataatgcttaggagcaaatcagctcccaggacaaaaaaacaggggcgacagtggatggatctccccatgtggccaccttactcctcttctacactaaaggttgtgttcgttggagtgagttgggaactaatccctccagcatgtaaaacgaagtgactcattagcgcatgattaattaagtattagctattttttgaaaaatggattaatatgatttttttaaagcaacttttgtatataaattttttgtaaaaacacataatttagcagtttgggaacatgcgcggaaaacaaaagggctgagttgggaaagccagcaaaagaacacactataaggagtttggaactccattgagaagcactgagttagaggcagttacaataatgaaaatgctatatgccaattagaaccatttggatggaaaccccatatgcttcataatctccaaaacaacttcatgctcaatggtgtcaaagggtttttcaaaatccaacttaagattacaatcaaattggtaaaaagaaaaataaaactaggccagcgcatatgacatgtggctcactataaaaaaaaggcctaacacaacttgtatcacgtacatccgcatgagaagagtatgggtgaagtatgcgcccacagttatgtggatgatttggtggcacgcgatataagcgtagcatttagttatggaatcttcaatgttccatccaaaaaagtagggttaattggatccatgccattgcaaatttgtcatattagaaaaataccaaaactatttgcaatattgactgggtactagtacaattttgtaaaattagatccatgccattggtgtcacgttttccatcttcatatagaccaaaatacccttagacattggacctacatatcagtttcatcttccttctccatcctcccctcttccctatctctctcctagctcaaatcccccatggcagccgccgtcgaccaccgcttcaagatcttcgcggttgccaacgccttcaaccatccgctcaaggacgttgtcgttgcgcacctccgtgcgaccgcgccaacttgtccgtcgccgaagtcgtcaaccttggagtcgacaagtactacgccgccactgccatcgccacctcctcctccgatgccgaccccatgctagaggcatgcggcatggctgcgggggtcaccatccttgccaacaagtacctgcaatgtcctcatgctccccggcgtggccagccaccgcctggctcgccatcctgttccgcgccccatgccctatctccggcgatgccccctagctccgcctatgccatctgactccgctcctgactctgcttgcgccatctgcctccgtccctgactccgcctatgccatcagctgccttaggaaggggatggagttgaagctggtggggatcatggccaacggtgagatgcggatcatgcgggagagcgtggagcgtggttcaaggccgggagcgtggagctagcacggtggtgcaccaccgcatgttccagatgtgggggaggagaagggggcgcggccgaccggcgtggaagaagaaaagaattaaaggaagaagagaacgtgacgacaatggcatggatccaattttgtaaaatttcagtggcatccagccaatatcgtgaatagtagtggtatttttctaatatgataaatttgcaatgtcatgtgtccaattaacccaaaaaagtatgcttggttgaatttcattgctaaattttagagccttctcagaccactcggtcagcgacaaattctattcaagatcccaagcatttcaaaatttgtcatctcacttggctagatttcagaattgcaaacaccaagtgaagtgagcatatctcaactgtttaggttcctcagtggaacctggccactcgggtataggtcatatccgtcgacagtgaaacctctgcgtttacttggttaatcttaaaatatgcacataaggtaggtgtctgtgtaaaaattcataaaagtatttacacgttaggagcgcgtgcgtttctactttattttgaaacaagaaattgcaaacacccatcgtaagcacgaaatctctaatgcgcgatcggtcgctggaatctcagcgcggcgatcagttttcattcatttttttttgcgaggctcgtgcacctgctctcgtcttttccaccgcttttttttttgtttcctcacgtggtttcctttttggcaccgcattactttcctattttagtaaatttttgcacctaaagtttttacatcttaaatttacacatctaaagtttatacacctagagtttatagatccaaagtttataagttaaaagtttatatacccgattcaaatttgaatttaaatttaaatattttttatatatagtacacgtaaagtttacacatctaaagtttatagatccaaagtttataaggcaaaagtttacatatccgattcaaatttgaatttgaatttaaatttgaatcggatatgtaaacttgtgacttataaatttttaaatgtataaactttagatgtatagaaatactatatatagaaaatatttgaattcaaattcaaattcaaatttgaatcggatataattcaaattcaaatttgaaacgggtatataaacttttcacttataaactttaggtctatagactttaggtgtatagaaatactatatatagaaaatagttgaattcaaattcaaattcaaatttgaatcagatataattcaaattcaaatttgaaacgggtatataaactttaggtgtataaactttagatgtatagaaattctatatataaaaaatatttgaattcaaattcaaattcaaatttgaatcggatatataaacttttgacttataaacttttagtatctaaactttagatgcgtaaacttgaggtgtat

SEQ ID NO: 80432 - DNA, 5685 bp, Oryza sativa
  unsure (1)..(5685): unsure at all n locations
atgaagatgcaaaaatggtaggacattgtctgatgaccttgccttatgcacaatcagctcatggaaggttctcgaataatttttggacctttcaacattcttttactgagacttacctatggtctaacggtatgtatgatatcaactattgtatccaatggcccatattttcagttgacgtggcttaatgagacgttgcattttgagttttaccgttcacttttggctgtgttcttttctcccctttcacaactcacttctctcgttttccgcacgcacgcttttcaaattgctaaacggtgtattttttgcgaaagttttctatatgaaagttgttttaaaaattatattaatctatttttcaaatttgtttaggctaaaacttaattaatcttactataattgtgtgcttggttttctatgttgggaggcaaggttgccaaccttgtctaccgaacacagccgaggatatagtgtcactgtaattaaaacaataactaacagaggatcaaattatcaatttttactacatacccttccattacttttatttagatgacactgtctagtttaatataataaataaataaaaaaagatcagaggtagtaatataataactgatatttctttttgggccattctttaaccaatattttcactttcgactagataatttaaactttgtttgtactttggactacctatactctcgattcgagtatatcaatttctatttgttaataaactctcactgtatatgaaccgtttctttcacgtagaatgacgagttagatgtagatgaataaaagagtggatggtggtccaaaataacacagaggtaaaaacccggtttaaattgaaaacattggataaaagatagtccaaaacgaaacatcattaataaaatttgacccaagataaaattctctctctaataaataccaccaatttatatatgtccatacacgcaattcaccgtcggttgctattaaagctgattcaacggatgggaactaatcccttccgcatggaaaatagagtggtccattagcacatgattaattaagtattagctatttttttcaaaaataaattaatttgatttttttaagcaactttcgtataaaaactttttataaaaaacacaatggttagtggtttgaaaaacgtgcgtgtggaaaactagggagaggggctgggaacacagcctaaaatgggagaaatctgcaaattgctcccacccacacgcactgcacaggcacacacaccgagggtccgtggcgctcgccggcgacggatgcggggggaggggaaggaacgtcgatggggacgtactcgtcgccgccacgcagcaggtaatcacgggagaggtgagcgagagatcagagatgtgtgtggaccatgatttggcgccttgatgctgtctgtgacccccctcgtttgcagcttgctgcaggtgacttggggaatgagattgtggtgtgggctgcgccttggatgcgatctgatgacccggatgaatcgtcttcttcgtaaaggcgtgtgagttggcgggagtaagattgatcggtcacacttgctttggtttaacgttgacaagcttcactgtggaggcaccctgttcgacgttttgcctaagagagcctggagagtttcatccagtgtttacacatgaatgccatcctgtgatgtggtgacgaacaaagccagtgttcaggacagcttaggtcagtggctaaggatggttctttctttttttttttcttttgggagtacattctccttaaaaactggccttctcatgattntaaagtgatgattgttctgatctaacccgtgtgaacttgtgatcatacagctcttagcggcaagaaagttataaaacagggcaaaaactcgaagtgcagatcacctaatgctgatattggtatatgttatcatcaccaaagcacacaattggaacaaaggagagttcacattttggtatggttttctacatatttttcaatgatttatgttgtgaagtttgcagaattaaagtacttgatcaacatataccatagacgtgtccaacttgtccagcagcacatgattacaagaacctagtggactagctaccacgtgataaatgcgagctcattttattacataccattgagcctgcattaaagcacaatttacaaaatgttggcctctctcaacactgctggagttgtatacatactgacatacacaaagtactctcagcgttgctttctcatgcaccttccccataaaattaggattgtcattgcataggaaacaccaaatcccaatgcagtgaagaggactagtacaacatctgtggatttctccgaagtgtatgtcataacaatgggctcttttgggttgtcacattgtttggataacggtggtccacacaaaccaatgtttccaagaaaagaattgttggaaaaggtggaaaactgatatgagtttggtattcttccaaccaacatgttgtaggacaaattcagtgttgaaaggaagttgagtgatgctagctccttggggatccccccagtgagctcattcgaggagaggtccaatgactcaagttgattcaacctgccaaactgagttggaattgatcctgtaagggcattgtgagacatgttgagcccgtgaagcagtacaagccccccgacagtctcaggaatggtaccatggaatgcattatttgagaaatcaatcagcataagggtcctcaatatcttggaaattgtcgtgtcactccctttgtatgtaactgaggcagtaaactggtatgtttgcccatggtaatatttattttccatgactagtgtatcattttgagtcatggcaatcatggacttgagcatcttaaaccatgcttctggcaatgttccattgaagttgtttgaggccatgtcagcaattctgagctgcgtaaatgcacagctgttcctgtcaactgtatatgaaggatccattacttgtccagtgaacttgttagacttgaggacaaggacttgaagtttacgaagtttactcatccaacatggaaaggagtcactaatctgattgtttccaacgtcaaggatctccaagttcctgcaagaaactagagatctgggtatctttccgtcaatcaaattgccacttaaatctattgcctcaagtgaacagccttccttgatgctatcaggtaaatttccaacaagtttattttcttttagacttaatacttgtaattcaatggcatcctccattaagcaggatgggatcgaaccactcaagttattgtaagagagatcaaagagttgcaaattcgtagcagcggtacatattgatggtggaatatctccagagagtttgtttctggaggccttgaaagtgagagtttccccaaggtaagttaagtaatgaagaggaatagatgagaattggttgctcgagtaatctaatgtgctgctaccttcttgtggtatcggtatggcccttcaatactgttgaaactgaggtcaaggaattctatatgaagaggaagcaaaggatcagatccaagacttgtaaagttattgtgcgacatgttcaagaggagaaattgcaagcctttccatgtcttccatgcccactgtggtatagctccttggatctggttatgtgaaatgtcaagactaaacatcttatcgagatgcttcaagatattgggaaaagtagacatgctgcaagatgctaaacttaagaactccaaattggggaatgacaccagtgatgaaatattttctccatctaccactactagtttattgtttgagagattcaggacggataggtttttcagttttgagaatgaggtgagttctattgtgccgtcaaaattgttcgaatggagcacgagagtttccaaatgagtcaaatttaagatctgcggaggcaccttccctgaaaacttgcagttgtacagtgctaacttaatcaattcccttaagtttcctattgaagaaggtacatgtccagacaatccgcagttggagaactggagaacagtaagagaagttaggttggatatccatgacggcatggatcctactatctggaacccagacacttctagcaaatccaagtataggaagctacctaacgaagagggcagtgttccagagaaaccacttgcaccaatgcccaacttcttcagagatctgagattgctgatggagctcggaatcatacctgtgaagtttgttctactgacggacaaattctccaagctactgtcctgtgagaaatttggcagattaccagatatgccaggattcttagaaagatcaattgttctcaacttcttgtgctggaagatgatgggaggaaaccatccttgaaacttgtttgtggatagctgaagaacagtgaggttggaaaagccagccaagaactctggcactgaacctgacaataaattgtaatgaagctcgatcgtggtgagcgatcgcatggcagcaaatgatgcgcatacgggacctgacagtgagcagtaaggtaaactaagaacttgaagcttaggtgtgtacttggctatgtggtcacaccacaattcgccattattggacatatccaccattcccatatggagctcctccaggttagtgaggtttgtgagcaaggtctccatgtttggtgctgagagctgcccaatggagtctacagcgtactgtgtgatgctgttttcgtcatcgtaagacacgatgacgaagctcgtggagaggtcgaggtagaccaggctcacgaggcgcccaatgccagccggcaccttgccggcgatgttggtgtccgagaggtcaaggtgtgtgagctcggtgagctgctcgaatccagtggccgggagctgggacatggtgaagatgttaccagagaggttgaggtgcttgagtgaggttaacctgaacagtgcatggtcgaggccgccggcttgcaggttgtggcctcccaagtcgagtgaggtgacacggccatcggcgccgtcgcagtggacgccctcccagcgacagcagtctgcaccagggacccatgatcgaaaggtggtggagtagtcgccggccgtcgcgttgaaggagtgcttcagccggagcagcgcggaagcctggtctggaaggcacattgccggcgtcgtttcggaggaggtcgtcgtaaggtcgtcgagcgtggtggcctggactagctggaggatgagcatcattgctaggagtgatgccacatggtgagggactctcttggagaacgacgacatggtggtgaaggtattttcgcaagtgctgtgctttatccacttaaaaagacacgacacggtgaaatcagtagagggtggtagatttcttgaattttagacgactgtcagaaggactggggtcatgtatcattggttgaaagggctgctggctgttgcctaaacattgtagtgggaatggaagacgtgtagtacatgataactgcagaataccccccaagttggcacacatgtatagtaattgctccagttctgacgacctttgagaagacccgcaaattggacatgttacacatgtataagggtgtgtttagttcatgaactaattagaagtttggttgaaattggaacgatctgacgaaaaagttgaaagtttgtgtgtagaaaagttttgatg

SEQ ID NO: 80433 - DNA, 19009 bp, Oryza sativa
aatctctttttgaaaagaatcctttctcatcaaaagaattaccactttctttggtttgaaaaaaaaactatatctagactctatactactttatactgagtataatgctagtgatggtgtttgagtctgtcttcaatgccacaagctaacatgtgaggctatgtccacacgtatatgattccttaccaaggcttggtttagttcccaactttttctttaaactttcaattttttcatcacatcaaaactttcctacacacaaacttctaacttttccgccacatcgttccaattttaatcaaactttcaattttggcgtgaactaaacacaccccgagtataactttgttgttgtcatttcagaattgttgaaccaacgtaagtacaagtctaagacttcaccgctttttatttgttaattctatatttagaatttaaaattagggtagtagaaactatcagaaaatgtactatgatagaagatgcatactcacaaatcattaatttcgaatttgatatttattttattaagaaagtactccctccattgatagtcatatttcatcttgggacacagaccaaggataaataattctacttatcatccatttaaatatgctactagttattcctcgtaaacaagcgattcattaatatttacattacttgatgcccatgtagttaatcttgtgtggaagaatagagagtcacgcatgaaatctgagaaagtcattaagaggatatgttgttggattgaaatatgcctatcaaaaataaatttttcagatttggaaaaatatcaatcaaaagtagatggagggagtactatattgtggctggttgcatatatgttgtcttaattatttttcatatataatgagttatcttccatacgatcactaacatatcgtaggagtgtatatagaccatatttttctgtattactccaactgactagcaatcatatttgtggggtcagaatctcaaggtagaattatttctagattgtaagtgaatagaaagttggttgttagcttgctggatgtatggtaggtcgatcgttattagtagctgaaaaagaaaatagctggataacacggcaggggaaaaaaaggcatatctgcttatttctatgggaaacactcgttagaagcatttatttctttggatgagttatcatcagtaagaaattatgtagtagtctttatggcatgttcaatggcaatgataaataccgtctcttaaacaatactaccttcgtctcaaagtaattataattctaaattgtttagcatatattaaggtttaagaagaaaaactataatatccatcgttaaataatggtttataggtaaaaatgaaagggcagttgagggtaaaatagaaagaaatttggatgagaagtgattaatcgaatcattagtactttattgtgacaaatattttgggataaatttaaattctagatatacaattattatgggacataggtagtacagtattatttacagaccgcattgttacaacagttgagatcatagaggctctaaccattaactcaatccaaagatattcttttattattattcttaatttctatttttttcacccgcatgcaaccatgtttctattttataggggttatagagtcgttgttgagccgttattatctataacaatgatgttttgtctttcctttttctctctcttctatgttaacaatttatactatctatatagttgatgcccactaatttttaaaagcttaacatgcaagtattctatatcatcacccactagcaatttttatctagagtattgtatatcacatgtaagtgtgcaatatcatcatccactagcaattattatctatagcattttaaatatcatgcaaacatgacatatcatttacaattttgttgtatttttagaacacacactagtagagaaatcatatttaataccgattgaaaatctccattaatcccgattatagcaatcgtgatcaataaatcaagactaaagatctcgacctttattaccgagtcaaaaaaaatatgtgggatgtgggattcgaattcaagatctctcatctcagcccttacgcgcattagcatcccacatactctacacatctaacttaaatagagatgtttttcttttgaactaactctggtggcatcttaagtaataccaaccggtacttaaaaatatctttagtatgggttggtgttatcgaaaaaatacatctttagtactggttgataacatcaaccgggactaaagatccaccaacattagtctcggttggtggtaccaatcggtactaaaaatacatttttaataccggttgaaagatgagtttgtgtgtttgggacattagataaaagatgagttctctagtattgtcaatatgcaagcaatgtaaccattatctccacatcatttttacattatttaaacatatatatctatcatttctataacgtataatatgtagccatccatgtatcccgcaacaatgcgcgaagtatcaactagttatttctaattagcaacactaaaggagcactattgatgaccattatacatctttattgaatgtatgtgtcctcgatcttagcttggacttgacatagaatcttggacccaatgtaacgttagcatggactacacttttggactaaacaagtctatataacacatgtatatgtaaagatcaggatgcatgcatatgtgcagactttgaagtcaattcgttggaaaagatgtactaacgaatctaaatcagtttgcaataacgtgtgttcaaccaccactatgaaaattaattacataaagctagccaagttagaaagaatgtaatcggaaattacgatattaatttaactaccgcttcaattggatgagcgctgaaaaatttgagagacaaagctaccacatcatcgttttcttcaagcccatttagtttgaaataattaaggaaagttagagaaaagtaggtggcttttgtaccagcttaaactggtttgttgttcccgtgacagcatctactaataacacatagccggccgaagcctggtccggaatgcacttgatgttcatcacggctaagcagtgacgccacatgctgagcaaactcccttcgagaacgacaacgtatggatggtgacggattaattttcgcaagtgcggcactttaatcacttaaaatgaagaacgacgacactgttaattagcatggaagatttttggattttagatcgaggctgtcatataaggacagtactcagggtaacatgcatcatatttgttcaagggaattaattgttgcctgaacattgtagtgggaatggaagacatacatggtaacatgatgactgcaaatttaaatctacagttagaggaaattcaattctagattggttttttataggacggatagagtacaggtctacgatctacaagaagaagaccaagctggttttgaaaaagaaaactttctgtttgatgaaaatcctttcagatcaaaagagttaccgctttctctcgtgtgaaaagaattttttttcttaaacttgtgcccacagaccacagtgtaaaatgcaattggaatatcgatcggcactcaagaatcagttgtaagctacaaaagattgtacgatgtctgcgatttttcatcaagtaacgcactcctacgaaaacaatttttctgtgcgggtaaaaactgtttttacgtgtggaggtggcgcccgtttgcctgaaagtgtttgcaaaaatctggtttctctgtgcgggtggcgcacccgatcgcaaaaaatcagattttcgcgtgcgggtgcttctgtcgcccacacgtgaaaaaaaaatccaaaaaacaaaataaaaatagcgaaaaaaatcgaaaccctagttgccgccgcaactcgtctcgccgtcgccgtcgctcgtcgtcattgtcgctgttgtgcgggggagggtgggagagaggtgccaccacggggagaacgtggggacggccaccatcctcctccgctccggccaccttctcctcgtcggtggaaagacgccgtcacggggagagcgcagggacggccgtcgtccgcctccgctccggccacctcctcctccttgtcggtggagaggcgccgccgctgggatggccagcgtccgcctccactgggacggccggcgtccgcctccactccggccacctcgtcgtcatcgtcggcggcggcgggggcggtcgaggcctcactcctcccgccgtcgcctgctgccaagccgcccgcctgccgccgcgtgagtgcgtgagaggagaggagagaaagttggaggtgaggataaggataaggaggtgagagagttggagggaggatataaggatggaatttttgaagtgttgggagggaaaaaggaggcagggtatttttgtgtgggaaaaagtacgagttacccccataaactatcgcggtcgaccgaattacccccctgaacctgaaaaccagacattactcaccttaaacttttaatagcggataaattaccccccctcaacactgttttgagtggttttgacttaagtttgcatacgtgacgccaatgtggcaatccagtcagctaataaaaataaaaatacctcccctgggcccaactgtcatacccctctctctttctccccagtcgcactctctctcccgcgtatgcgcttgggcaggtggctccgcagacggagacaagagcagaggcttgcggcggctgcccgacgtgcgtcctcggccgacgatggcaatgggaccgatggcgatgaggcagaccgagcaatgcagggtcgtcaatgaagatggcttgttcctagcgatagcggcgtcgagggacgtgtcccctgtgcggcgtgcttggccggcgaccggtgagcactgcgcacggaagaggttgggtgagccggtgacctccggatcccagcgacggtggagatgagccgagacggagagggcagccgaaaatgggattcggggggacctatgcggccggaggacgacagacgcgccagcggcgcgacgacgtggaggaccgagacggaggcagcggcggcgcgagatgatgagacatcgatgcccccctactcagctcggtgggacggagatcggcatagccttctcagcccaccgccagcaaccgccttcacccccgcccgtcgcctgtcgcctgccgctgcctccgccccaacccgctgccggcagacgccttcgcgcccgcccacgcccaccactggcagccgcctccgccaccatccgctgtcggcagccgcctccgccctcgcacactgcctgccagccgcctctgcccctgcccgtcccggcctggctcctcgcctgccgctcaccagctagagagagagaaagagagagaggggttgagagaaggggagagagagagggagagaaggagagaaaaaagcgctgacaggtgggcagcaaagagccggcacctttatcctcaaataggtgccaatttttaaaaagaactagcacctattactgttgtaggagaaagatgccggtttttattgaccattcggcaccttgtagtataaatccatcggagtagttgggacgggacccatccaagaaccggcatttcttttaaaaggaatatgtgccggttttgtttaaaaatccgacacccgtaaaccgagccgagccgcacctaaggagctctctcaaacccgtaaaacgtttttatccatctacgtactctatctccctcgttcttatcggatcagttctctctctctctcactctctctctcgtctcttcctccttttctctgcctcctctcttgcctcttcgtcctcggcggctgcgggcggaaaggtgacagcagcgagcgacgccctcccctccgccagatccggcaggaggggaggcagcgacagcggtgatggcgggaggcagcggcgggcacccacttgtgtgttcatgttcatgttgttcttgtgtgttcttgattgttaactatgtgttcatgttcatgttcttgtgtgttcttgattgttcgggggtgaaagggagttgctcggagccgatgcatcgagccggctttttttattcctgaaatcttaaaggtgccggttctaaaacataaaaaaaccgacatctttatccatatagatgcctgttctagaagcagctctgattcatcagtgccgcctctgtggtgccggtacctaagggggtttcccaaccggcactgaaggccttttctgtattagtgtatttaaagaaagggcttccaaatgcaacaagagcactgcaacaatggtaaaccttgcggaacagggagattagacggagctcgattagtttccgctagacgaggaataaagaacataaccaaaatggggaacaagggaatactggaccatatctgcttttgcgccacgacaaaacaaaatgctagttgctagcttcccagtaacgcatacgtctggagcgtttgtcccatcgacgagggccaatgagactactatacgcgtttactctttttgtttttaacattgcctaaactgtaatttactcattttcgttagacattgtgccaagaggatgccacttttcaattaacaagaaagatattacaatatagtcatactacaaaagaggaaaagggaaaaaaaatacaacaaggccacacaaggacaaaaccaccccttctagtttaccctaatgtactccatagaaatgaatgcgtatggatcattgtatccctagctagataggggcagtttatttatttgtgtatttgtatttgtaagacaacgtagatcactataaattgttcacaagcactcatggacgaccacctccgtgtcgataagggtgcccgcatattattcctggctcttgatttgagcaccagttcagcaacctcgcggcggaggccatcaagtgtccctcttgcagcgctgtcgtcaagatgagcagcgtgaggagcacgagcagcaggtgccggccgccggtgatcctgatgagcgccaccatcgtcgtctgcttgcttaattaagttaacactgcgatgccgtgtagccgtttatataatagagcgggacgagctgatgaggtaggtagctagcttggaggccaactgctccccggctgaccagtcaagtgtgtggcctcgcgagtccaataattggggtattcctctttcaccagcataagcaaaaaccgattacaattgaaatctaaacgtgtattcggattaattaattagtacaaagttaaaaagtagatttgaaacattataataaattcatatgtagaatttcttttcacaaaaatatcatgtgttagcttttcggaaagcatgcagagtgtagtcaagaaatctagtcatgcatataggagaccaagctagtatagtatagatactaaactgaggtacttattagatagtttaattggtattaatttataatttcaaaattattatatttggaaaatactaagtacatactacctgagtacaatttggtatgcttattatttattattccgaatttcataatctgtatattaccaaaaaggcataattgggactccttatcgatttcactttgtcatttcagaattgttaaaccaagataaacaagtctaagacttcccaactttatgtttgttaattcagaatttaaaattttaaattaggataatagatatataatgtccgaaagggtaccacgatttaaaatcattagttttaaattttgtaattattctattaagaaagtactatattgtggctcaaataaacccgttctgtgttttgtcttcattttcttttatatataatgatttgtcttccataccatcactaggtaatgtaggagtgtatatggaccataattttctttatcagtcaacttggctagcaactatgcatatatgtctggtcagaatctctatgtagaacactatttgtagattttagagaatgggaagttggttgttagcttgttgggtgaaggataggttggtagtaattgccaaagaagatagataaatcgggaggtaggcagtgtttagttcccttcaaacttccaaaaattccgtcacatcaaatatttggacacatgcatagaacattaaatatggacgaaaaaaaccaattacacagtttacatgtaaattgtgagacgaatcttttgagcctaattacgtcatgatttgacaatatggtgctatagtaaacatttgctaatgacgtattaattagccttaatagattcatctcgcagtttacaggtggaatctgtaatttgttttggtattagtatacgtttaatacttcaaatgtatgtccgtatacgtcagaattaaaaattttggccaaacaactaaacacggctgtaatataaaaggccaacattagaaatttcaagtcatatcaacatttttggtgggcagcattcgtttgattcatccatcctgtccttaaaaagaaaaaggctaggtatgttaatatcaaataaattatttagataatggaatagaatcccaacctttactcaacgagatacaaccaattattacacaaatttatgcaaactagcgcacatatacaagttttttttaaaaaaaaacaccaacaaattaagctgaaggaaattaacacaagctaattaataatcgcccacacaaaacaaagactctccattaattctaaattttaagatgtattagcttttcggataggagagtagtgaataaatctagtcatgcatataggcaagaccaaagttatcacaggacacattaaactaaggtccatgttagatagcttataaatagttattaatttataatttcaaaattattatatcaggaaaaaatagtaaatagatactagttacttatcgattcgaaatttaatactctatattaccaaaaaggcataacttagacttcttaccaaataaaattttgtctttgtcatttttcagaattcttaaaccaagatcgataaacaagtctaagactatgtaactttttatctgttaattctgattttaaaattttaaattaggataatagaaagcattcgaaaaaggtactacgatggaatatgaatactcaaatatcattaatttcgatttttttaattattctattaggagtatactatcaacccatctttccgcttatgcttatacttatgaaccaaaatttgaattctcaacctttaatttgaagttgactttggggttttttcatcgaaatttacttttcagtctttgattttagatcgctaaaaacacatacataaaagttttattcacaaattatttctcgtttgcaaatatgttacaatgggagcgtatattgtatcttactccctccattccataatataaggcacaactaatttttatagttgttacataatataaggcatatatgcatgcatgccattaactaaaatattattatttaaattctccactatcaagatccctaattttattgggtgcatgcattgcatttattagattaatccaaactatgaggtgataataattttttttagtctttgggttaaagttgtttgtgccttatattttggaatggagggagtaataaacccgttgtctaagtgatttgtcttcaatactatcgctagataatgttgtagtatgtaggacagtgggagtgtatgtggaccataattttctgtattacactgacatgtatatgtgccggtgctaaaccttggaaattggggtgtcagacgcggaatagatcagggggatagaatctcttggggttaggttaggtgtctctcggcggtggaggcagcgactgctttgagtggaaaccttgcctgtactatgagcgcgggttctgaaaaaacggcaacagctaaaaggaatacaaatctctatctctatctctactacttaaaaaataaaataagaggtgcttccatcgtttgtaaaaaaaacggacgaaaaaaatctgtccgatcaaaaacaaaacggacgaaaaaaccagacaaaaaaccgggcgaaaaaaaagaaaaaccaaatcgtgaaaaaaaggaaaagaaaattgaatccaattccgcgctaaaaaagggtgaaaagaaattaaaaaggaatatgtccgattcctaaaaaacaggcgaaaaataaccatgtgaaaaaaagaccggataatagcgagtaacacataagatcggaaaaaaaaaagtccgactcctccggtggaaaaaagagagaaaaaaaacgaagagaaaaaaactgccatcgcaaaaaaaaatctccgactctaaaaaaaatccgactcctcgggggagaaaaataaaggcgagaaaaaccaggaaaaagagaaaaaaaaacttctatatagtcctccgtccctgtacgcccgatgaaaccccagccaaagaaaaaaaacgaaattaagcaaagggataaactagattgaagttcccaaaattaaaagaggataaacgatattgaaactcccctaactcgaaaaaagggaataaaatatattaaaatttcccgacaaaattctctaaacttgaagaaccctaatttcgggtaagaaccataagagtcaaatccaaatcaattaagctaagggttcgggttacttaccggacttgaagcccctgagctcaccgaagctttccgggaagcggcaccgccgcaccttcacctcctcgcagtcgtgttgggttccctgcacgcgctgtcctagagcacccctccaccgtcctttgccgaagacgggaagcgtcggcttggcgtcgccctaccgccgacgaggtccaggccgctcggcgctcgtcaccgtttgcacgcccacctagccggaccgccgacgtcgtggcacggctttgcgccgccctcgggtgcgcccccccagccggcaaagcaggagccgctcagcggttgtcgctgcacgcgcgcaccagcttgccggaccaccgtcattccgctcgctcgtcgccggagagaaatgggatcaagagagagggatttgggagctagggttttgcccctctccccggtcggcgcttcatccggcgggaggatgattggagccatccattagatcggacgactcagattcgaccagcgtcaggccgtcaccgccgttgattacgctgcgcccaatgggccgcggaagtgcatcggaccgtccccgtatatgtcggccgagctcagctgctcagcttgcgggcagtcgaattgactcaactcgccgaagatgcgccagcccaagtttgggccggcttgggaagacctaggccgaaagcaaatttgatcaaacaatgtggctcacatttttcaaattaaagtccgttggataaactcttaagtaggctcgaaaaataaatctaaaactaaatcctaaattctatgctaattgatcaaattagactctgttctacctatttgttaatatatcaaattaaacttgatttttacagatttgaggttttcaaggtgtcacactatcaaacggtgtttttcccgttgcaacgcacgggcactattgctagtattacaaatgactaaatatcaaataaatataaggagtgagtcttcgaacctagatcagctaacccaccatcttgtagagctagccggaagaccgctggatgtttctcaagaacaacggtagctgcaggttcgtacgacaccgccgccgctctgacggggcccgcgtacttgggggctgaaaagacgaacagcaagctggcctgcactggcctgcagggggccatccatgtcgttaacctgttgcgtgatcggcgtggcccgcgctttcgctttcgattcgcggaatcacgagcttgcatacgacttcgggtgcccgcggcccttgcatccccaaacagcgcgagcggcagcctcccgacgcgaccatggtatatcaatgcagtttctttccaaaccagtgtactcgtgcaaattcacaaaaaaaaacatatatttccgaatttcttttcttgctcaaattggctggcaaatcataactgtgtggtcagaaaccaattgttgaattatttctttattttaagtgaatagaaagtttgtctactagcttgttgagtatttgataggtcagcagtagccgcctatcaaggtaacattagtgaagaaatggactttaataccggttggaaactctctttagtaacgattattaagcaaatcaggactaaagatctcgatctttactaaatatgcataccaagtaaaaaaatgtgtgaaatgtgataatcgaactcaagatctctcatctcaaccctcatgcatgttaccatcccaccttctacacacatctaacttagatagatatactttcttttcaaactaaccctaaaatatcttaagtctcaattggtaacaccaaccggtattaaaaatatctttagttttggtgttaccaatcggtattaaaaataaatttttagtccggtttaatattactaaccggaactaaagatcctccagcattaatttcagttggtgttactaattggtactaaagatgtatttttagtactagttggtaactccaaccgagactaaaaatattttcagagatttggacttttagaccctacacttgctttagtaccgactcttaatctagccaagatatttgtgattttggataccacgacgaaagattagttctccagtagtgtaacatggctggagaaattatcgatctactgaaatttaaatcatatgttcaaatccagttgggctgtgtacatctattgtgaatgtagaggccggattttaatccattttctaaaaaaaaaagttcaaatccagttgttctcgatgggaagcattcgttggatgcatatgttactttggctgagttctcatcaattagttcgaaaagtctttaggctgagaacccttatcggttttatttggttcttatgtgtttgtctctttgtttaatgtggataagggttgagtgcttcataagagcgttgttttggagtagagtgcctaaaaattgtgttgttctttagttgtctgtcaatcgctttacgatatagtatgacatttttatatcaaatgtagactgtgtgcatctccccgcaaaataaaaataaactctgtgcatctgatatatgtatatatacatatagtctgctagtagtaattatatttcttagcggatttttttccattaataaatactacatagctgctaatccaatgtaacattagcatagactactgttttggtgcaaacaggtcagcattggtatgcgcagactttgaattagtcttctcgttggaaaagatatatgtagtacgaaagtaagtttcataaagctagctacggtcttgtttagttcccaaaacaaaaacttttcattcatcacatcgaatatttagacacatacatagagtattaaatatagaaaaaaaacaattacacaatttatgtgtaaattgcgagacgaatcttttaagcctatttgtgtcatgatttgataatgtggtgctatagtaaatatttggtaatgacggattaattggtttaataaattcatcttgcagtttcctagcggaatctgtaatttgttttgttattagattacgtttaatacttcaaatatgtgtccgtatatccgatgtgataaccaaacatacactttttcaccaactaaacaagccctatgtttctctaaaatccttttggcacagacaacgagaaaaaaatgatacacgtaatgtaggatgatacaaatcacatattatatgtactatcattttctttttagggtacccacatatatactcgtaaggtaggatggataccaagcataaaaaaatgtattatacatacttattatcttcttttcagcacgcccaatcagatacatgtaaggtaggatggataccaagcacctaaaaactgtattatacgtacttatcattttcttttcattgcacccacaccgatatatgtaaggtaggatggataccaagcacctaaaaactgtattatacatacttattattttcttttcagcacgcccacatagatacatgtaaggtaggatggatatcaagcacctaaaaactatattatacgtattaatcattttgttttcatcgcgcccacacatatatatgtaaggtataggatggataccaagcacctaaaaacggtattatacgtatttatttattagtttctttttagcgcccctacataggtacacgtaaggtcagatggataccaagcaccttgtattatacgtacttattgatgtgaccattaagtatatgcatataaccaagcatgagaaatatagaacattgccaaagaatgcatcagatgaatggaggatctacaagatattaaagtacaatgagttttggaatccagttcggtctccggagacagcattgactttaaacagatttagcgttttcatgccaactctgattcgggtgatcttggacttgatggatagtttatctcattacctttcaaacgcatctggtctcatatccaaattcatcttgagtcaatggaaatcatcaaaacaagacatgatattgctgaaatcgaacttgggccttgtaataaactagactcatctcagaagtgtctccctccacctccacgaattagcacttaaccctaaatctatttttctctataaatgtctatgtacacccactagaacaattgggatttggtttaggtataagtttgccaagtgctattcaacttgtctatagtcctcgctcgattagtcggtgactataaattcagatccctcaatagtttgtgcgttgatttgccaggtcgattagatctaccacttcaatcacaactatttctttgtgcttaattacctattcgcaatatttagattgtattttatcttgttcttgcagtgttctcttgtttgcatttaagggatcatcaaccgcgcatcccggttggtacgacatcgtttgtggtgtagcgattgcacgacgttctgaacttgttctggttggtagccacatcgcaaacgtcacactcgatctgatagttatcccctcaccggaaaatcgggccacaagagagagcatcatcagttggtatcagagcacctaaattagctcatgctcaactggaccaaggtaaaaaagattgtgatattctacaattgtccactaattatgctatgttagagctacctgtagtggaacagatttctaatttccctttatcgcaagctaaaaatttagattgtgttgatattgataattcttgtaatgagaaagagttgtgcaatgcttcacttatatacatgccacaacttgtgaaagaacatgttacttctatttctaaatatttggtttccactcaaaataaatgtgtctttgctattgctgaagaccaagaagagctgaaattattgttttctttatgtactttaggttatatcgtatttgatgtcctttcttggaacaattatcatgtcattggtaaatataataatagaggagattatatggtgcatcgtgtgtatatatgttcagatatgagtactcttttaaatatgtgaaaatgtgagaaattaaatggatcatacaacattgatgctattgggataaattcacctaaccttgttttgaagatcgacaacaatattcaagaaggggagtgttgtgcaccattagattcaatggtcaagtctcgctatcattttaggacttgttcattaagtgaggtgagttggttttccctttatataaattggatttatgaggaacaaatgatactactcaatgactgcttgtttggtatttctttgtgtgatctctcctatgacgacaattgcagtaagaaactaaggacggtttccagacaagaaggagaggatgatgtgaccatcaagtatatgcatataatcaagcatgaaaagtatacaacattgccaaagaatgcatcaaacgaatggaggatctacaagatattaaagtccagtgagttttggaatccagttcggccttcggagacagcactgatcttggatttgatggaaagcttacctcattgcccttcaaacgcatccgacctcatataccacttcaaacgcaactatttatttatgcttaatcacctattcacattatttagattgcattttatattgttcttgcaatgttctcttgtttgctttacagggatcatcaaccgcgtgtcacagttggcacgacatcgtttgtggtgtagcgattgcacggcgttttggacttgttctggttggtagccacatcgcaaacgtcgtacttgatcaaagcgatagttatcccctcaccagaagatcgggccacaggagagcgcatcatcacttatcatgttcttttcagtgagagtcagacaatgataagggagtcatcagaatcaaacaatgatagtgagaggccatttgtttctggcgtcacaaaacttccgtttacgtcggtcaaccggatggaaattttgtgtttcatgtattttatagtagtaagcactcctttggaaccagtccaaagaaaaagtgaaagaaactttgaagaatcgaaatctatagaaaattatttctgcatggccctttcataaaggaatgacacaaggaaaatcatttaaaactcctatgaaataattaatatcataagaacattggagggatgccatgtatactcttccttgtaattaatatcgaaggaagaacactctctacgttctttatacgcttggctcccttttcatcaaaggatttgttataaggaacaattctataggattttttttctatttttttgccctttcaacaaatgattgatgacttcaaaatcctgtgaaattcttttggagtggattagattaatacatgttttttttcaaaaaaagttagcatgcatggggtctaatatcttggaaaatgttatttcaatcgacctctcatccaattctcatgtatttctcgtagcttatccaaacaattcacctgtacagaaaccatcataggtgtcggtttcccaactagccactattgatcggcaacaatgctcatagacattaggtgccagattcagaatcagcacctatagagaatataggttccggttcttcacccacaaccagcacatatattatttaaaaaattaaaaaaaaatccccgatggagctgatccggcaaccgcgccatcacctcgccatgccgcactggctgccaccccacgctgcactgggggactagctggagaggggttcaacgagatccaggcggccccagccactacctcacgggatggataaatgtgggtgttggctgcctctgagtataggtattgattttacaaaatcagtaatcggtatctaaaataaactataggtactgatttattagttaaaccgacacctataggtactaacattataggtgtcatttttttatctagaatcagcacctataatattaatatagataccaattttttttaaataaactagcacctataatataaatatatatataggtaccaactttttttaaaaaaaaaaaactggcacctatatacaataggtgttggtttttatctatattttttaatatgtagaggtgggaaatgatattaggtgccggttttaaataaaccgacacctataagcctatccctatgtgaggttgtttgtagtagtgattgtttctttatgttccctttgttgtatgattccccatttctgtttaattttcttttgttgtacgattcataggggacgctctcaaagaacacaacaaagtggagtgcaacttactttcatactttgctacactttagtagtgttgagaaaataagtaaagattgatgggaagttctgggggagtgccagagttgtcggtactctctcctctcttgtacctcgacagaagcttctttaataaaataagtgttccttttggtgtttaattacttaagatatattatccttattgcgggttcatcgcatagtatttatactccctccgtcccaaattatagggcgccccctttttaagaaaaataaaactcggtagctttcgactaataatcatactaactatatctatactaagtattatgtatgttatatcactagatttatattttgaagtactttcatgtgatgctaatttcatatttgttgagatcataaaatagaataaaatactggtcaaagtatattatttaagaccgtgtaaaaaaagggcttataatttgggacagagggagtattaagtactctggacctagaatttggataaagaaaaagttcctacgcgaagctagagtagtattcaataagttaggcgtagtggtgtctagattagcagttagctttgtttgttgtgtgctccacagaaaatgaggtaggcaacacatggtgatagccatgtccgtcttttgtgtcccttcacgttcgggtacatcatagagctatagactgaactcagcttggcagaccaggggagagtcagtgctcaaagcaatcgatagagttttaccttaacttaagtttagttaattaatccatgggaatcctctctagcataagcctacaattcgttgttgttcttggttgaagtctattcttagattattcacgcatgttttctgtgattcgatacccttagaatactctgaggtaaagtgttgtagtagtatctatgcgcttgtgaatttatctgcgaccgtaacaaatgccaacaagcattatgtttctaaaaaataattctctgtctttcaactctcttttgattcaaacatttcctccaacccatggttcgcacactaacaccctagccgaatctcaaggaaggtgcctttcctcccctctacagaagcttgggctctcacaaaaaccatatatttgtatgacttatgttactccctccgtcctataatataagggattttgtatgggg

SEQ ID NO: 80434 - DNA, 640 bp, Oryza sativa
aatcgacatttgatcggaatcggccagtttcaagttcagacttcggttggtgtgtagtctggctgtgtgggcttgggctgttagaaaggcctgatgggccagcactttattagaagaggaataagtctactttacgtccctccgctcatgccacaaccgcaaatcaggtattacttatctccaactcacaaagccgtcgcaaatcactcctcaaacagtttgggagatagtttcgtccgatgggcatctttcaccggttcaccccgttgactagctgagccagcacacgggccccacatgttagtgtcttgtagagaaggtgtggctggtgaaaactcaccgagggaggaggcagcacccaccgcccatgcccaacgccctcatttcacctcctcctccacccacccatcaccaccgccgacgccacatcagcccagccgccactgacccctgcgtagacctggccaaatggccgtgccaagccgggccggcccgagcacggcagtactgtagccggcccagacccggcacggcacgccagcttgtgggccgtgccggcacggcccgttatcccgtgccgtgtttgggccgatgcctcagcccgtgggctggcacggcacggcacgtttactgtagcgtg

SEQ ID NO: 80435 - DNA, 6515 bp, Oryza sativa
ttctatcaataaacaaatattctagctcaaaaaaacctgctgtatgtttcgcgtataatgatttgtcttattttcttcagtactatcactagagaacatatgataacataggagtgtatatggaccataattaattttctgtactacacaaattggctagcaatcatatttgggtggtagaatctcaatgtagaatagaaagctggttgttagctagttgggtgaaagataggtcggcagaagccgccaaacgagatagataacgcgggaggaagaaggccaatgcaacatttgaaacttcaagtcctatctacatatccggttgatttttcaatgggaagcattcattggaagcgcatgctggtttggatgaattctcgtcaatcagatatagcttgtctggttcatttgggtctaactattttgatgcttatatgtcatctctttgttgaatataatgtgtcatctttgacttcatataaacatcttctatttttggatgacaatgacggataagacattagatatggtagtccttcctaagaatgcagtttttgagtattgactagaaatttgtgttgtcttcggttgttttatttgtgagtccttgtttaattaagttttcttttttcttttttataacactgtgtgcatctgatagatatgtaggccgggtgtaattttattttttaatgaaatattttcgattagaaaaaagaactacatagttgctgacccaatggaacgtcaatatagtctactcttttggacaaaacatgtcagcatgcgtgcagactttgaagtcttcacgttggaaaggatgcacgaacctagatttagatcagtggcaataacgtgttcaactacaactataacagtacataatagagccatgttcatagccaatggtatttatctaaaatgcattggcacagataaggacgggtaccaaccacccaaaaaacgtaccctctccgtcaaaaaaaaaaaaagaccaactctacgaatgaatctggacacgcatgtatccagattcgtagctaggattaggttttttatgagacggagtagtactgtctttatatatgaatttgaatatatatttaactttatgattaagagttactatatattttatatattttggattaaatgtacactattggagaaatgatctttgctctgctcggtggtccgaaaaccacaatagtcccggttcaaataggaaccgagactaaagatcatttgttgtcccggttaaaaagtgcaacggaaatggatgatcattagtcccggttggtgttatcatctttagtcctgtttggtcctctgacaaggtttgtcaggggccgaggatctttagtctttgttggtattaccaaccgggactaaagcttgtcacatttttatattccttcctcctccagcccgagccattgctgcaaattggaggtggaagggagggaggtgctgtccaaattttttgtgaatgtgttttggtgataatatacaaatcagagggatcgaaaatgttagtaactccattctctaatgatgtatgcttagcatattacatttatagctttgtgttctatacattattgtctctaacaaggtttatgggcaggggtagacgagggcgacgaggacctcactgctccctagtcctacccacctaaccatggccaccgacaagtatagagagtaagagatgagatagggtagagggggatgtcaatgccacgtgggctacatgccacgtaggcgtcacgtcaaaaaaaccagcctccgtagtgccttaggatctgttttgcattgtttttgcaagttggggggggaggatcaagatttcttgtattgcgatttagggatgcaaaattaaatttgacgggaatgataagggacgtaaaatgaacttcttcctccttcccctcccttacttccttcactctcgccaccgcctcctctccttccttgcctcctccggcctcgccgccgcctcctctcctccctccccaccgctgtaggggttggtggcgttgtggtcctaagcgagggcatctccatcggatgggttgatgacagtgtcgacggcagcgggtgggtggaggaggaggtgaggtgagggcgttcggcgtgggtggcggtggttgcctcctcctccctcagtgagttttctccggccacaccttctctacaaaaccctgacatgtggggtccacgtgctggttcaaccagtcaacggggtcaaagatgtcacgtcgaacgaaactgccttccaaaccgtctgaggagtcgatttacaatggttttgtgagttggaggacatgttatacctggttttgttgttgagggatgcaattcaaccaggggcatgagataaggaacgcaaaatagacttatcttcttactaataagtgttggcccatcagctagactacacaccaactgaagccttaacttgaaactggccgactccgatcaaatgccgattcagcacgaattaggccctgtttagttctcaaacaaaattttttatgctgtcatattgaatgtttagacatatgcatatatagagtattaattgtagaaaaaaaactaattacacaattcgctagaaaattgctacattctatttatttctccctgaaaataattacacagttcaacttaaaaaaaactaatgacacagttcgttacgttctttttattttcgggcaaaaaatcgcccacctgtaaatagctaagagcaatgcaagtttttttttattaggatttgtgccatatatgtatcattgccatatgaaccagaaccaaccaaggcttcatgcatgtgtcaattgtcggggcaaaaccttgccatatgaacaaaaaatattttttttctttcaattgattttatggccgttgaatttgcacggaaattgggatttgtatcgaccacagccagcacttttagcagtgattacgactccttagagggcacctgtaagttgatgatctacctgtcttttttgttttttttctttgctttggatttcttgttctaacttcactaaatcagctaggaagaatatttatgcaaatttatatactcctgcctctaccctataccaccgtcatccggttgcccttatcctgcttgcttcgaagatggatgaaattgtcagtctttgctacaaagttctcttcctgctcgaagcatatcaggtactacgatgcctttgtatgggagtgcgccaagtctcccaagaacaggttgtgccggccatttgttcttctctggccatggatctgcttctgcattgatcttactcgttggctccggtggtgaacatacaaggtgtggttggttttttatttttcttgctgaggcctcaactttcctcgcgaggtcccatttgggttcgtgccgaggcatgatcttttggagctcgccatgacatccttgctttcatcgtcattgtgtgcatcgaccaggtagtcgactgtcgtcgactaaacatagcaaaggattcgattgctttttctatttcttgttaggtccttctttgcataattctaggtctatttgtaacttactgatcttcacggggcttttatgtaaaacaggttatactccaagattctttacatataaatcctgaggctgtaccctcagcttgtcctaaaagaaattattgaggttattcttcataattcaagaaaataacatttgctatgagccttctctcaattttatctgtcaaatgagcaagatccactacctttgaccttgtagttcccattggaagtcctagatatgtaaatgtaatagttcctactacacaccaaaaacaccggctagttgttacacctttttttctagtacatttagagatattaaacttcggcttatgaaaattcagtttgaggccggtggactaagcaaagtatttaataaagcttcaaggaaaaaacaagttcattctgtgaagcccacattaggattatagtatcacgagcatattgaataattgggaatccgcctccattattctcattgatatgtttgcatatcattcccatttgaatgccttgttaacaatgctttggagcaaataaactcccaggacttggagcaaataagctccccggacagtggatttccccgccttactcctcttctacactttaaggagtttggaactccatcgagaagcattgaggtataggcagttataaaaataaaaatgatatataccaattacaaccatttggttggaaaccccatatgcttcataatctctaaaacaacttcatgctcaataatggtgtcaaaggtattttcaaaatccaactttaagattacaatcaaattggttaaaaaaaatgaaactaggccagcacatatggcatgtagctcactataagaaaaaggcctaacacaacttgtatcatgtacatccgcacgagacgagtatgggtgaaatatgtgcccatagttacgtaggtgatttggtggctcgcaatataagcgtggcatctagttaatggaatcttcaatgttccatccaaaaaagtatgcttttggttgaatttcattgctaaatttttgagccttcctagaccactcggtcttcgacaatttctactcaagattctaggcatttcaaaatttgtcatctcattttttttaccgggaatttgtcatctcatttggctagatttcaaaattgcaaacaccaagtgaagtgagcatagctcaattgtttaagttcctaagtggaacctggccactcagtgaaaatatctatgttgacttgattaatcttaaaatataatggtccaatcttcgaatgtactcataaagatttgctaatgatagattaattaggcttaataaattcgtctcgcaattttctagcgatatctataatttgttttattattagactacgtttaatacttcaaatgtataaatgtatatccgtatatccgatgtgacaaccaaacctaaaacttttccctaactaaacgaagcctatatttcgaaaaaaaaaaaacttgcaaacacccatcgtaagtaggccctcccgaaatacttatttcatttctttcctcgataagttttttttttctcgctggcgccaagctcgtcaattcaaaaaattcaaaaataaaaaatccgccctttcgcatccatggccaagaaccccaaggcggccaagaaccgccgccccacgacgcggagacctcgcgccgccgccgccgccgccaccgcctccgcctccgcggacatcgaggacctggcgccgccgtccgggtgcagggcagcagtggggctcaccacggccgccgcggcggtgcgcgcggagctgctgcggtggtacgacgccaaccggcgcgacctgccatggcggcgcgccgcggagccggcggggagcgggagcgggagcgggcgcggcgaggagaagagggcgtacgcggtgtgggtgtcggaggtgatgctgcagcagacgcgggtgcccgtggtggtcgactactactcccggtggatggcccgctggcccaccgtggacagcctcgccgctgccacgcaggaggtgagacaagagaaattatctctcctccaccatcgctggaaaaggaaatgtaaagtttgatgctgtgtgtgggagagtggtaatcgagttcttgatttgtggttgccgccgattgttgcaggaggtgaacgagatgtgggcggggctcgggtattaccggagggctcgatttcttctcgaggtgagtagtgagttgattgatcacgaattcactgtcgaaacgacggggattgggatggggttcacttgttcagtgcgttctgcggaagaatttttcagcttttgacagcgcccacgaaccgtttgatgttttgtctataggagagattttatttggaatccgttttgtgtctgataaaggaggggattattgctactagtttgtgatgtttgctgcattgttttcgctgccaatctcatgtgaagttatcagttcatctggtgaagatttggctagtttgggtggaagaactgacaagaacatcagcagaaatcatcctttttcttcacatttgtattcagtttacaattagcacttcatggtcatagtaagttaaaaatacttaagagtaaagtccatcaccggtccctaaacttgtaccgctgtgtcatcccggtccttaaactctcaaatcgaccgttcaggtccttaaacttgttcgattgtgttatcccggtccctaaacttgcatatcactcgtttaggtcctccaacttgttcagctgtgtcaccccggtccctaaacttggatttgaatatgatctgggtcaaataggatggtctaaagactttacattaaaaataattcataactttttcatgtgaactctaatgaagacaaactttatatgaaacttgtagccatcgacgcaatctacaactttgtagttgatttttttttattttaagtcattttttgtcccaaaatg

SEQ ID NO: 80436 - DNA, 4803 bp, Oryza sativa
tggacatgaggtgattaattgggtatgattggctggtcattggagactatacgatgatcatttttctgaagaacctataacttcctgtttattttagacgcatgtattagtgaatagtattattttttcaatcttgatttgaattggtgatgcacatattaattcttatttctaattattgtgcaggtttagaatgagaagacctcttttttacacataatgattattgttaaagtgcatgatgattattatgtgaaaaaataaaaatatggctggtgtccttggactatcatgtttctaaaaggtaacattagtgttacgtatggatttgataaagaatggcaatgttattatttttattttgtattgatatgtgtgagttaaatgaaaaaaaatattccgtaataaatttgtttttagctccatttatttgtctttataaacggttccttttatttatcttcaaatctatagttttgtgatatatcttattaaatatgtatatttttttataatctgaccaaattacttagggcccctttgaatcaaaggatttatgtagcaattttataggattcaaatcctataggaaatttttctatttggccctttgattcaaaggattgaagctttccaaatcctatgaaattcctatggaatgacacattgcatgtggattttggagaaaatttagcaagagctccaacctcttggaaaatttcctttactctatctctctcatccgattcctacgtttttcctgcgctctaatcaaacgaccattcctgtgttttttctatgttttgcaatactctgttttacactttaattcctgtcagaatcatgtgtttttcctattcctctgttttttcaacactgcgatttaaagaggccatatagttttattaaatttactctaacttgttttttcgtgcgggaatacctctggatgactgatgacgtcagatcacctagaattgtcgataattaatgcggtcccttttcccgtcatgatatgtgaatagtgaaatctcaccgttcggtgaaaagaacatcagtacttcctccgtatcgtaataagtttatttttattttatttatttcaaaataagctcattattaaataatcattacatcggagtttataagaatataaataattatattgtgagaagataaaataaacaaatagttgtaataaaatttgataaaatagggaaaaaataaatttgtttttgaactgaggtattaattctggaagaaggaaatctcctaaagaacattagtattcacacatacctttcactccttgttttctctctttcgatgagtcatgaccgacccgtccttgatcacttaatcatgatacggtgaaaaacatactagtccacacgagttcaagggggagttgttgaatgcttctccgtcttaaaataaaatcatcgttaatcctttgtcctaaaaaagaattaactttggaattatcattccttcaaagtttataaaaacagaaaataaatatattgaaactagataaagtaaagaataattgtatttggatttaacaaataaggggtattttagttttttttaattttgtgttgatataattaggatgaataaaaattaagaatattctgagactgagagtatggagtgaaagggtagcttagctatgaacccatgatcactactagtatttggagattttaggagtactgttatacgtacgattcagctgtataacttactagaaaagtgtccgtgtattgcaatggtaaaaaaaaagaaaaaattgaggaaaagttgagaaagataatgtacattgtgtaattaattgaaataccaattttccggaatatttgggtattttttaagtacgtagtagtataattaaattaatttacaagcaaagtaagcgtgagaaaattaaccatgattaataatagtctttgaaaatttcttggaatttctagaacttaattgctaattttgataatacaaacatcatctttatttaaataaatctaaataaaagtccacatttctcttcgggtcattttccgcccattttcttcttcagcccgcaaccgagcggcatgctttcctctcttctcctcccctccacctcggtccgcaagcaagcgtccagcccaacgtacaagtctaattagtcatcccaactcctcctctcactgtcgtgtgggccccaagcaaaattctagcctaagcgttgtgttagacccgctagcccgcgcgcggtccatcaagcgtgcatggcccagctgatgctggcctgacgtgggatcgatctgagccgtttgtttttgatggatggcttagattggttccaaatcaatcaaaaccaccggtacaaaaaaaacctaaccctaattcattttccctctcccacttcccccaccgtcggctgcctctccctgttgcgccgcctcttcccctctgctgctccctctccgctgcttcccctccgcctcctcccaccggcggcgcctcttcgcctctcctgtcctctccctaacggcggcgcagctccccatctcttctcctcccgtgttgccagcacagcgcgatgacgacaagagtacgacgcggtgcggcgacggcgggggtacggtgcagcgagggcagcaatggacgtccctccccctctccttctccctgtcggccttgatggcggggtatggtgcggtgacggcaacaggcgacgacggcggtgatgccgcttcctagcgaagggccggacggacccgcgctgctcccaccggtggcttaatgctccatgaatccagtatgtgattcgaattgaaatttcccgtccgttctcttttggataactgaaggtgactccgcgtgcaagcgccgacggatgaaaacggatgaaaaatttaggtgacgaatgcaaaattaccgattttttaagaagttaagatatacaactagagatatataatcatagaccaataaaaaagaacatgttcatatgtattgcagccgttgctcaattttaattatatgtgagtcggacaattacctggttttagtttgtcaccgtcagcattactaaagctagtcacaagttgagaagaaaacgacaccctgacgagacagcagcaaaatggcgagaaggctacatgtgtcgcgcgcggagagagagttttccgtttttttgcttttgaggagtcaagtgaggaggacgaggattttgatgaggatgagtgatccactctgtttttcctttttggtgccttgatgccaaagggggagaaccacctatcaaaaaaaaaaaactatcccctttcgtgatggctagtcgaaccttgggcttttgtgtcatgtttaaattctttattatgcatgtttatgtcttgttgaactctataggcttgaatgatgttacgtggaattatatcttatccatgcttaaatgtgtgatatatcttgtcatttgcatatgcatgaggttatattgtcatttctaatctattgcatagattgagggggagctctcctattcatttcaagcatatctttaggggagctccaccaaaatcctaatcttttattatttctaattgtgttgtcatcaataatcaaaaagggagagattgaaagtgcatctagtacccctcatttattttggtgttgatgacaacacaattagaagaaaactaatgctttttgttgagatgaatgcaaggataaaaaaggagtggaacttgagtttaaaagcattgtggcatcttttgtggtaatcgtctttctaaaccatgtatatcttgtgttcttgagagtattaggatgccgtactattaagagggataccacatgcatataattggtagaacactagtgctcaaaatcctttacttgaagtgttcttgaatttatcctgttggactatccgattttgatcagactatccgatgctcagactatccgaaatttcatagaactttgatctctgtctttggtctaagtgttggctaaaaagaattggactatccaatgacctagagactccgaaattcaatggaacttgagtctctgtaagatgatgaaattcttgcttcaaaaataacggaatatctgatatgacatcggactctccgattgatcggattgtccgaaattctccagaattttgtcctctgtctcgggcttgcttgggggtcaaaaaaaacattagactatccgatgtcacctcggaaagtccgaggtgggatgaaaagagtctctcctaacggccactttttgggggatttataaatacccccaccttttctagggttacccaactcattcattctcattcactttgggttgagtttggtgctaaggtgctttggatctttgagctctttctccctctttcaaatacctcctcgttctttgtgtggtggatcttgttggttgtggatttggtgtttgaggacctagtgtgtgtttcactcgatcttgagcactagggtttgaccaagagttgtgtggtgtttgttactcttcgaggtcgaggactcctagacggctaggtgtcactcccgagccaccgatctacgtgtggttggcagggagaagtttgcgaaggccggatcttgcctccacaaggaaagagataccccttagtggaaggaggagtgcttagtacaacctctttaggaaagggttagcaaagacctggctcttagtgaactcctcaacggagagtagaatcccctcaaggatttgaactcctggaacaactccgcgaacttcatcgttggtgatctctctatatcctctctt

SEQ ID NO: 80437 - DNA, 3303 bp, Oryza sativa
atatgacaacctcaaacaacattttcaaatactaaatgatttcaactgaaaagtcattaataaccaagtggtataactcatcaagatctataacttttatttgggtcatttcttcatcccagaaagttatttttaacattggtcacaaatgacatatctcttatataggttattaactaccagagagagatgtaattttttggggaccatggttactgtcattttgtcggatgaagaaattatcaaaataaaagttatagatattgatgagttatacaactttgtagttgatgaatttttcagttgaaatcatttagtatttataaatgttgtttgaagttgtcataatttgaaattcaaattcaaattattgaaacaaagtcatatagcaaaatgaccaaaataaaagtgaagaatcaaattatataatatcgacaattgtttacagtgaagaatcaaatattgtatattgctagaaaaatgcccgtgcattgcaacgggtgatgctagttttatacggtttagctaggatgaaattcactttgggaatttgcttggatatttttttaagaaaataatgaactgtaattaggagtccgactttcttctcatgttagcatgcgagtttttttaaagatatttcttatacgacttctttttatatttccaaaagaaaacgaatttaaaatcgactcaaacaaggatatgtatttccaaaaacaaacaaacttaaaaaccgactcaaatacgaatgacgtaccaaaatacaggcaaaaacatctttaatttttataatagtagagatgatgtcaagaaaaagtatggtacaaaattaaatatctacacaaaactgatgtaaaagttttttgaaaacacaaattaatgatctacacaaaatctatcatccatatataatcttagaataaaaaacacaaattaatgatctacacaaaatctatcatccatatataatcttagaaagaagtgccaatttcaagtcggtaaattagaacattaaagttagaagatgagtatgtgttacaatttgctaattatcacattttccgctctcaataagtatagaaaagacatcgtattcaaattgtattaaagactactccctccgtttttaaatatttgacgccattgacttttctaaacatatttggccgtttgttttattcaaaataatttaaataattatgaattcttttcctatcatttgatttattgttaaataaacttttatgtatatgtatagttttacatatttcacaaaagtttttgaataagatgaatggtcaaacatgtactataaagtcaatggtatcagatatttagaaacagagggagtaattagttactccatccgtcccaaaatgtaaaaacctaaaactgaatgagacgttttcgtactataaaatgtttcatctagtaatagattcttatattttgggacggagttactacaagatatatacttcctccattctcgaataaaattaacgtggacactaatctagtttagactttgattgcctggcttttttttctaaagaaaactataaacacttagaaatatgttatagatatgctatattattgatgtctgtaaaagcttcatgaatatgagcatccatttttcatcactcataatataatcatcagaagtaatttatggtcataatcaattataaaaatttttaaataagtgatggggcagcaaaatcaagttgagttaaaaaaaaacattgacaaccatgggccgttggtatggtagggaaacttttcaaccactagggtggataccgggtgaatatctaccccgtttattacatgccacttaaatggttatagaaaaatgttttagaaaaataacaagatagattaatatgaaatataacacttcataaatataccagttcaacttcagtttcgataagtactagttagagtttaatatgttatttttgttataacttgaagtcgaatttgaactgacatattaattttattaattttgttgagtgatacatttcatattaatatatttttaataatcatttagtagtttacatggaaaaccgggtggacgttcatccggtagattgccgtaggtaacatttcggcataatgatcggcgttaactctataagtactactagtcgaagagccgagcagcgtgcccgctgtcacgctgtggcgacgcgcctctgatcatccgacgagagcattcgtcctctgatcggcctctctcgcacattgcttaattagctacaagctacgaggcggcaatggcagcgccacctcacgatcacggcggccgcctccgcgtcctccgaaccgagcacgtcacgccgtcgtcgaccggcgatgacgccgacgcgctctccgaacgtgctctgccgctcaagcccgtcgagcccgtcgagcgactcttcctctaccgcctcgcccccggcgccgccgtccacggcgtcctgtcccacctcgccgactccttgtcccgcgcgctccgcgccttctacccgctcgccggcggcatccgcctcgcgcccgggaagaccgaccggtacgagctgttctaccagcccggcgacgcggtcgccttcaccgtcgccgagcacgacggcgccggcgtcgacgagcttgccacggacgatcccagggaagttgccacgattgcgccgctagtgccggcgctcccgcggggcggcgcggtgctcgccgtgcaggccaccgtgttgttgggcctgcggccggcggcgccgcgcgttctcgccctcggcgtcaccgtgcaccacgccgcctgcgacggcgcgagctcgacgcacttcctccacacctgggcggcttccgcctgcgccgccgccggaaatgtcccgccggagccaccagtcatggaccacagcttcattgttgaccgcaaggacatccacgacttgttcgccgcgcccagggctcagaaagggttcgattcgcccgacgccatggacaggctcgtcgccacgtacgcgctgtcgtcagcgcagctgcagagcatcaaggacgccgtcgccggcgaggcggcacgccgcggcgtcgtcccgccgcctcggtgcacgtccatcgtcgcgacgtacggcgtcatgtggctgtgccacctccgagctacacatggccacaacaacgacggcggccacgacgacggcggcggccgcgcctacttcctcttcgtcaccgaccaccggcggcggatggagggccgcgtcccaagcaggtacttcggcaactgcgtcggcccgtgctacgcctcgatgccca

SEQ ID NO: 80438 - DNA, 2674 bp, Oryza sativa
ccgccgccatcgacgaggcggtgcacggcgagaccggatactgggagaggtacccagagcgcatcgtcgaggccagaagggacggcgcgccgttctcggtggctgggtcgccgaggttccgcgtgtacgacgtcgacttcgggttcgggacgccagcgaaggtggagatcgcgtccgtggcgaagaccggcgcgatgtcggtggcggagggccgtggcggctccggcggcatcgaggtgggcattgctctgccgccggagcacatggggaggttcaggacgtacctcgccgacgtcatcgcaggtgtgatctgatcagcgtgcttgtagcaaaatgacatctccagcagcagcccctactttagagccctaaagatcaaatgggggctgccactaattctttaggacactaaaaatatcattaactctagcagtagctctcatattttagcccctatttctttttctcttttattttagtataaattgtatgtttgtgtctactttaacatcacaataatttaaacacaaataattctagcacatgaaattcaaccatattgaaaattacaattttaaacaccatgattcaaatttgaattcaaaatttttaacatgaaaatgacatgtcctacaagaaagtattgaacacaaccgatagttgacagaaaatgcaacgaaacaaactatcgagcaccatgaagcgcccacaaatgttccagaagatcatctcgaagttgctcatgtgcctgtcggtcttcaatttctttatgtatctgtagaaacttctctaaccaaatttattgcgtcgttggtactcctctttcctcaacacctcactatcccctgatcataatcgaagtctacatcttcatctcgctcactgtcaatgaacatgttgtgcattattacacaagctgtcattaattatgtaccatagggtctcggtatcccaaaatttagcaggacccctcaccattgcaaagcgggcttgtaaaacaccaaatgctctttcaacatccttcctcactccttcttgaacttttgtgtaatggattctcttgttaccctgtggattggaaatggtcttcacaaaagtggcccaggaaaggtatatgccattagcaagatagtaacccatagtgtatttcttaccattcaccataaactctagctctggagctgtccctgaagtaagcctttgaaagagtggtgatctctgtacgacattgatatcattaagagaacttggtaatccaaagaaggaatgccaaatccacaaatctttagatgcaacagcttcaagaatcatggttggcccatccacatgccctgagtattgccctttccaacctgttgggcaattcttccaccttcaatgcatacagtcagtgcaacctagcatccctggaaaccctcttggagtgttcatagccatcaaccttgcagtgtcatcagctgttggtgccctcaagtattggtcagcaaacacatccaccacagccttgacaaagtgtttgaaagcttctatcatggtgttttttgaaattctcacaacttcatcaagactatcggctggaatatcatatgcaagcatgcgaactgcaccatacaccttttgcaatgcagtggcaccaagaagacccaccgcgtttggtctttgcctaaagtagtcatcatgtgcctccacactagccactatgcgcaaaaagagctcccttgacatcctcctgaacctccttctaaataattttgcactatatataggaggatctgcaaaataatcagccactatgcgcaaattgccagcaaatctgtccctgtaaattatctcttgacccatgactgaaccacgatgcttccttttggttctcttatgctctatgtcagtaagaagagcagctgcaatatagtagtcatcgtcgtcagacgcttcctcctgctcccaccattgagcaaggagatcatcatcatcgtagaaatccatataaaataatcactaccatcacaatattgtaaattaataagaaaatttaatttccactatctcaaataacaaaatagacaattatattcataataatacacagtacggagtatatatttaagactcaaagcctataaaaagaagtgctacataagaccttgtttatatgggactacttttaagtccctatcacatcggatgtttggacactaattataaatattaaacgtagaccattaataaaacccatccgtaatcttggactaattcgcgagacgaatctattgagcctaattaattcatgattagcctatatgatgctacagtaaacattctctaattatggattaattaggcttgaaaaatttatctcgcaaattagctttcatttatataattagttttataagtagtctatatttaatactctaaattaatgtctaaatacatagactaaagttatgtccctggatccaaacacctagtgatccatagcaacgacagttcagtgcagtgctagtagtatgtacagtcccacgatccaatgcagtgctactagtacaagcacagtgtttgagattcttctctaccaccgaagaagtctactactcctacagttctaaaaaaaatatataaaaacaaatcaatgtctaacacaaaaagtggtcaagtataatacttctctgct

SEQ ID NO: 80439 - DNA, 6295 bp, Oryza sativa
ttcctgtaggctaaacatctcttgttccaccccttcccaagctcggttgagctctcagccagcagcagcagcagcaccagttgctcctccttcccctttcccttcctcctctccacgcagcagccccccggaggtgcaccatgtccgacgctcggtctcgccgttcggttgcctcgagcactcggcgtcagcaggacgccgagctcgccgcagcagaagagcgcaggcgagcaacggctcggaccggtgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggtagcagcccacctccatggcggcggcggcggcccaagggaccgcgcgcccgccgacgggaacccaaacgggcgcgagcgtgctggcggtagcccggagcccgcacgcggccctcgcaggcagcacggctctctctcccctgaccggcgccatggtcaccacggcgtccagacggtggtcagggactttggtcccggcggtgggtggcctaccctcaccaaaaccaactacatcgagtgggccgcggtgatgagggtgaggctccaggtgcggcatgtgggaggcagtccggtacggtgacgtcgactacgatgaggatcggcgggcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggtgacgacacctacgacgaggagagagctgtcgagaagctcttccgctgcgtccctgagaagtacaggcagatcgctcgctcgatcgaatctctgttggacctctccacgatgtcgatcgaggaggcgttaggtcgcctcaaggtcgtcgatggtgatgagccacagcctctctcggggcccatcaccatcggcgggaagctccatctcactcgggagcagtgggaggcctctcaaggtgacaggaggaagggggagtcatcttccccgacaggcggccgtaagccgcgcaaggcgcggggaggtgtccagctacggtgggcgcgaagacgtgcccgagggtggcgcccgcagaggtgcccagggcgttgccaccggcaaccacaagccggcacgagacgacgcctgccgcaactgtggcaagcttggccattgggccaaagactgtcaacagccacgacgtggccaggcccacgtcgcacgggtggagaagagccggctctgctcttggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactctagcgtccgaggctccgtcaagttcggggacgcctccggcgtggagatcaagggtgttggctccgtcaccttcaccgccaagtccggtgagcacaggctgctcactggagtctactacatccccgcattgaggaattctatcatcagcgtgggacagctggatgagaacggctcacgcgtgatggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacgaagcagcggcggctcccctttccccagcagacgagcttccgagccaaaaagcggctcgagctcgtgcacgaggacttgtgtggcccagtgacaccggccacaccaggaggacgacgttacttcctactgctcgtcgacgacctctcccgctacatgtgggtgatggtcctcggcagcaagggagaggctgcggacgccatcaggcatgcgcaggctgctgcagaggcagagtgcggccgcaagctgcgcgtgctgcgcaccgacaacggcggcgaattcacagcggctgaattcgcgtcgtactgcgctgatgagggcattcagcgccactacaccacgccgtacagcccgcagcagaacggcgtcgtcgagcggcgcaaccagacggttgtggggatggctcgggccctcctcaagcagagggggatgccggccatcttctggggggaggtggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgctaaggagcttggccacatcggcaagctcgacgacaggagcaccccaggggtgttcatcggctatgcagagggctcgaaggcctaccgcatcctcgacccggagacacagcgtgtgcgcactgcgcgtgacgttgtgttcgatgaagggcgagggtgggtatgggacaaggcggtggacgatggttcgattccgacgtacgacgacttcaccgtcgagtacgtccacttcgagggagctgggggagtaggcagctcttcttcacctagcgtgtctaccctagcccctgaatctccaccgactccaacaccaacacaccctcgggccacgacttcgactacgacgagctcttcgtcgacaccaccccagccagtgactccacatgctccagtaccaacagccactcctccaagcacgtctactctgacgccagctcgtgttgagcgtagcccggtggagttcgctactccgctctcccacgacggggagcgcatcgacgcgtacaacgacggcgagcagctacggtaccgtacgatggaggatcttctcggcgaccagccggtgccgggactggtgcctcgcgacctagaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctaaagagggatgaagccggagccatcatcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcagcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcggaggtcgcggcgttcaaggaggagatgaaggccaccttccagatgagtgatcaggggcctctctccttctacctggggatcgaagtgcacaaggacaactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccaaggtgtcctggcaaggcacacttcgtcgggtacagcgacagcgaccacgccggcgacatcgacaccagcaagagcacgagcgggattctcttcttcctcggcaagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggaacggtggagctcagggtggatagcaagtctgctctagccctggcaaaaaaccccgttttcacgaacggagcaagcacatccgggtgaggtaccacttcatccgaagctacttggaggaagggagcatcaaggcgagctacatcaacaccaaggaccagcttgcggacttgctcaccaaagcctcttgggaggatcaagttcctcgagctctgctccaggatcgggatggcccaactttccccacaagacgacgcacaagacttagggggagaatgttggataagtctttgtggtccttggtcatgattcttctttttgcttttgggtagtttcacctttttcaggacagcatctaccctttagcatatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatatgtatccaacctctctcgggtaggtatgacttttgtgtttagtgaataaagaaaaccagaaaatcgcccccatctcgagtgccatcctcttctcaatgagagtaaccattgaaattctaacagcactacgatttacaagctcaatttacagttccctgatccccattcaagtgcaaaccttatctgtaaatggctgtattttgaacttccatatgataccgttttcccatacagctttttcagaattagaagctttatattgatctgaaaacttccaaattgcatagactttgaacatcatttccttgatcacaggcagctcactggtgaactggtcgacccttctaggccaggagacttcaaccaagcaattatggaactaggagcaacactctgcagaaagacgaagcccggttgctcccagtgccctgtctccaaccactgccaagcactcacactttccaaccaaagtgcttccgtaaaagttacagactacccacgagtggttccaaaagccaagccacggtctgattttgctgctgtttgtgttgttcaaatcaatgataatctctttctattgatcaagaggccagaagagggcctgctcgctgggctctgggagttcccatctgttcttgtgagcgaagagaagactgatgtgctgaataggagaaaagagatggacaaatatttgaagcaggtccttagcatagatgttaaaaggagatccagtgtgatcctcagggaagatgttggccaacatgttcacattttctctcacattcgcctgacgatgtttgttgagctgatgattttgaacctcaaaggtaatcatttgttgtccatactagcagttattcatttttgtttagctacactctattattcattcaggcaaaattggttatatagcatcgaaagttcacgttttttgttttatagcaccgaaagataccggttcactttaatagcacccaaagttcaccatattcccatttttaacacttccgtcaattctcggtcgtttttcgttcgtcttgatcgagccacacacacgatatgacgtttct

SEQ ID NO: 80440 - DNA, 2929 bp, Oryza sativa
atggggaattgaggaaggaactccctccttttcaatacctgggtaggggtggtaattgagagggaatttctcctttgctttgcctaaacaaatctcagccatccattttcattaatgacctaatctccaactaaactccctgtcaatttccaccacctctgccaaacaagatattgggaataaaaaccaaattcccatcttaatctcaccatcaattccctcgtgtaaactcccaatcccattccctcaaggtgccaaacaagccgtagggggcagagagcggcgagcatagggcggcgtgtaggctggcttggagcggtggccctccggcagtgcgaaggcggtggccctccatccgttgggccaatggggcagcgtgggggtgggcagccaccggttctcctgccggcgagcggatagtggcatgcgggcggacagcggtagggacgatggccgtgcagcaggaggaccatggtagtgcggggtggtgtgtggacagcaacgtgcggaccgacggcgggaggtcgtgcgacactgtgtggacggcggactcgtgagggcggcggccggaggaccttgcggatgatgggcgacagaggtaggggaaattctcacctttttgtgccaatcttgccggaggtgcaggggaatcgatggccgctggtgccggagcccagatgagatccagcatcgtggtgccgtgcgggaatgtgacgagagcgtgaaagtgaattgtcgtttggcgccagaaaaatatcgatggggctatgctcggagccccaggactaggggcttgggggtggatctgagggccttattattttgggggctaggtttagggtctttactggatctagttttttatgttaaccctcaaaatttatttagggactgggtttaaggtccctgctggagatgctctaaggaccatttttggttcgaagcctgcaaaataaatgtcctaataagttatctgcactctgaatagtattgctaccaaaattcaccgataccacacatagctgggttgccaaaatattttggcattaccaaaatatacttatgctttggtagccaacattttttacatgcatggtacttagcaagcctaaacaatcgtaagtaccaccactggactttattttctctcgtataatctattataataatggaatagctagattaaatcgtcatgtgggctttaagggactactgggtgattaagagatcttattcaccaatctctaccgcccacccacacgcgaaaattggctcgcccgcccgggacaatcggtgttgtagtagtgggatcagctttttgcaggcggccagcccaaccgcctgagggcaaaggcctgcgaaactagtgtatttccgtaggcgggcaaacggccgcgtaaagagcaaatttaaagaccacaaaaaaacccagaaaattcaaacattcctataagagcatattcaaaaacctcctaatccattcacaaattcatcacaatcctcaaatccattcaacaaatttatcacaatctccaaatccattcaacgaactcatcacaatactcaaattcatttaacaaattcattagatatcatcataaagcagaaaattcatcgtcggtcgaagccctgccgcaacctgagagcccccaccctgacctcctgacgccaccgccggtcaaagccgccaccactcactccttccaccggcgtatccaagcgcccgaggacagccgacggcagatccgcgctcccgaggatggccaacggcagatccatgcacccgaggccagcaggaagcgaatcccattgctattgtccaagcaccgtcattgtcatcgtcgcagccagtcgcagccgtcatcttcgccattgctgccgtcgtcgtggccggtggcggatccaagcattgtgccgttgtcgtcattatcggctggaggcaatggtggggggatagggatggaggtggggaaggagtgtgaggtagtgggagtaggtgcagggagagagagagctgagggagaagaggggatggaggagaggagccatgacctaataggatccccatattttacggacggcttgcaaaaatcatatattcggacgtccgttatgaaaataaatgtttttataggcggatctcttaagactccaaacataaaaattgattttgccaggcgaggctaaatctctatttttgtaaacggttataagagagtatttttttctctccacctgagaaaataaaaatatgttggtaaaaattgtttttctagtagtatgtgatttagagaggttatagataaacatgaaaatattaaatatctaaataatacacctcagtagagggagtgtagtaggaatcacaagcaatatcataatggatgacaaataaaagtttttacttcctctgttctagaaactaacaacatagctaatactatatcagacacaatctactgttatgaatctgaacatttttttaaaaaagagacacataaagtagtaataatttcccaacccagtgaggtggtgttttgatccagggacttaactttagtctctatatttagacactaatttagagtattaaatatagactacttataaaactaattacataaatgaaagctaatttgcgagacaaatttttttaagcctaattaatccataattagagaatgtttattgcagcatcacataggctaatcatagattaattaggctcaatagattcgtctcgccaattagtttaaaattatggatgggttttattaatagtctatatttaatatttataattagtatttaaacatttaataaaaaagttttagtcccatctaaacagggcctcagagacccgagaatgaaaaaccattggcacccaaaaccaccagacagccaatttcactaactttgaggtcaaccg

SEQ ID NO: 80441 - DNA, 718 bp, Oryza sativa
cctgcagccctgaaagaggaagtaattccgagatagtggtactgtgggtgttggttgacatctcaaaacctctccatcagcagtaaccgtgtaggtttcaggatcgacatcaattttcggaagtgcatcgtttagcttcatattcagctttgtcaaaccacgaacgcgacctacagcttccaccctctttcccagcttgtactgcactgcaacgccagcttctttagcagcctgccattaattgttgactgagaaatcagtagatgtcgttggtcaatgacagatatcaatatcggaaagataaatccaggttgtattcggtgagacggtgagtccattgatatctataacacatgtccaacactgtggagctaagccctaggcccacatgttagtgacacaccatgccatatttaaaaagtttttaattttccgctattgtttttatgtacaacgaatttctgggttgtgctgggcagctatacaaatgtatactgatatgttagtgaagcattatgcctacttacaaattatacatccattcttttctagatgatgtttaaaacatcagtaaaatctgacacaaattgtgaaatgtttgatcaattcttttctaatcataaattcataaaaactattaaaatataactaaatcaaagattttctatgacaaatctactaatgtcattttcacatatcaaaattttgatatttttga

SEQ ID NO: 80442 - DNA, 1093 bp, Oryza sativa
ccatgccggcgctagccccttgcctctgctccaccatcgcgggtggcggcatttacaggggtgcagaggtcggccttcatcgagtcgacgacgttcttgcggagcttcatcatgtagagggcctcgtcgatgatcgatcccgttctcagcgttggcgccggccccgagtaaagcatgcgaaggccgccgcggcggacgcgcacgatgttgccgcgcatgatgcggagaggcggcgcgccggccggcaatagcggcgtcgccgccccttctctgtgtctcctctctcacggtgttctctaagttgataaggggcaattttgtctcaacacctagtagaggagagaaaatcttttcgaaaatgaataaaatggtgaaaatagcaaagtggtggtagacgcacgcttcatattggtattttatcgaatcacgttttcggaatggcattctagcgaaaccgtgttttgaacatggcaaaatggccattttttcttccgctcccccccagtcgtcgttacccgccggcccccacgccgccgtctcccggcctgtagccaggtcatcgagctctcagccaccgtctccacccccatggcgaagatcttggcagcacattggcgcctccccacagcagcgctcggcggcgtcacgcatcccgacgagctcaaaggtgagttggtgactagttccgcttgcgatggccagatgtgctagtacgtggggcttctccctcaggccagatccagggcggtgctcccctcggttcaacagctatgttcctttaccagtccttctcttcccctactcctcagacctcaactctctctctctctctaatctccaacccgtaaactaatctcagcaatttttgttttgtgtatgacgagatttggcctttggttgcaaccaaagggggaacacaaatattcctagctataacagaaggtgaagttgtctgttcttcattggttttggttcttggttttttgttgctagattaataccagctcagtttatataatgatatgctagttaagtgggtagacaagaagcgaaatttcaaagtttatatgtagcgattagatcattggttatt

SEQ ID NO: 80443 - DNA, 662 bp, Oryza sativa
cttataatgcactctggtgcggtttagcgctatatatatatatatatatatatatatatatatatatatatatatatatatatatatatatatatataggcaaaatttgctacaggacactcaaaaaatatgtaattagctgtgggacatcataaaaacgtgacttggctttaggacactttaaaaaagatgtaatttgctaaaggatactgaagccattactttattatttcttggatcaaatggagagagcaattttttaaaagacgataatgcccctcagacctctctccttcctcttgtctgcaggtaaaaaagagaaagaaaaagaaacaagccgtcgtttcacatgacccacacaacaacatacaacagtgatgtggtgtcctccatggaggaccaccgtggcgagggcaacgatggcggcattcgcatgatctcctctgatgagctatgcaagcatgtggctgcatcagatcgcctaaaacaccctattgataaattgagaacaacaaaagattttgctaccaatccagctgaggattcgggatggagggagggcacgccaggatggtgttgatgatgaggctggagaggaggaagaggagcctaagctggagcacgacaagcatgagggacattgcatggctggctctgccgca

SEQ ID NO: 80444 - DNA, 20785 bp, Oryza sativa
tagaatgaatatatatttcagaatgagtgaagcccacaatgatataactaactcgagtggtgatcagcataacaataagagcggttgtagttttgatcactaattaataatagtgatacacatgtgtcgtacacaacataatagcatatgtcatacatatgtatatataccattgcataatgacacacgcagatactaataatactaataagcttatttctttcctgtccataccaattagcaatttgcttcaccggtagggatcttggcgtatgcataatccatggcctctcccttgctgtccattgcttggcagtagtacaccgtggctgctgcaaagtagaacagctgctctgcaccagacagcagagcatagacgaccaagaggcatagccccagtaccatgttcttcgtgtacgcagcagcgaccaggttcaccgggctgacagctatcgacaagaggcagatggccaccaccagcacgaggccctccttcctcctcacccgcgtcatcagccgccacgcctgccggagcgcccggatcccgcggcgctccgtgtcgcccaccgacacggcgacgctcaccatgccaacgacgttgaagtagaggaaggcgaggaaacagaggacgaagaggaggacttgcacggagagcaccttgatcaagtagtgccgttgcacttgcatgacggaatagattagaacaccgaggagcgccatgtatgtgacccggagtacggtgaccatggcgatggttatgagaggacccttgagattccccttcatcgccttgcggaggagctccgggagcgagtagcggtcgccggagtaggtggaggaggccgcgaagaagccgacgcactgattgacgaagccaagcaccaaagcgacgagctcgacggcgacgacgacgaggatgagctgtgtaacgtcatgtttcagctcctccaggatcatgcggtactcggcgctggaagggtcggtggtctggagcttgattgcaagttcggccatgtccatggagagtggctggacgaataggacattggtagagaggacaaggaagctaggaagcgcgatcaggaggaagacaggtgtgaagagcttggggttctgagttgggaggactagggcttccttcaggaaggtaaagcatgatgagaagttagcgcttgttctggctgccatagcttacagtctgccacgaagctcgatggatctaccagttgggaggatggattggttattctaatatacaggattgctactaactggactacccaacaagggagacttggaaaattcagtctcaagtcattgttgccttaaattttacgctatgaagacgtggattatcttttgtgctgatagctcaatggctgaataaataaattattatttataataattatgcgaggatgcaacactactgcacaaatgatatttgcaaatggctaaaacctaattttgcaaacggctgggtggtcccacatccgccaacacgtatgtaaaagtcggtatttttccaagcgggcaacacaaccatacgtgaaaacaaattaagtcgcgtgcctaaaataaattgccaaaaaataaaaattccaaaaatcaaaaccctatctcgtagccattacaggatccactatgaggccacttgagtggacaccccaggtaatataccgtcgagtgtccaatatgaccaacacacgtatttggatgtgtgatccatacacgcataaatagccacccaaccttggagagcgctatcgcgcggctagtcgtgcgccacccgacacacacttgctagacgacaaaacaacctcctctagtctctcctctctttacacacacacacactttatatacatactttgtatactctacaaagtttatatatacgtatgtagtatatacatacatatatggcaaaatttgctacgggacacccaaaaaacgtgtaattagctgtgggacatcgtaaaactttgatttagctctaggacactcaaaaaaaggtgtaatttgctagaggacattgaaaccattattttattaattttaggtcaaatggagagagaaacaaccaaaaaagacgagtttgccctttagagccgaattgtttccccatctagcacttgcggcgacaatgtagatggcgctatgcagaggacagatccatggcggagcagtggagactgcatcatgcgtcgatgtccatctcctcgtctcctctcgtcgccggcagattcattgccatccaccacttgctgagccaccgcccccactggaggagctggagaggggctctcggggtgagcagccggccaaaatcctcggccttttgcccccctcaaatctctgacccgagattggaagttgcggcagagccagccatgcaatgtccctcatgcttgtcgtgctccagcttaggctcctcttcctcctctccagcctcatcatcaacaccatcctggcgtgccctccctccatcccgaatcctcagctggattggtagcaaaatcttttgttgttctcaatttatcaatagggtgttttaggcgatctgatgcagccacatgcttgcatagctcatcagaggagatcatgcgaatgccgccatcgttgccctcgccacggtggtcctccatggaggacaccacatcactgttgtatgttgttgtgtgggtcatgtgaaacgacggcttgtttctttttctttctcttttttacctgcagacaagaggaaggagagaggtctgaggggcattatcgtcttttaaaaaattgctctctccatttgatccaagaaataataaagtaatggcttcagtatcctttagcaaattacatcttttttaaagtgtcctaaagccaagtcacgtttttatgatgtcccacagctaattacatattttttgagtgtcctgtagcaaattttgcctatatatatatatatatatatatatatatatatatatatatatatatatatatatatatatatatatagcgctaaaccgcaccagagtgcattataagtaaaacgctccccacctctatcctccccacgcgcccaccctctcccacgcccacgttctttttcccgcgcaacaacctccctccgttccttttttacccaacgccgttccattttctttttttcttttttcgttacgccatattccctccgttccttttttttctccgtttcatttttttcttttttccgcactccgcattccctccgttcctttttttcttgttttttttctctttttttttctcatgcactctgctgttttccttttctttggagtaaaaaatttactaacaaattactttctcacctaatcttcttttagtaaataaactattagctttcagtcacactataactttaccagtaaatcaattactcacgtatacattattatagccaaatatatatatatttcggtgttatctcgagaaagaaattacttccgatagaaaaatctactctggtcttcactcagtaaataatttacttcacagaaaatctgctacatccactcagagaataatttacttcacacaaaatctactacatcccttatcacagtaaattaattattcctcgtaaaatttactcctatcttctttcagtaaatggattactttagaatggccattaatttttctggcttttcctcactcataaaataatgcctcctgccttttccaaataaatagattagttttaatctcgccacaccaacaagattgactctggtattctcttagaaaataaatttctcctagactgctctacccacaaaatttactacaatcttctctcattgaaataagttagtccctgactattagagtaaaatatttaccaacaaatcgatatagccaaaataaattacaaccacatttttgtctagtaaaaaactacagacatgtttacaaagattcagggacacagatacattgattctacaattaacaaaagtagactcgctattcctattgcatcggcagaggacaaatagtagccgatgatgaagcctgcaccggcaaccttagaagttctgatgggcaggacttgttggcagccacagcagattagctacaggtagaaatcgatggagaaggccaatgacggttggcggcagctagctcgtgcacaagcgatccccatcaagagagggatctgaaaaaaaacaatgaaccacaggggcttagaatgcgcacaacaatgaaccatgattacaaaaactaaattcaaacatgatcggtagaaatggtgaagtagtgagacttggatcttatcgacaacaacaatggttcgatccagtagacaatgctaggattttagaaagaagaaaaaatgggatttgtttaccatgctattcttcagctgtgcaaccaagtttgtactcctagcctgcaatcaatgacattgtgcaataattgtatatagaatctcctcttgttccagttccaaattcctcaacattgcacagaccaattgacaactaaaatataaaattcagaccggaaaagtaaggaggtgttgaatgcatcctgcaggaatttcattgtggtgagaaccgagcgttgctcggttggctagcatcgctggtgagcgagcagcccgcacgggttcgatccctgggatcgtcacccgcgcgtctcaccgggatttattcccaaataaataaatttccagctctcccgtgccagcgccacaatagcgcacaagatccttaggtggctttgtgtatctcattagcacgtgtgtgtgtatagttgataggtctagcatgcgtgtaggggtgtgtgtgtgtggagtgcgacgtatgttcagatactacagcttgtactcaaagtggagagctctcaaaaaaaaaaaagaatttcattgtggtcaggcttgttgctagactgctggtaggaagtcagagataaattcatttttttacagtgattgattggttccatatatggactgcacgtcatagctacggcaaataactattcatatattcatattagcatataactaagcaaatgcactatcatgcggaacatattcagacggatggttgtgatggcgtgttgaataaaattacctcttgatagcaccaagcaattttcgattttgaatcaaactaaaaataggtaaaaatcatatctcttcaaagcaccaagcaatttttagttctgaaccaaactaaaacaaggtaaaacgggttgctcttacctggcaacttgatagtcgtgccgaaagagatccttgcaacctgaaattataatccaagtttgtggcaatcttactagcataatagggcgctctctagcacaaagaatcaaaattgcagcaatgttaaatctagatgagagcataatcaaatcgtacaatgtttagaaaactgctcttgtcttttttttttcagtcatgaattggtgtgtgtgaattgtttagaaatctaacagtatatacgggacatatgggagatgtgttcgcaaattcatgtaacgagacagaagcaaattgaagtgtatggcttaatttaacccgtgcaaatcaaagcacagtaaggaagatgcaactagctagacaggggacaaatcgatctacgatggaacatgtatgtatgttatacagcacctgaacgaacacaagcaatcaccacatatccggcgcccgcaaataagctgcaattaactgatcaaacacggcaactatgctttttcaaaaaaacacaacagctatagcctatagatatcgatcgagcagatagatcatggagaaaaataaaacaccagatgaataaaacatcgtgacttccattgaacacatacgagcatccatccatccatcgatccctcaacataccaggtgaatttctttgatgaaagaacatacaaccacgtgaccacctcctcctaccaatccttggcaatcaatcgagtcgagggaagaaaatagacaaggcggcaggggcagttaccagagatgtccaagcaagaagccttaggtgagggccagacctcaccgagccagcggccttgaccgccatcgccaccaccgaccaccgttggggagccatggaggcggccaccatgtcgacgacggggagggggttgcagggcgacgggggccggtggctgagaaccgagcgccccacgaggttggcggagcggcgtcgcggcggcttgggtggagcagatcggcaagggccggcgggaggggggtgggacgagctcgaggcggcgacggcggaagggaagccggtggaggccgtgggcagagaacggcgggcgcccgtcgtcgtcgtggagcctgcttccagatccaggcgggggcaccgagatccgggtagccgagggcgacgacgtcgtcgaggtttctcgatcgatccgtgaaaaccggggtgggacgtggggtggtgggagcgtggatggtcattgttgtgtgtgtggggcctgggggctcggtgggtttttttgggaggggggcatggggaggggggggggttgtttaggatgtgatggggagcatcttagttattacgcatcgtaggtgcggtatagtatatagtgtatatatatatatatatatatatatatatatatatatatatatatatatatatatatatatatatatatatatatgaatgatatctatccatcctgttcttcttgtcttccagtcgaattgctttatcaaccaactcctgaaaatcctcatagtcatgagagatcaacataactgacagctcatcctttaagccttccaaaaacttctcctgcctttcctcgtcagtacgcacatcttctggagcataacgtgccagacgattgaactcatgaagatactctgccacggtacgatccttgtgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagtgttctaccctactaactattcttcaaagacactttggcggcataggttctaagatagattccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtccttaaggtttgaccatttggcttatcctacagtcaacctggctctgataccaacttgtcacgcccgaaaattcactagtaatttccgaactaatttgtgcataaaatcctcgtccaggaatcagccgaggtacacaaactgacaatttaatatacaaatccatcttaataataacgttacatacttacaaaagaaaagaaaacagcagcggaattaacggtctagcgatggcttcagctccactcccacaggcagctcaactggggtataagccaaacgtcttctccttctggatcctttatcttcaactgaggtttgattgattattgcaagaatgagtatatgacatactcaacaagccacacagcaaatatgcaagtgcacaaggataccaaaggatggcataatataggctcatttgcaaaagcagcatttagcaaagagttaagagtagtaaaacagtagagtaattaattaaaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacagctattcgaatagttttactctggccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgctacacaaaagataaagccgttgcccacgctggcttgtggttagcacgataaatgtttcacaacagtagctcgcgaaccggtccttaattgtcatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgatgtcatgatgacctcatcaatggccggaccaagatggcgacctcgccggagattggatggtcggctgcgactttggaggacatgaacacgtagaggacgacgagacgaacccaacggtactcaccctcgaaccaaacgacgaacgacgacggccggcgacgaggtctattggcggcgcggcttcggtcggcggtggcgacggggctccggtgaccggcgacagcggggagagagcggccgggcttctccacacctcggcgcaccttacggcgatgacggcgaccggcggcgacgacggaggcggcggcgcgacgcggatggagctcggccggcgacgacggcggggtggagcacgtggcggcggcgctacgaggcacgggagaccacgggagaggggcaaacgaaagaggaggactagggggtcctatttatagccttggattgaagagatcggactcctcccgcaagaaatcgatccggaaaatcaaaaactcggttttggagataaactcgaaaacgagttcgattcggataagatactcaacgattagctccgatttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgttgagggaggcaaattagacttttcgtcttgggctggctgaaaacaaagcaaagaaagaaagagaagggggaaactcggctgggccgactagggctgcacggctgtgcacacaaaagaggggggatgggccggaaagggcccaagactaggaagaggattattattacttttccaattaaattaatcaatgaaatgatctttgaattgttaaaaatacttccaatgctcaaataattccaagaaaaatcttgaacatacttggacactcaaagtacttaacaaaattataattagaccatttaatgattaatttaatatgtgggtaattactgaaatgctctttgtatgattaaaaattaggaattgagctccgaaaaaatctgagaaaattccagagagtataattaaccatggagaatttaataaaaattaaatccatccatgtcttaaatttaggaaattttatttcccacatttaacttcacttgtaaattaatgaacatttaatataaattctaataataatttattaaataatttataaatcctgaatcaaaaatcagggtgtgacacctaacaacaaaacaacttaaactcaactttacttcacaattcattattacatacataacgaattatatgtttgaatgttatatacctagaaccaaaatctaacaaaaaaaaagttcaaactcagttcaaacttgtttgaacaagtttgaacttattagtaaagaagttaatgttcatatctaaacattttaaaaaatttcatactcattcaaattgggtatatactcaatttaaatcttggagcctatactccatgtagcaccagttaatatatatatatatatatatatatatatatatatatatatatatatatatatatatatatatatatatatatatatatatatatgacagcgctaaaccatacccagggtgcgtaataactaaaacgctcccctcacaacctacccccaccccaccccccacccccacccaccggtagtaacaatctatcagcctatgagtaaatgagttgctaccactctcgcgcactgttgtttttcttccgacgtggaaccataggtaaaagaattactagcagattgttcacgaccaatattctttttgtaaataggttattggtttgtaccatccttctcttagtaaataatttattgccaacttttggagaacatctgatggagttataaagacttataggttatatatgttagcatatttcggtggataaatggtttgtcattgtaacatgaatagcaatactgtattgatacaaccgtatacacatttaacacgactaaaaacattacaacagggtattttgcgcatttcaccatcgtacagtaaaaatattagaaaaagacaatcacaaataaaaagacaatgggaaaaaatctactgatatgagcccagccccttgcacaggctaattacatcattgctgttagttcctttaactaactagagggcatcgccactggaaaagcatctgaatcagaccgcccacctacagttcagttcatgcatttcaggccagattaaggacggcgaacaagacatcattcctgtggcgccatcaccactggcatccatcaggactcgatcacttaactgtatacaatatatcctcctgttccttttcccagcttcctgaacataatacagtgaattcacgaatcaaaagaaaattcagatgggagcaaagaagggggtgctgattgcatcgtgaaaacaacactatatcaatagacctgatcatgcaaccatggttttgatcactgcgaaaaccatgggcgtgaaagaagtgtagaaaagaaagaagaacaggagaaagggagcagaacatatcgacgctggaggtgatgccgggcgaatggaatcgctcatggtgttgtttgtctagaacctgcacacaagcaacaacacagcaccaacaagcgttatcaaaatgaggaaaaagggtttgagcaaggtgaccttgtcctcggtgaacatggaacggggaaggagtatcttgaaggattcggcatccaccaagaaccgacatggcgctgcatcaataaaacgagaacctcccaggcggccattagttcagatgtgaggaaggaaggaggtgcaagctgaccacatgattaagatctagtccaccaccatcgataccaagaacgcctcgctgcctcgaccatgccggaggcgacgcctggatccggcggcgggggatcacaggcacgcgatgaggtggtcgccccctgccgcgccgccgcctaggctgccgcctcctgttcgacgaagctgatgccgaaggtggatggccgggcggacgatggagaggcctcctgatccagttgttgccgctatcgcttagagaggagctgcattgatgtgcgctcgatccgccgccgaggatgtagcccaatcaacgttgccgtcgaggtcgatgccgccgctcgatctgttgaggcagacctccgcatcggcactgccgaggtcctcgtcacatccggcgacgaggagcggaggatgatgcaacaggaagggggcaagggtggcgcctgatggttggatggcgtccaccgtcctgttgccaactcacaactggacgacgcgcctccacacctccaacgccgacaaccagcccggatctcgcccgccgttcgccgatcctaaaaaaaaggggtggacagcgacaggagtagaaggcgatggtggcggcgctttatggacgggggaggtggcggcaccaagggaggcaccgatgtggacggggagggtcatctcggcggcgtcgaagccagctctacctcaaacccccgccgctggatccaggcggaggacgaccgccgtcgccggatccgggcgagggacagccccgccgagcccgtcgcccaccgttggcgcaggccatcgtcgtcgctcgctgctggcgcaggccgtcgccgtcgcccgccgccggaggaagctggagggaccccgccgcctgccgcccagcacaccgaggaggcccaagccggcgaccgcctgccgcacccgcaggccgtaatcgtcgctgccgatccataaaaagtggagatggaggggaaagtgggtgaacggtttctacgagggagagggagggagtaaatatagttagcagatagagttgataggaaaaaatttaggctgggttcgtttggacgttttcccagcgcgcgctacagtgttttgcccccgcgcacgctttttaaactactacacggtgtactttttttgcaaaaagtttctatacaaaagttgcttaaaaaaatcaaattaatctatttttgaaaaaaaaattagctaatacttaattaatcacgtgttaatgaaccgttccgttttccgtgttactgtagcgcgctgggaaaacgtccaaacgaacacagccttactccgttaagcgtaggtgcacgggaggtaggggtgaaaacggggcgggtattacccgcccgcccggccgtattatttcgggacaattttgggtaaaaaatttgggtacccggaagtttctacggatagcgggttcgaatacgggtattttctatcggatatgagatgggattcgggaggacggtatccgacggatacggattatctggtaaaaatacgggtattacccggttatatatccggataatacccagataacatgcctagcccaataaagcactagtggccaaaaggtccactagtacaatgaccaccatcaaccaggaaaccatgcctaacaacccaacaaccaaaaatactaattactgttcagtgttcactaatcccactaagcaatgacgccgagactacgagcgccactggtgctacggtgcagcacccgtcgcgccaccacctgctgcatccgttgagctgcggccaccgccgctacatgcctttgctgccagctgatcctcatctctttaggaacaggaagtcagcagctcatcacaagtcaggccgagtttagttccaaactttttctttaaacttccaatttttctatcgtataaaactttactacatacacatacttctaacttttccatcacatcgtttcaatttcaaccaaactttcaatttttccagttaaaaatcgattgttccttgtcgtattgctcgtatatcttaaaccctaataatatagtcacattatggatatatggggatggttgaatatatagctattgtctatatagtatagatgatcgttgctttgacgtgatacccgaaaagatatttgtaaccgatagtggtcgtatccatctaggtacgtattcgtctcatatttgtgcccgatattatccgtgcttgtatccgtattcgatactatccgtatccaacccgattccgattataaaatgtgggttaggatatgggaagagtgagatctgaccgaacccgacccgatttcacccctaacgggaggggatttgattgggggggtgttgcatggggggtggggaggggtgggggtagggtgtgagggggtagggtgtgtggggaagggtgggggtatactgatctaaagcagtcttcaagaaacccactaagatttgaaacctgcattaccccgggtacctgggcttctgtccgagacagctgggtcacgccagctagcccttggtggaactcgggctgcctgaaatagcggcacggttctgcttttgcccgtttagctaaatcaggtggagcgggcatgtttgacactcgtccaagacggcaccggtggtaatgactcagcgctagaatggttggggctccccataaacctgtttcatttataaaagagaggactgcttcacaacagcctgtgtagcacgcccatcaccccaactggccctgaggtcgcgccctcgcgctttttgtcatgattcatctattctcagacgagcttctcgaagatgtctttgatgagtagataatgtagttattttgtatgtttcgacactcttctttgtagaagaatgcaaaaactacaaggactaaggcgtgcctggattccaggacgaggctggaatcgaggaagaccttggtttataccttctaatcatatgcctccaccctccactccttgcaaaaagtgtgacttatgaggactaaggtgagctcgggatctagaatatggtcgagtctgaggcagaccttagtctacttcttaagatgtagatcttatatgtctctacgcttctcttactgagtagcgtaggtcttataaggactaaggtgagcccgggacccaggacaagaccgggtccagggcagaccttatgttacattcttaagacatagattttatatatctcaacactcctcttcacaaagcagtgtgtaactagacgagctaactaagctcgagacccagagcaatgccaggttcgaggcggaccttgtgctacatacttatcccataagaagatgaaggtgggcacggtacccaccaagataggacccctagccgcactagtctgggtgtagctttttatttttaagaatggtttgagcatgccatttattttatttgtaattgttttgccggggaaatgggtatagttggccataaggccggaggcccgatggcccggcccacggcacgggattttggcccggcccaagcatggcacggcctggtagcagtcgggcccgtccttgggcctatggctaggcacggtgggctggcccggcacggcacggaccgaggttggcacgatgggccggcccggcacggcacggcccaacggtcggcacgaccacggctcgcaccaacggtaggcacgagcacggcccagcccaacagacagaggcaggccatggcgccgcaccgcgcgcgcccccatatataagcggcgtcccctccccagcccaccctcgctctccgccactccaccctaacccaaaccctagccgccacgccagcggcggcgcggccactgctcagccacctccgccgcagcgccgctccgcctccaccgctcccccgcccaccagttctcctcctccaccgtccgccgctccgcctccgccgatcaggcgctcaccgacaccgagtcgcctcccttccactcttccagatccagccttcctcttcgtctccgatcgatgcctcgcctgacttgcacgaggggcgcatgaggtccactggccatgcatggtcgcctgagtcgccttccttccactcttccagatccatccttcctcttcgtatctttcccttttgttcttctttgtcagatcccttggtcttctcgtggattcgtgagcctatcgtcttcaacggcaactccggtgctccggctgcgcaggtacaagcatgaaacccatccttttttatctttcttccttctccatttccgagccctaactttgagtgtgcttggctgcttgcaggtcgcaagctcgttgcttagcggcagccgccgttgagggaacgtagtgcccgcgatggacgacgatcctagctcaatcaactacgagttgaggactatgtgcgcggtgatgatgattatgatgtggaggaggatcgtgtggaggtgtacggcaatacctctgacagcccgatccgtgtgaatatcgacgacgacaacccaccggttggcggcagtggcaatgggacaccgactggctctagtgccactgctaccaacaagaagaccaaaacctccatggtatgggatgactttgaggaattttatgaaacgaccaatggtaatagggttcgtatatcaagtctctgctaaatgcaattactgtcataaaactttgagtgctcgttcttctgctggcactggacatttgcttaggcatattaagtcatgcaaacctagaaggcttgggtctaatgctttgcctcagtccatgcttagatttaatgcagatggttctgttattccatgggaatatagtcctgaagttgctagggttgaattgtgtagattgatttctagagaggatcttccaatttgttttggtcaatctcctacttttgtgaactatattaaggctgctcataaccctagatttgtttatgtctctagacaaactactaccatagattttcataagttgtttaatgatcgtcgttctattattgttgagcgtctcaagtctgctagctctattgctttgacatctgatatatggtctggtcatgctaaggaagattatttgagtgttgttgctcattttgttaattttgattggcaattagagaagagggtcttgggtcttaggcgcattgatgtgtcacatactagtgctaatattgctgagcatgtgattgcagttgctgaagattatggtatactgataaggttttctctattacattagacaatgcttctgctaattctaaagcaatggaaacccttactcctgctctgtctggttatgttgctgatttatttttgcatcaacgctgtgcgtgtcatatcatcaatttaatagttaaggctggacttgacaagttcaagcccatgctaagtgacattagagctgctatttcattcttgaatgcatctaatcagcgcatagctacatataaaaatgtttgcattgttgcgggttatcatcctcgtatgtttgattgggacatggatgttagatggaattcaacttatataatgcttaagcatctcataccacatagggaaccattcacagtgtttattagtacgcaacatccttttgttaatggccatccattactcacaaacttacattgggcatgtgctgaatctgttttatgtttccttgaacagttttataattcaactgttgttttgtctggtgtttattatccaacatctccattaatcatgcatcacattttagaggttgctggacatctaaacacttatggcaatgttgaaaaccttgcaaatgctggtggtcccatgaaagataagttcatgaactactggtctaaaattccaattctttattcatttgcatttatcttggatcctagggccaagatcagggggtttagtaaagtgcttcagattatggctcaactcattggtgatgattactctgcttatttaactactgttagggctgcattgtctgatacttttgctaagtatgaaagtaagtttggttctgttagattgcatagttccagtattccaggcccttccactggtaagaaaaggactacatgggggaagatttttggttctgttgctgctggtgccagtccaggtgttgggcttggtgctggtgctagtctaggtcctgggcttggtgctggtgccagtccaggtactgggctcggtgctggttcattatctaggatgacatctactactgctttgcttcagacagcttcttcaactactaatctcaatgcttctgaactgtctgcatatcttgacagtgacacagtcaaccaatatgatgatgacttcaatatccttagctggtggcaacagcacaaacaaacttatcctgttctttcaatcttagctaaagatgttatgactgttcttgtttctactatatcgtccgagtctacttttagcttaactagcaggattatcgaggaccgtcggcggcgtctaaaccctaggctggtggaaattctggtagtgctcaaggactgggagctagcagatgcaaaaggtcagcatactactgagaatgtggagcttcaaaatgcttatgagaatatgtatcttgatgatgaaattgatgtaaacccttgaactaaatgattgtaattgatgtgaacattttagctgtgggctgtactcttttcctttctagggttttctcacgaggtgtgagtttttacctagaaaggtttttaatgaggcagccattgcactaaggagcttatataaaccccttttatattctgactttctgagttctgtttgtgattctgtgattctgtaattctgagatggacttgatgaagcatagtagatgacttgatgactttgatgaattgatttgaaatgattgtaaatctgtgacttgatgaagtgaagtgattgtaaatttatttgatgaagtgattgtaagtttgttgaatggttgatatatttgatgaagtggttgtcaatttgatgaattacatgtgaatttcatgaatttgatgtgttatgacaattttttgtattgaattgaactgttgaaggggttttttttgccagggcgtgcctgggccggcatgggcacgatgggctggccgggccgtcgggctagcccggcacggcccgaggctactagggccgtgcctgggctgtggccgtagcccgtgggctggcacggcttgttcgttgggccgtgccagcccgactgacctcagcccaggcccgatcgtgcttgggccatgccatgctgggcggcccatatggccaactatagaaatgggtaccctggttgtaatttcaccaacaatatacaatatatatgtataatttttatatgtattttttatgtataataatatacacgtacataaagtttgtatacgtatgtgtacaatatatatgtacatatttaaaaaaattggaataaaacaagaaaacacgtatacaaactttgtatatatacttatacaaaatttgtatacacgtatattaaaaactgaaaaaaaaaccgtaaaaaaaagaacaaaaaccaaggaaaaactgaaagaaaccaagaaaacaaaaaaagggaaaaaaaacgccacgtgtcgtcaccgcagcgttccgtggcgccatgtggttgcgtcgcacagggggaggcatgcaaccatctgccaaatatctttttcactcatcctcagtgtatccacaatcacggttgacacctttcaatatactaaccacgatgccgcatggtgagtaagagagacattcgatggaatagcttgtctgtcaacttcaacctaatacatgcttgtcaaacaattcgaaggtggcaaacaaatgtgttgcatatctaaggagacttgaccaaaatactacatttcactattatctcaattactcagaaaccttactcacgcttagctagtccccagcaaaagcgaccagcctcgtactttcatcgcaagcaattgttaaacatttttttctgaacgactcgcacgagaaggtgcgaagttccattgatagagcaggaaaaaattacaagattacaaccctggagggtcgtaaccaggaaaaaggaaaaaatataccacgacccacacaccgacatcgccaacacacaagcccaggataagactagcaccagaccggccgctgctaagcatgaccgaccgccactaggggacacagacaagatcacctcctagggatgccaaaacgacgtctttaagaagagaagtgacagaaaaactgccgccatcgtccgtcgggactcaaaggagccaagactggactttcgcccggcaaccaccctcgaggggtgagagagcacgacaacgccctcaggagggggaatgaaccatcgttgtcaatccggccgaggccggactaggttttcacctgccactcaccacctgcgaatccacggctgacgcaccgatgctccaccaccacacaagctctgccgacatgtgggacccctgcaccggcatcccccgctggccagccttcgtgcgccgaagaccacaccacacccaccggcagctcctcctcacacctaggtcgcctcctccactgccggccacgcctctcgtgccaagccggcctcctccaccaagacgcgcctctcgcgccaacccggcctcccccatcggccgcgcctcttgaacgcgctgatgacgcctagagggggggtgaataggctgtccctaaaaacataa

SEQ ID NO: 80445 - DNA, 1396 bp, Oryza sativa
cgggactacagatattttcccactatttccaaattctttttacacccggttatggttaagaaccgggactaaagataatagcactgaatattgaatttcgttgcatatgtgtttctaaaatagtaaataatacattattgttgtctgtagtaaattaagtggataatatataataagcacgtgaatgatttaaaattgttaaaaattctaataatcatatataattagcatatgcatgatattaaattgttaaaaattctaattaacctatgtaaataccacatgcatgatttaaaattaataaaaattctaataatcatatataattagcatatgcatgatattaaattgttaaaaattctaattaacctatgtaaataccatatgcatgatttaaaacttttaaaaattctaataatcatatataattagcatatgcatgatattaaattgttaaaaattctaattaacatatgtaaataccacatgcatgatttaaaacttttaaaaattctaataattatatatacctagcatatgcatgatttaaatttgttaataatcatatataactagcatattcaatacatccaaaatagtttacaacaattacggcaatacatcggcggtgacggttgtccgcacgtactttctcctcactattgttccttccttgtgatcgctacgtgagtaaggggtatcttcatttgataggaggatgctagggtcaatcgtcaccgtgaaagggggttgcccatcaaactgatcgtaatcctcgtcagtcttgtcctttactccgacgatttttcttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtcatcccactatcatcaatcgttatgcctccaccagtcaacctaacccattggcaccggaacagagggaccttgagaggtccatagtcaagttcccatatctccttgatggcaccgtaatacgtgccagttgtaccatcgtgtcccatggcatcgatacgaacaacactgttctggttcatgctcttaatttatcccttaatttatgcctagaataattaaaatccttgtgaaagcctccaacaattaaaatgtgcaaagttaaaagtcaaataaggcttggaggatttttgtaaatttcctaaaagcctaaaatgcgtaaataaattttagtggaattttcagacacaaataataattattaagaaataaacaaagttaaaatgattttataaaaagaaaaaccctaaaagtcccccttccctcccttgg

SEQ ID NO: 80446 - DNA, 14694 bp, Oryza sativa
atcactgttttatctagccatgcttatgtacttttgttatgaccttattattgttattgttattatggccttgttcaccttagaataaacaaaaccccaactagtggacactctactcatggtaccactagtatgattttaggtagatgcttcgctggttaattaggcaacattaggtggttttataactctagactttgggaatattttcatcacctggacactatagaatggttggattattgtggaattggattcacacctccccctctattcaaaacccttaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggatatctctagggcaaatgaaggctacacgagctacggcccggtagtcgagatgtgatggcacagggccggtgtcctgctgctaggggctccgtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaactactaaaatgtggaatggttggcctgggttggcttgggacgagctgggacccagggtcgggttgccagttcggtctgaatcatcgtaggccttgggttaaggcaggttcgtgtgggttcacggccttggttaataatattgtatagctctaggaccgtgtttacaaaatagctttgagcaactaagtgtcttttaatgctgtttactgcaaaccctaaccccctatattatggctcccttgtactcccttgcatttattctgcacttatggatgtgtcttgttgagtacggtggttgtactcagtcttgctcaatttttcccacacccagaagaggagcccctggatgatgaaggctttggtgtctagctcgtgcctgccgtcaagcgcctgtggtcgtcgccctagtcttccgctgtttttcgtttgtcttcttgtgtgctgggtcttcgccgcccatgtaataaattaattaattacgcttccgcttgataaactctgaaatgtatcaacttttggtgtaccttgcctcctgggacaaggaataatacacgcacgtaaggaacgcccgttgggttatttccggtcgtgacaggacccctcgccaggaaggccagttgctggttaatcgtctcgttacccatgagatgttgtcgcagccatgcggggaaagtatcaatgtgatgtcgtgtaatccatgcatcggacttaccgatgtttctggcgcgaactagagccaagtgctcctcgatgtaaggagccaccaatgaagattcttgtaaaaccgtgaaatgggctttacggaataaattgttgtctaccgtcattattgctttccttccgagagtcctctttccctgtagtctcccttcatggcgtgattcaagtaccccgattaggcgaaggtcttcaataaattctacgcaaaattcaatgacctcctctgttccataccccttggcgatgcttgcctctagatgagcacggttacgaacatacttcttcagaacgcccatgtacctctcgaaaggaaacatgttgtgtatgaacacaggcccgagaataccgatctctttgactaggtgacaaagcagatgcgtcattatattgaagaatgaaggtggaaatatcaactcaaagctgacaagacattgcaccacatcattctgaagggcttctaacctatccggatcgatgaccttctgcaaaattgtgttcatgaaagaacatagctttgttattgttgcccggacattgtctgggaggataccccttattataactggtagcagttgtgtcatcaacatgtgacagtcatgagactttaggtttgtgaacttcttctccttcgtgcttattactcgctttatattcgtggagtatccagatggtaccttgatgctctccaagcattgaaacatactttccttctctgccttgctaagagtgtagctggctggactcaagtaatggctgcctttctcctttggttctgggtgaaggtcgccgcgttgttccatatgcttcagatcattacgtgcttccagtgtatctttcgactttccatatacacctaggaagtcaagaaggtttacgcaaaggttcttagtgaggtgcatcacgtcgattgcgttgcggacgtccaagaattccgaatagggtaactcccaaaatatggagttttttttccacatcgccgcgtgaccatcttcgctctctataggctggctgccaggcccctttccaaacactactttaagatctttcaccatagcaaacattgttttcccgctgcgatgtttggccttcgtacggtggtccgccttatgttcaaagtgcttgcctttcttccgtactgggtggtttgcagcaagaaatcgacgatgacccatgtacacaaccttcctacagtgcttaagatacgtactttctgtttcatccatacagtgagtgcaagccttgtaccccttgttggactgtccggataggttgctatgtgtaggccaatcgttgatggttacaaacagcagcgctcgtaagttaaactcctcctgtttgtcttcgtcccacacggggacaccttccttctttcacaacagtctaagatcttcgaccagtggtcttaggaacacatcgatgtcgttaccaggttgcttggggccttgaataataatcggcatcattatgtacttcctcttcatgcatagccaaggggggaggttatagatacacatcgtaacgggccaagtgctatggccgctactcatctctccaaaaggattcatgccatccgtacttaaaccaaaccgtatgtttcgtgcgtcctttccaaagtctttaaattttctgtcgatgtttcgccattgcgaaccatctgcggggtgtctcaacatcccgtcctgttgacgttcttcagcgtgccaacgcatcattctagcattccccttgttcctgaacaaacgccttagccatggtattatagggaaataccacatcaccttagcaggaattctcttcttcgttagctgcccgtcaacctcacctggatcatctcgtctaatcttgtatcgtagtgctttacaaacagggcatgcttctaggtctcgtactcctcaccacgatataggatacaatcattcggacatgcgtgaatcttctgaacttccagtcctagagggcagactatgttcttagcctcgtacgttgtctcgggcaatttgtttccctccggaagaatgttcttgacgagtttcaataaattgccaaatgccttgtcactaacaccattttttgccttccattgcaagaactccagagtggtatccaactttttgtgcccctactcgcaacctgggtacaacatcttgtccaatttatgggcccccttttcactttcgcagtcctccttggcatcctgcaacatctgaccaagatcatccgcaacgtcgttataatcagcatctctatcctcctcgcccgtttgatttccttcaaatctagcgtactgagcaaagtctagaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattgcatggacaacatttaaaactcttctgcttgttagtttcggccactctcaagaaataatgcacgccgtcaataaactctttggaccgccggtcagcgtacatccattgccgatccatctacatgaaatgaaaaaaaaatcgtacacaaataatcattcgtacaataatgacagtcatacaataatgataaaataatcacaaactctttcaacagtcatacaataatgacatcattattcatgcaaaaattataaaatattccaccaaaaaattcttatttattatttttgaagttttaaattcttttaattttcaatttagtttgttttcttttatttaagattaactttcactatattttcctactcaactattttataaaaccttatttagcaaataaacaaaatttctatatattctttcttttcccacacaaattttctctctcatcaacttattacaacaaaattttggagacaaaaaagtgtgcaaaacatagctccaaatgtaatatgaccaaaaaaacattggatgatggagttgctaaccttttaggcacctccgatttgtatataatcaccaaagtaaattcactataaattttagcatgacctcccctcttttttgaagaaattttgaagcttgctcgggctggaggaggaagaagacatatataaaggggtgggactcaccgggatctttagtcccggttggtaacgatctttagtaccggttggtaacaccaaccgggactaaagatcccgggagggcataacaagccctgacagcatttgaaccgggactaaagatgaccaaccgggactaaagatcaaatatgcccgttaccctttttattgcaaccgggactattgtggaaataggccgaccgacgaaagatggtttctccaccagtgctactcaaagtaggtgtaaaactcctagttcaactaggactcaatctacaaattccaaaccaaatacaatttaccaaaatttgcagccacaaccacagtcggactctcctcgccgtcccagcagcaacacatcctcctgttctcctgagccaagtcggcttgccacagccccaagccaacctttcagattaacacacatgcaagcagtcacatgcacatgtacatgcatccatatacatgcatacacgccacaatgtggagaaagctacgcatcggacgtccggagatttgcaatctccggacgatgtttcactggaggttaaatgaatgttgcaatgtctcatcgctcgaaaaaaaatgtttcaccatgaaatctctggacgatgtttcacagtttgttgaataaatgttgcaatgtttcaccactcggaaaaaaaatgtttcaacaggaattgtttgttgatgtttcatcgctcgaaaaaaaatgtttcaccgcattatcgaagatgtttcaatcgaatgcaacactcgataatgttgtctgcaacaaaaaaaaccaatatatgcaacatccgaagaaaccaaatacaacatccattaccgatttaagaaacatccagagaaaaaacagattgcaacatcacaaacacactatatgcaacaaaataaacatgtagtgtgcaacaatcctcgctaactagttagacgttgccacaagcctcctcaccttcatcgccgagctcagaaccctctcaggtgatggcgtctcaagcttttccgtcgtgctgccccgttgccgccaacgtggttgccggtgctcaccgcaccctaccgctggaactgctgcaccggccgccgctcaagcgcatggtagtcctcgccggcgacgagcaccaccccacgcttcctccctctcttccatctgtcgtcgccatcgacgccacccggaacacagccaccgtgcctgccacacgatgccgctgacgaacatcactggtggcgccataatctggccacccgcacaggaagccccgccgtcggcggcggcagcggcgcctgcgccccctgatgacgccgcggccgcgtgtgcagcatggagagttggagacgccgaggagaagaagttgaacgagaggttggggatgagaaggaatgaggataagattggggaaaggtgggtcccgtcgactgtccggagtttgtcttgtatcggacgctcgatacaaagcgttttcgcatacatgcacaatacagtaacaccgctacagtacctagagtactgtagaactatatacttatgctccaatttctcaaccaatctcctccgtgaacaccgacgcttgcacgtacaccttgtgaagcccgttgcgaagatcactcccacacggtgtccatccactgtgtgccatctcgtatccaacttcatcacccggtatccttaaccgtctggacctcaactcctccctgagtctagtcccgatccccaccgttgaccgaagttgacctccaagaatcctgactctagtcgccttctcacatggtatcccgaccgtactagacctctgctccaccctgagtatagtcctggtcctcaccattgaccaaggttgacctcaagttacctgtacacaatcagataaaacaactgttcctgagcacaaatatcacaacctgacccacattagtcacacgcactcccaccaacatccacaaatcttttaaaaccaattcattgattaaatcatttacaaaaccaattgttcatcataaatattaatcatgacaatgatttcacaaccgtcgttgtcaggtccttccgcctcgaccgctgtcttcatcaagctccaccagacgtcggcatccccatccgcctctactgccgcccgggggatagacccacgtcttcaccgcctctccgcctgcctcctccctcgtggcaggcaagacgccgctggcccgtcgtctctggcgcgggccgacacctcgccaccaggatctgcaccattgtcgccgcttgcggcctcgacgccctccgccggtcagcccctacgcatccgcgtctgtcttgcctctcgctccctgtattgtctggttgtccgtcactttgctagtcatcttgcacgtgattagcaagggagaggagagagagacaagatggttgcagagagtttgttggctggctggctatggacttgtggagggaatgcatgtgtcgctgctgctggtacagttgggcagagaggttgctggacgtggacttggtctatggaccatgtgtgagtgggtaagcttgcaactgatgctgttctgctgctgcatgtatctgtttttttttcccgattagagatcgagtttgcgtcgcccactgcctcgtcgacatctatgtgtctccgacatcggcatcgactctgcttcgatttcatcgttcagccctgcgcatcttcggcttgatcacccgttcaggtgcccggctacaacgacttctgtaaccaatcgttatcgagcatgcgtctacgccatcaatcttcgggttgccgctgcgttgcccccttgggctgcagtgccgccgcccgtggtccacctccactggttgttggaacacggagaggcgccctcctcagcgtggcctcactaccggtggagttctcgccgctatatcgacatcgggccgcacctgtgtcgccccttcgggtcacagcgtcacccctctcgtcgtcttcatcgccgttcatgcatcgacatcctcgtcgtccgcattggtcatctctagccgtcgggttcttcttcatctactttgagcattactgccgcatctccaagttgccaccgtcgccgctctaggccggtggtccagctacctctacatggctatcgacgttgccatccaggccgttggtcctgctacatcgccttctacttcgtccagcatgattcatcgccagcgtcgccgtatcttccttgactgcacttcgctcttctccgacaaccgcgtgctgctccagcaattctccctctacgccgttctcgtgccacaaccgtcttggaggcttctctgctagtctcctccaacattggcgtatgattcatggtggtcccctgcctcgcctgcacggtattagcaacaccggcgcgcgcattcgtcttgagttatcccggggtttggcaaaccctgtgtgatgtctcgtccttcacggttcgactacatcggctcttcagcatcatcttcctcaacgattgccacgatcatgtcaccgcgttcgtcttcagctcgtcctcgtgcaccttggtccatgacaccctctcgagagtccacgaccattctacagtgtcccatgcgcgccctgcggcacggctacctcgacatcctcgattccccgacttcagctacatcgaccacggctccctcgcacccttcgctttggctacatcgactacggcacaaaagggctatcgtcgatattgagcactctcgccggtttcttctctagtccaagtgtccgcctagtccaagtgtccgcgctgctcacgcttggactgcggggggatgttagagtatatagtagttagagtcatattagaataggattgatttgtgtggactccttccatatctgtaatcattccttatctcctccccatgtaatcctatatataccgcccccctgaggctcaatacaacgtgtcaaatattcaaagtattcctcactccctatactatccaacacatattttgttggatatggcgatccaattttttggtcggtttgtatggatatggtgatccaatttcttgtttggttggagggatatagcatggatgggaaaagccataagttggtgacccatttgtcatatatattttttaatcaaaatataatcatccgagatcttgttttaaacatttaattgtaacaaatataacggtgtaataaaatcataaattagataaacggtttaggagaaagatcatttggagcttgcttaacagaaaatcaagccaccacacccaatcagaataggacacgtcacctagaccaaaactggatggcttcatccagcaaaatcggccggatgcactcatccagcatattgagggaatattcccaattccgggccaccccattcaccctgccctccaaccaaacaccacaaaaaatcgggcggccatctcccatctagactcatccacccaaccaaacacaccctaatacgctcacgtcctctccaaactccatctatatttcggctatataaatctccatcaagcaatgtatatttgaatggtagccacttaatcttgtcgcgtcccaaatcgactctaaaattcatcctcaaaattgtgcaatagaataattaaaattcgatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataagcaaagttaaaaaggtttataaaaagaaaaaccctaaaagaagttcttttcccccccctttttccctcttgggccggctcggcccatttccctctccctctctctctcctctcccgcggcccatcggctcccccgcgcgcgcgcgccgctgacaggcgggcccgcccgccactctcgctgacgggtggggcccacctgtcatctccctcctcccgccgcgtccgtcgccgcccgtgccctagcgccgccgccgccgccgaatccgccgcattccgccttccccgcgcgccttaatgaggggggaattattccccgcaatcccctctcccgattccccctctttcccctctctctctccctcggattcgctcggaatcaatcccgcaaacctcgccggcatattcaatggcggccgagatctccgcgcccgtttcctctctctccggccgccctctctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctcccgactcggcgacccctccatccgcttcgccgtgttgccgccgaccccgtccgccggtgcggttcgcccgccgaccgtcggagcgccgtcgtcatcgttttcccgagccgcgccgccgtcttcttccgctccggacgccgttttcgtcgacgtcgttgtaccggggtgaaccgtggaccatccccttcgtttcccccttccctcctctttctcgggcgccgctccgccgcgccggtggtcgctgtcggtgaccatcggggtgcgggtgcgcgccgctcccgtcggccgtgccggcgaggccgccctcgggcgcgccctcgcggctgccaagtgggcccggccgtcagccgcccgcgcccgcgggtgcggctgacggcgggacccacggcgccgaccgccgccagccgcgtgcgcccggtccaccgtggaccgagcggctgacgcgtgggccccacctcccgtggacccggtccgcgcgcccgcccctcggctgacgcaataaatgggatttttaattgaaaattaaatgaagaaattcgcaaatatccatttaaagagcatataaacttcaaacggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcagaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctattcacctttgttatgaccatattattatcgttattgttattattattaccttgttcaccctaggcaaacaaaacctcaactagtggactctctactcaagacaccactagtttaattctaggtagatgcttcgcaatttaattaggtaaccttaggtggttttacaactttagacttgggaattatttcatatcacctggacactctggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgtgaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggatatgggcaagccgagcaatgtacccaagtcagtgttataattcttaaaatttgctcaacaactaaaatgtggaatggttggcctggggttggcttggacgaactgggccccagggtcgggttgcagttcgggtctgatcatcatagccctggggttaggcaaggttcgtgtgggttcccgcccttgattaataatactgtttagttctaggatcgtgtttccaaaatggccttgagcaactaaatgtctttaaatcttgttactgcaacccttaccctttatgtataattccctcgtactccatggcatttattctgcatttgtgggtgtgtcttgttgagtacggtggttgtactcagtcttgcttaattttcccaagcccagatgaggagttccctgaagatgaaggcttcggtgtctagctcgtgcctgccgtcaagcgcctgtggtcgtcgccctagtcttccgctgtttttcgttgtctctgagtgtgctgggccttcgtcgcccatgtaataattttatatacgcttccgcttgttaaactctgtattgtatcaacttttggtgtaccatgcctcatgggacaaggaataatacacgcacgtcaggaacgcccgttgggtgatttccggtcgtgacaaatcttccgatcaactttaagtgtaggatctttcaaatatttaatcaaaggaattctccaatcctcttttgttttctgggcgcaaatgtctgaatttacaattaatttggctttgaatcaattgcggcgtgccccccagcgctctatccagaactggtcagaccggctatgcaaggccggtcagaccgcccctggtcaccggtcagaccagccgtgcaacgccagtcagaccacccctggtttgtgattttgccaatttcacacaaaggtttaaaatcgagcaccggctcttccaatatcaaaaatactcctttcttcacattatagctagatgcatgttgtgccaaatcatttgctatagaattatcatgcctagcaatatgtctaatagcaaaattatcaaaattggcaataatatcgaaacatgaatcaagatacctatttagtgatccgtccaagcaattgtaaactccggcaacttgttgcaccaccaattccgaatcaccaaaagcttccacgtgtttagctccaaccaactttatcacttgtaagctgaataataaagcattgtattcggcttgattatttgtacaataatactccaaacgaaccgatgcctcataacacatgccattaggtgaaaacaaaactacccctatgccttgaccttctttgcaagaaccataaaaataaatattccaaggtataacttcaactaagcaaacctcttcctcataagcaatatctacaggatggtctactataaaatcaactacaatttggcctctcatatatttcaatggttcataagccaaatcatattcaatcaaagtgtatgcccacttgccaattctcccacttagaattggcctttgcaacatgtgtttaataacatcagcttgacaaacaactatgcatgtactagataacaaataatgccgcaatttggtacaagcacagtataggcataaacaaagtctccctataaagacatacctcgtttcggcatacaaaagacggcggctcaaatatgtaatgatatattccttgccatcttcctcttgtgccaaaacggcaccactgactttgtcttcggaagcaatatataaccgaaacggcattccaactttagtcgctcgtaccacgggtggagtagataaataccttttcaatctttcaaacgcctcttgttgttttgcaccccaagtaaaattggcttcttttttcaaacgaagtatagggacaaaagcatcgattttacccgctaggttagatataaatctcctcaaataattcaccttacctagtaatttttgaacttcctacttccatgtcggcgctttgaaatcacgaatcttttctatctgcttaggatcaatctcaactcctctttcatgcaccatgaatcctaaaacttccccgccgacacaccaaaagcacatttaagtgggttcatcttcaaaccataccggcgcatcctctcaaaagctaacctcaaatcggctatgtcccacaataccatccgatttgacaacaatactatcaatatagatttctaagataatacctagtaaatcatggaagatcaaattcgttgccctttgatatgttgcctcggcgttcttcaatccaaaagttatgacaacccactcaaatataccaacaaatcccgggcacctaaaagccgtcttgtacatatcctcctccgtcataaagatttgattgtagctggcattaccatccaaaaagctaatcacattatgacccgaggcatcattaatcatcatgtcggctataggcataggatattcatctttgggagtagcttaattcaaatctctaaagtctatgcaaactctaatcttaccactccccttcttctccaccggaactatgctagaaatccactccgcataatgacatggcctaataaaccccgctttcaacaaccgatcaatctcttctttgactcggtcatatagcaaaggattgaaacgacgaggcggttgtttatgaggcctaaaacccggtttaattggaagccgatgctcgacaagatcacggttaagacccggcatctcatgatactgttaatagtgaaatttggtaaagcccgaagtcatcatcggcttaaagtcaatatcagctttagagtattggaatcagccgattggaggaaacagccgatgggagtcatcaagttgccatgctgtcgtggtcttgatggagtcagatcaatcaaaggaatcttatctagaagagttcgagttcaagaaagatgcggcatggcagtctatctattaattag

SEQ ID NO: 80447 - DNA, 12542 bp, Oryza sativa
atatacatataaattggatttagccgatgacaacaaaggtttcactgtttaatctaatcttgtggatttcatgacatcggacctccagccgatgtgtgttttaaccttcggatcggtgattattatatcttgtttctagccgattggtttctactcggttatattgtttttttattacatcatcaacagcagattgcctttatatcattatctacattgcacatatagccgattgcttaatccctatcgctatcggctgatatcggcatcggctattatcggctatcggttggaactactccatcggcttgtcagccgatcgactgttttgatctactatttgcatatcttgtcagttgcaggatcaaactgactggcacaccttcatctcattaatctttggacctgcacaggagttaagcagatctcctaagccggtgtgttcgattttttcgtcaacacagattggcacgccttgtgggactcgagttttgcacccattatgtctgaagagaaagtcaatgccgcgaaggggcaatctactaagccgatattcaacatgtcggctcggggggcaagcacatcagtatcggctcatgaaagccgattacaagaagcaaaacaagatcagtttttgagttatcaagaaaagaaagaagataattttgaagcatgaggtttcatactccaaaactgggggccatgtgttaacagtgaaatttggtaaagcccgaagtcatcatcggcttagagtcaatatcggctttagagtactggaatcagccgattgaaggaatcagccgatgggagtcatcaagttgccatgctgtcgtgttctcggtggaatcaaatcaatcaaaggaagcttattctagaagagttcgagttcaagaaggatgcggcatggcagtttatctattaattaggtatagtttgttagtttccttttatctttaggaaagtatgtttagtgtccgataaggactttatcttttccttttatctttaggatagtttctttcttgtccgacaaggacttgtatcaacccatgggtataaatatgtacacccggggtctatataattatcactcgatcaatacaattcggcgcatcaccaccatttttacttctacttttgtttctacgttccggcggaacttggcacccgacgcggggctgcatcgtcttcaatctccggcgaaggggtaagtccaatgttccgtcggtccattcaattgcatcgtttacgtcggcgtcgttcaaggctgcatcagtacattcgacctcttggattgctctggtttggatgatatatttgcctacctatttatcatatgtctctattaatctagtcttagcacatcaatttagctctatcggctgcttctcgttttagggtttctgccggtatcggctaaatcgcgttgctagattagattaacttagatatctaccaccctgaaaactcagtcaacggtttgatcgtctagatattatgtttcttttcatacttagtgctgcatcagttgagtttgatctactaagtcatgtttagaaccataatctctagcctgctttttgactgccaataagggtttcatcggggttttagtcggtgagttatctggacgttgcatcggctcataaggattgcatatacatataaattggatttagccgatgacaacaaaggtgtcactgtttaatctaatcttgtggatttcatgacatcggacctccagccgatgtgtgttttaaccttcggatcagtgattattatatcttgtttctagccaattggtttctactcggttatattgttattttattacatcatcaacagcagattgcctttatatcattatctacattggacatatagccgattgcttaatccctatcgctatcggctgatatcggcatcggctattattggctatcggctggaactacttcatcggcttgtcagccgatcggctgttttgatttactatttgcatatcttgtcagttgcaggatcaaactgactggcacgcctgcatctcatgaatctttggacctgcacatgagttaagcagatcttccaggccgatgtgttcgattttttcgtcaacagatactccatgcgaagcaatcaacatactccttaagtagctcgattattttagctttataatcgactctcatgtttttgtttacaaaagttggccttggcttagtttcatcacctatgtcaacttcttgcaacggatcggccgatgtgaacccttaaccaagcttctctacttcatcaaaatcttcaatagtttcactaatatcgttctttgtagaccgatattcttgcaccctcttttgcaaccactctaaattagcttctttattcattacataaagtgatatggcctagccgtgctaaactagccggctatacagagataggtacaaatttgccattggcgatactaataaaatcatagctagaaagatccatcccgataagcattgaatattcccataacaccactcaaatgttgcattggccattgcaacctcgggcgatgtatccgcttgaacaatctcaacatcatcgccgtcccattgaattaaacattgatgcaaggtaaaaggcacacaacaaatggcatggatccaacaacgacccaaaataacattgtagttaccttgcacatcgacgatgaagaaagcggttggtagcgtcttgtttcccacggtaagctccactgaaaagatatccttcgcctccgttggttcaccattgaagccattgagaattatgttggtcttcttcaactcatcatctccatgccccaacttcttgaacaacgagtatggcatgaaattcatggcagcacctccatccactagcatcctagagaccggcttcccatcaatatgacctttgaaatagagaggcttcatatgacggtttgactcatcaggcttctcaaaaaccgcatctttaggacctagtgagaattgagcaacctcggcttcatctatagcgtaaaactccataggcaacatacacaccatgttgacatccatgtcctcctttggagatgattcatccttagcaaccgattgttcttccttctccttttgcacaacaaccggttcttcaatctctatggatttatgcctccacatctttgtaggcagtggtcgcaactcattgaaccttctatctctttgctcttcggcctctctctctcttaattcttgggcccaaagatgttgcaaccttctcttttggtacccgtcaaatccttaggcatccacctcggtttcggctctgttccaggaggtaaataatgccctctgttgattttactcgaagacgatgaagcccctgaactaccctttgcaaatctcctgtcgaaccggcgctggagcccggttagaccggacgtagaccattagtcagaccagccagaagcgccggtcataccgacattgggctgacggtcaaaccggcctgatggcccggtcagaccagccttagggctgcggtcagaccggccagagggcctagtcagaccggccgcctgcgatgagctggtcccggcgttggatttattgcttgaagactctccaacttcatctccagaaggtattggctcatcatgagaccccactttgatagtaatcacctccgaagtcctaatctccactttgacacgctttccttcccttttctcctcattggcccggttcttagcataaaactggccattgtttggtaaagataaacgctaacgagctggccccggttgtattgcattggaggcatatgattgaacattgatggtgttgccccccatggcatgtagtaaggaaaaggataacccgacggcagcattggataaggcccccatgacatgttttgagaacgatgatatgtaggtgattccgactgtcttggtgaatgaccaaatcgctccctaggaggtgatcttggtcttttccttttgttgcgagctttctcaccaccttgcttctcatacttattcaaaagcatatcgaaggtcaccttagtcctcttaggagctttagaacttgaaacttcgctcctattctccttccaaacaccaacctccggattctttggcaccatcatctttggcctaggctctccaatgaccactccttgaccaatcaacaccttcttattgttgaaattaattgtattcaccgggaaaggatcatgatcaagcttcatcttggaaccatcggtaaatttcaatcgcccttcatctatggccgattaaacctgtcgtcgaaacacattgcaatcattagtagaatgagagtgagaatcatgccatttacaataagcttgacgcttcaattctacttgagagggtatgacatggcctttaggtaatctaatttgtttttcttgcaaaagataaaaaaaaatcatatcacatttggccacgtcaaaactatacttaaccttactttgccgatctttacgaggagtcggcattaaattagagcaaacaaaaggcttatttttgttagttcatgatcactccgcaacatacatatcatgatcaccctcatcatcactatcactagcttcaggataatcaatcaaattaacattaggctctaacaaattttttgctatccttaacccggctttcctgagccagagccttttgcatgagttgactaacataaaaaaattgttggcaatctaatctttctttaataggagcaattaaaccattaaaagcaagatcagccaaatctctatcagttatattcaagctataacatcggtttctaacatcgctaaatctcttaacataatcaatgactgattcattgtgtttttgcctaaccgatgttaaatcacttagcctaagttcagtttcaccagtataaaaataatcatgaaatctttgttctacttgagtccaagtatgaatagaatttgccggaaaagaagtaaaccatataaaagaagtaccggacaaagataaagaaaacaaacgcaatttaaaagtatcagaactactagcctctccacattgcgctaagaattgacctacatgctctcatgtggtcttactatcctcaccactaaacttggtaaattcgggaactctataaccacgaggatatggtatgttgtcatagtaatcaggatatggcttttggtaaaccttagtatgattcctagctttaattccaaatttatccttaataataccactaatcaattcctccatattatcaggcctattttgatttggtggtgggtttggtggcttaataggttgtggttgcggcgcaatataattatattggccatgcctagtatcgggagtatatcccctagtaggatcattgtaagcattagggatatgtggttgaacttggggaccaatagtggatataggaggattgggtgctggtatatggtataaaaacatgttatttgtcattggatctaccccctgtattgggatgattgcgccggtctgaccggtccaagccccgaactgaccggcatccaaaggcgcggtcagaccggtttggggtccgatctgaccgccggggtaatacccggtctgaccggtctgaccggcggcaaagtcgcggtttaaccgaccatctagcccggtcagaccggctgtatgcgctgaccacccctcgtcagtttgttgggtcttcaccccatcggttttactacttatttgatctatggggcttggctagcactggtagaggctttatctttgaacataaaatcggccatgagagggccaaatttagtcctcataaattcttcacaacgagtttcgatagatgcatctaacttattatttaaagtaaccatagatgaatctatcgtatgcgcaatttgttgttggatagattgtgatacctcttcagcacttaccatgtcgaaagtatgtttaggcaatgatcccggcttgaaaatcacaccttggcgggtcctagcgcacgccttcattagtagatcttgagtatatgccttgagatgttcatctaaagctttgcgtgctccctcatcaagctcctccaatgcgactggtatcacattgaccggttccacctccgccttggttgatggaggctttgtcatggcgatatcgaagttgagatgacgttgagcagatttccctagtggagtcgccaaaaatcatcttggcaactttttgtgacaagttgacaagcacgatcgcagcacgtaaacgccttgcgttgatactagagtcaccaaccatctcaatctagcaaaagctaaaccaagataggttttgataactaaactggctaacggagccgattctagataactacccgtctcgtgggcaaaacggaaggttttcaggacaaacctacaaagagatgtcgcactcttgtaggggcggtggacgatttacggcgcaaatcgacaaagatggacaaactaagagaaaactaaaagcaatatgaaaaacgattcgattgattgattgtagattggtttttacaatgaaccggccttacccccttatataggggttggtcttaccctttacaggccctcctccacgtccaactcgggatagaatccaaaggaaaccagaaacatgccttcctgagcaaggaaacttcgagacccggtgaaacagacctggactcggactctgccggtcagaccggccacacaccaccggtcagaccggcccacacacggcggtcagaccggccccacagaggaaaaccggcagacttccaaactttggcaatttttcttattttactcctaggtgccaaatttgggtgtaaacacattaatcattatatgcatccataataattactaatgttcatgaggttatttgcactccgattttcgccatcaaatttgggggagcagccggagtaatctcgataatgatgcccgtcaggtgatcgggcgggggaggagaaatcgggcgctcccctaccccatgcacgcgcgctcccctcccctgacccaccacgtgtcctcacacacaactctattgcaacaaattacccatatattttggaaactctctattaagagaatttggtttattttttgttccagcaaaaatgtttcatctagtgtactgacaatgtttcactatatatagatctaatgttgcagtgaacgaaacattccattgcaacaaaaacccacatattttggaaaccccctattaaggaaatttggtttattttttgttccaccgaaaaatgtttcacctagtgtactcataatgcttcactatgtatagatctaatgttgtagtgaactaaaacattctttcgctatttgctaaaatattgtttttatataagttgaaacagcacctaatttcaacgagtgaaacattttcgatctacttagtgaaacaattccgatatacctggtggaacatcgtgcaacatttaaaaaaatcaataataagctattttttcatcggaatatatccatgtgtggtcttgttttgaagatttaattgtaacgaatttaatggtgtaatcagatcatgatttggataagtaatttaagagaaacatcagtttaaagtagttttgtacgtaaatcgggcgctgacatcggcatgatgtcgggcgcccgagccgtaggcagccccggctaatctttgatttttcattttatgaacgatatactaatctttggatatttcatgtatcttttattacgtaagatccgaaagaattcttcgctttgatagtttgcccaacctgcttgagttaaggcagtctttatcagtgagatatatgaagtgaaggggtattctcaccagagtgatcacaatagctcatgcaccttacttccttcaactaaaaaaaactgcataaaaaaattcacctttatggctcaaaccaaacataaaattggatcatcccactcacccaaccaaataaaaaagtaaaccttgcatactaaccagggttcaatatatatattgaacgagcactttctattgggggggaggcttgatacgaccgaaatttcggtccgaaataatttcccaatcaattcctcttttttcccttccagtattcctgattacaaattccattgaatttcaaattttagttcagtccaaatttgttgcctaagctctaattcctataccttggataacaatccccaatatccccatgaaccaaatttcataattaaattaaaatctatagtaaaatattcaatttaatttttcctcaaatccattcctacaaaagtccaaaacaataatgtgcacctgcatgcgagctgaacgaagttcagttggttatatatgtttgttatgatagcacctattcatctggtgtcaagttctaaccttgacacatatgcttacatttatgagcaattatttttttatttgtaggcaacgtatcaatcaataataagacataagtggtaacatcatctctctatatattccaacgtaatctctcgggggtaattaaagaggtaggtacgtgtttatgcgtttatatgcatgggtgagtgtgtgggcatgtatataaatatctacgttcgtacagtgtaaaaaaatatagcacctggcaacctgggcatcttttcttctccttctcattattttctagtagatggcacacactgttcatgggccacatgttactgttcatgggccacatgttagggagaaaatagggcaagggaagcagaaaataatgagaaggaagtactgccttcaaaatagggcttccttaacattgcggcacttccttgaagactttttaatttttttaaccttttttatttttattttttaaaataaaccctttcaaaacttatttcaaaactttcaaaacttatttctactctagccacattgtagggtgtatttagtttacaccaaaattagaagtttggttgaaattggaacgatgtgatgaaaaatttggttgtgtgtgttggaaagttttgatgtgatggaaaagttaaaagtttgaagaaaaagtttagaattaagtaagagcgtagtggcaaagcatagtagcaaaacaaaaactgacatgtcgactgtaggtgatgtgacaatattaattcgtactgtcatacggggtggcgtagtaaaaaagtttagatttagaaataattatcgagatggcgtagtaaaaattcccctgatgtactcaattgcactgccgacccatggcctcatgatcgagatctgtgagttatatatagtagcacaattcaatactgctgtaaaatatctctgcacccttcaaataatcatttgcaaaaagctgagtataatgcttcatatgctgtccctaagaatggcacattaaattaaattaagtgatgagggtggagtagagaagtgaggagagagataatgagctacccctaaatcaagaggtaacctccacacaaattttaagaagagtgtgagagtattagagacgttggtatttgtgtactagaggtgttttattgcatgagttatctattagtttatgagtgaatgatatagataaatttgaaggtggtagtcacatcttctataacacctgccctaaacacataaaactcaacgttcaagcatagtatttattggctctcctaaaacctacatgcaagcatgccacatcgacccattaagcacacagagctcaacatgcaagcatataataattatatctataatttatttcaattctaaaactaaacatacacgtgctaaatcatcattctcaaatcattttcataatattacaatccaaatcattttattatttctttactatctaatatatatctcacagcaaagcgcgggttattatctagtatatgagaagaatggtgtcaaaattgaagaactctctatagtacttaaattatactccatccatcctaaattataatttaggtttatatttttttacacggtcttcaataacacactgtgaccattaatttattttatattaggtttcctataaatatgaaattagcataaaaagaaagtacatcaaaatatgaatctaattatataacatgtataatacttagtatatatatggttagtatgatcattagtcaaaagttatcaagtttgatttttctaaaaaaggaggcgccctataatttgggatggaggccttttctctactattaaaaaaaaaattgaagatgtttttgtcaaaattttggtacgtcatccgagtttgttttctaatatttgtctttatcacttccggtttgcttttatttttgtccgtcttctttttttcgtcgtcgatttttttgtcagatttgtatttttttgcacgtggaatttttttgtgcgagtttttttatccatccctttctttggttgccggttcttttgtccaatctcagtagtatccaatctatcttagtagtatccaatcagttgcacacgcgcagcacctctagccgctgcccaggccaaaccctagcatcatcacaacgtcgatctaccttcccacatgtttcctcctaaaattgattgcaaaaattgattccccacttattccttagtattttccccatgattttccctttcaattcagcttcaatttgtcgctccattgttgatggcctaccggcaagcttccccggcctttttacctgattttatgaaaaagggaaagaggagaacgaatggatcaaaagccctcacccaattttaggagaacaagagattcggccaaatttgatgagaagatcggggactgtttttgaaggttgaggacaaacagttggctatgcgagttgcgtctctacttgtgggttgggccgaagagaggcaggacgggcggagggaggtatcagactaggctaagctgaaaagtaaggaagaaatatgcttccgtctaaaaccaatgaaggatattcattattttttaaattacaatgtatagcgattctaatatttttatttattgctcagctcctaatagctattgtgtcactgaaaagatctttacccgtgcgattgcccatcacctaatagttgttgtatcactgaaaacatcttcacccattacaacacatgtattttttctagtaattaataaagtttatgatgaactcctctactcattgtaaattttgcaatttttttcccaccaacacaactcggcgagaccctagggtcaaatccccaaacagctttcaaagcgggacaccacctctttctcaaatttccctctctttcacttccactgggcctaggcacttcaggcagccccaccagtaagcaaatgcctcctgggatgccctccctctctcccctcggtgaagccagcatacgcgaattggccactactgcaggacaggtatattgtaacaaaccctgtaacacatactaggatgtgttacacggcaatatcacaggaacacatactatgtgctacaacatctgcttgtaacacattttcaaaagatgtaaaatatagctctagaaaagtgaggtaggagcacaaaatacgtgttacaaaggatgtgttgccaagacaatggatccaggatcgcacagttgcatgataaccactaattggtggcatagccttttttttaattacttctacatgtcctttgcgtctagtatcatatttcaaccttataaaataaaaatatcaatttatgggcatgataaatggaaataaactatattttgctttgatttttggactaattgtttatatatagatggcaatatttgagatcctactttttttctgagtcaacatttaaatacttaatacttgtttcttcatccgtgttataatcatgtgcgaaaaaaacagagtacacaagtaacaactgaaccatcacaaataagctatttatcatgtaattcaagcttgtgcagagtaaatctcacagtatgaatcagtaagctttagatttagtgattcattatcttattttaaatatttcaacatatatcttgcagttggcttatggtttgcaccaaagaacaatgtatgatacacatgttaggaattaccaactttaaattgtattgaagcgtatatggtgcacctattgaattgcaaaggatagtttccaaatttccaataaaaactgagacatccatgactagtatgaagaagaataaatatatccaaactattcactaaaaaaaatggaaacatcatatttcatcgaaatgtaccaaattgccaaagtaaacatcaattggaaaacacactgatctaattccacaactgatgagtctgagattgtatttttcagtcaaacctcagtgttcttcatttgtaactaaaaacattttcaggaattcagttcatgggttcaggtaagtaaaataaataatgcaaggaagttctgattctgatgtatatataaacaaattgtccgacatagtattgcatacttcatgggctagtttttactagtcaatatctatccaccatcttgctgtcttgctgcacattgtttgaaatattttcagcaaattgtct

SEQ ID NO: 80448 - DNA, 1753 bp, Oryza sativa
aggagtcaacagcgccagtgaggtcccctaggaaggctcctctgcctctccgctcatccttcccacctctctttcttctcaaggtggtgatggggagatgtccatgccacgccatcttccccgtctccggaggctccctgccatcggatccgccaccaccggccgcagcctcataatcgcacgcttgctttgccccgccgcagacgctggcccaccgccctccttcatccatgcggcttcgatggcgccgatgcctcaccgcccgccgaagtccaccgcccattgcgtcctccgccacctacggccatccctttaagccttgaggaaacccccctccccccaaaaacctcccctcctaccctggcgtggcaggtcagctgtgtgtgcgcgtggtcaaaaggttcagatttggaaatattttttagaaatgtctattaataaaatgaaaaaaataaaaagatctaaaaaataaaaaaaccaacaatggtatgccatgtcaatgcaaagagcggttggagcccgcttgcacctgtatgacaccgaagacaagttcgtagacctaaaaatacatttagtttagtatctaaatgacaaactacgtatgtttggaggtcggccgtgtgcttcattctaatattttcattactaggtgctcccgtgcagcacacgctcgttgcatcaaaggcgtgtatcgtcaccgatgttctccttatctaccctgatcaatggcactggcgaaggtggtgagcaatctagtcattatgtgcagttacagcagatttgcccatctgtttaagagagatagtaggatagagtccgactcttactctatttctaacacctagtataactccaaaccctaaactgtaatcgactacgtacacatactcgacacaaactaaaatagacctttagttgtaaccccattggttatggtagtggtgtagtaggaagcaaatccaaccatccgttgctatggctgatggagctcgtagtccgtcgggcaccgaagtccaaaggcgatggcaagggccgcgaaggaactcttttggaggagcaatggaggccatgggccactggacggatgggcaatgaggatgtcggcggtggtgagggagtaatggcgccaactcgcagccgagtttagcagcgtctccccgactcccatctcatgttcctctcgtcgcccatgaagactgtagccatcacgaccttgcagatgtcgtgtctatgctgaggcgaccttgtaggtgaacgggaaaacagcaagcgaatgcggccttgcaagtgaaagggaaagaggcaagcgaatgcggtcggaggaagcccgcgtcggcggcggtggagctgccctagccatgccgagaaggcgataagccactcgtttttctcccttgtactcccttcagtgactactatttgcaacaatgccatttaagatatatattggaaataaaaatatattttcaccttaaaatcaaattaggaattccaaaaacagaattttagttgtaaaaatctatctacaactaagctcgaaattttggagacagggcggggtgagagaaattttggaactggtgaaattggtattggcgggctctgctcaagtaggataatctcatcagtcatcagcccactaattaaagtgctcatctcttggactcttaccctcccactcccaggccccactcccccccactccccagaccgctaacgccgccaccccatcctctcccgtcccctatacaca

SEQ ID NO: 80449 - DNA, 16309 bp, Oryza sativa
  unsure (1)..(16309): unsure at all n locations
aatcgcagcggtaaaattcaaacagacccggaacttcctggtaaggaactccggaacttccggcctcccaagcccggaacttccgggtaacagaatagaaatgaaattcaaatttcgaaacaagagactaagccaatcttcacaagatggtgcacaggtattctaagcagaggatatatcatagaatcatctacagaaatatcacagaaagagacaagagcaattttttttcccgaagtttggatcttgcgatcctactctccgttgaggagctccaaagagctgggtctcgattaaccccttgcctcacttgtggaaaaaccccagaggaaatccacagccttcaaccccaaacacccctcggcaaatttctagaattgagtgaccaccaagatcaaactcaacctacttctagaattttgacaggcgggtgctggactggagttgcaacaggacgtggagcttggttgcggttgttattgccagcattgttgttgtagaactgacgctgtggacaaacaacatatgaagatcctccctgtgacactgcctgaggtcccatagtgagacgcggcctctgactattcccttgctaagctttgaactgagcaatcctgcgtttcttctgttccattgggttgtacttatcctcctgacgaatggccttatccaccaacttctggaaatcagaataatccccagtcattagcgggtaagaaagctcatcattcagtcctgccaagaaattctcttgacgctcttcatctgtgcgcacatcctccggaacataacgggccagacgattgaactcatgcatgtactcggtgacagaacgggatccctgagtgagcgccctgaactccttcttcttgagagacaccactctcgatggtacacgagtcttcctgaaagcagcagtgaactcaagccaagtgattggttcagcagtagccctgttgagacagaagtgatcccactactcaaaggcagggccatgaagctgatatgaagcaaaggagactttttcttagttagtgcactgaagcaggtccaacttcttttctatggcgtgtagccaatcaccagcctcaactggattggtagtactggaaaaagtaggcggcctcacacgaagaaattctgctaacttgttctggggaggagcatgattgttcccctggttttgttggttctggagttgttgcatcatcatgttcatgagttgcgcctgttgagctaggacttgggcaagcgtgagattctctccattgttgttgttgttgttgttgggcccatttccattgctgcgggtgttcaccatctggcataggcaagagcacaagaagagaaacaagggagaaagctacttaggacagggaattaatttctactaacttgacttttattgatcttaactgagtttcattattacataaaactgaagactctcacaccacttaactcaaacttcctaacactcgaaaccaaacaaacgcatgcatttacatcccaccaatgatgtaaaccacatgcaagacccacacatagccaaacttaaacaagcaaactaacacaacgaactaaggcaacgacttaacaagacatctagatcttcctggcatcggagttgattgaaggctcgttcggctcgttctcatcatcttgagtagcaccccactcaacctttgaatgggtgcgctttgaatcttcttcctcctcatcacttaaattaacgaccggaggatccactgggactgggacagcttctcttgccaccacacgaaccttgggcaccaactggtagcagggaacaaaaagagctctcttccttgcagtaagatgaaccctggccttctgtggtggcgcttctcccttcaattcggctagttccttctccagacgatcaaccttgtcctctagcttgcagatcttaccacggttccgatcttcacaagcttgagcagctgacacaacttcagcgcgggactcatccatggcccacagcatctcgaccaaatgtcttatggtagcatcattctcaattccttcaggatcaacatagctggcacggtcacttccctggggctgacgaggatggcaacgatactcagtgtcggccaacagatcattgtaacggtcacggagctctcctatggcgatccttgccgcctcctgacaagcttgaggatagcttccccctccagcctcgaacatcatcgatgggatgtcttcacgatcactgttcaaggtgaccatgacacggcacttctcttcatcacgatcatgaggaatctgggcatacaaaggggcagtctcgaatcctatggtaaaggacatcatacgcagctcctggacaaatccctcaataccgaacaagtgctcaggcttgaagcgtggcatctaaagacaagtgaaaggagggagttaagacatttatccaattaatagcacaaggttttggattaaattgaataaagttagaaaatcgaagtgaaaggtaaataaagtaaactaagataagttggaacagttgaaaacaggatcacaaatttttgcacttttgaataacaggtttaaaaaaaagctaaaataaaagagagttataaaatcaacatgctaagtttattatattgcaacatgattaaataaaaataatgttgtaaaacctttgctggtaaatgagtcattagtacagtaatagatgtacagtactaacaacacaggaataataagtaaatttttaatgagaacaattaaagagactataatctgcatgtgccattagcttggtttaattaaaagagaaagagagaagaacagttctacttttttaatatttttagagggcttctataggtaaccatttggcataacctagggtcaaggaggctctgataccaacttgtcacgcccagaatttctatccaaaactccaaacacttacatgtgtgtaaaccctcgtccaggaatcagtcgaggcatacaataacaaattgataatagagtgcaattattactctaattaatagacggatataaattcattatagagatagatagttcctcttaaacaataaagatctaagcagcggaaaataaaataaagagcgtaggcgactccatcccacaagcagcttgaccagggctacgcctaatcctccacaccttcagcctcactgtagaactcctctgatgaatggttgcaaggtgagtatatgacacactcaacaagccacgcagcaaatattcaagtgcaggggataacaaaggatggcataatatagtctcatttgcataaatggcaatcaataaatacttcagaatttagaaaaacagtaaagcatttaattaaacaatattaatccaacgctatacaacatacccgttgcataggcccaaccattctgaacaaccattcctggctgcacagttctatctccaaaccaggaatataccattctaaaccaggagctaaacaagttattaccaattacagcatcatttattatggtgaaaggtgtgagactaatcacaaaagacattgttagacccgcccataaccgcgggcacggctattcgaatagttttattctggccagaggtgtaccactgtacccacaagacacaacctcaacatcatgtcaaccatgcgtcgcgatacttaacaagaacccgaatagagattgtgacaataacctccgcaaaacacaattcaaagcagtgcacctttcttggatcataatcacccccttataaaacaaggcatggactccccagcgacccccgtgggcttatctccgccacttctcagtctggttccccacaatgaaccacactatacaaaagttaaagccgttgcccacgctggcttgtggttggcacggttaatgtttcacaaccaaaaatcgtgaaccggtccttaattgtcatgagtacgaccatcaaaaccatgtgctcacaacccaccattaccatgttttagttggcatcttaataaaccatcctatcacgattgaccatcatgagctaccattaatcgatcattaagtaatagtgaatcattagttatcccattcatatgagctagtgtctctaaccatggctaagcatcctaattactttagctaaaaccatataatgttcttgctaatccaatttgtcgacgtttgatgtcgcaattctggtatttgcatagtatggggatcgtcggtgctaggatatatgcgagactgaggtaataaccctacatcctgtattgtcaggtaataaccctacatcctgttggccgaagccggtattgctcttattcatgataatcacaccagtataatatttggggtagcctatctaactgttgtcgacatggcggtctgactcgtagtcgacaacagggtagcctttctcctcgaatccgtgcccggtaagatcagagatagcgctttcgtctctcctgacagtatccggagacaccgtagggtactagccgtgcttatccctgaagtcgatatccggcggcgtgtcttggcgtatgtaggcttccatgttgtggcttctatctcgattatgttgagtgttgatcctccatggtgggtgccgatcgtgttgatcgtctcctctcccctcttctccttgggggcttgtatttatacccacaggtatccccttgtccaagtagaactagtgaaaccaatatagatacaatccgagtagtccttgtcgttttcatgtagaactctggttgtcattccttatccggaactcctcctatatccgaaggtgcttccgtataggatatggtatatagtgggtcctgccgagatttagtcaactactattaggtatgtggtatccataaccctgacagtagcccccgacttcgatgcaaatgaacgagttcatattctcaaccgcagactttggaggaactgttatcgagctcatgtgaccgttctcggtgagtttagagataacgttagacttcctctatcagcctcgtgcgggcaccgaaagggtttgtctaagtcaatctctgatgtcgaccgagaaagtacagagcgtacgactaagtctcccgtcttgctgtaatcgagaatttggattgaagtcaagaaattttatctcggcgggtacaccatctcttcattccgtattcctcaacaatactcagaaaagaatagaattttcctgaaatcaatactcagaaaagaatattagatagaaataacccctgagcgaatgctcaaagggtgacatgttataatatgacagattagtgaattgaatgtacagaccagtgttttgtatatgagcgtcttctctcttaccgactccaatcagtcagtttgcagagtcatacactctcccttgcccctagccttgtcgtcggagaatcgttctcggatgacaaggctcttggacctttgacctgcctcggttgaacaagcactgatcctagcccccagccatgaagttggaaaactcaatttccgattacacggcttggttaatacgcacggcgagaactcttacactaccagatcttacatggtctttcgtctctgaaggatccgacaaggccttattggctctgggcgtccccagccgaagttcccttaggttcctcggaggccttgtcatgacagcgtaaagggacaatatgataggtttcaacgctaggtgtcttttgtgtaagggatctctgggtaaaacacttggcgatcttgtgtacctgatatcaactttgttggagtacaggtaatgggagaatcgctacaccgctggtcgaggaccaagcagtggtcgtaactcgaccacttaaagtggaagtagtgggagaatcgctacaccgctggtcgaggaccaggcagtagtcgtaactcgaccactagaagtggaaatagtgggagaatcgctacacagctggtcgagaaccaggcagtagtcgtaactcaaccactataagtaaatgtacgagagatcgctacgattgactggttgagaaccagtgagtaggtgtccctcgatcatttgaattcgtggtgcgaggaccgttgtgttattgctgtagtcgtacctcgaccatctaagattgcggtgcgagagattgctacgtactggttcgaggaccagcgaacgcgcagaatcatctctcgacactaatggaggttgcggtgcgagagattgctacgtactggtttgaggaccagcgaacgtgtagaatgatctctcgaacaccaatgaaggttgcggtgcgagagattgctacataccggttcgaggaccagcgagcgtgtagagttctctcgaacactaatggaggttgcggtgtgagagattgctacgtgctggttggagaaccagcgagcgagtagagttatctctcggacaccaatggaggttgtggtgcgagagattgctacgtactggttcgaggaccagcaaacgtgtagaattatctctcggacaccgatggaagcttgcggtgcgagagattgctatgtattggttcgaggaccagcgaacgtgtagaatgatctctcgaacaccaatggaagtgctagagttggtttattatgtgcgtctcatgtggccagcatgactcacgcacccaacttgtagcatatccggatgtccgttcacaatcatgtcaggtgatcaagccgacgacgttcgctaggaattatccgttaacaaccttttctcgagtagtccagcgatgcncaatgctatgagataggtcgtcggtcttcgttggtaggttgggcgcgacgactctgcatttgttgagatcgttctcgataatgtggtgtactcgaccacaacttactcgagtgctcaattgttcctgaaaaatattttctagagggcaggatatatagcagagaatatcgagtatgtactcaaaaaactgcatggatcttctagtattatcaggatataacgagcagatgtaaatgtcagggcattatgtaaaccgtaaacaagcatgatttatacagaagaagatagagcgagcccctagcgttagatcgtagtcgatttaacatcggggacacccgcgcaaccgatattattgtataaagaacatgctcttggaaaacataacaaatcatggatctgacaatactgtatgagctgaataggtacgataaattgcagataaaatattgcgtacctttgtagatacatgccggatgtatctacgaaattagtagatcaatttgaaaaaccaatctaccaattaccttattgcgtactcgttcgacatcatatgatctgacatcttttggtacgccgcgtatcttgaggcttgaatgatctcgatagaccaagttgtcaatgacgatgatggtcccgatctagtcggaagatgtacttggacaagttggatcttcccacagccgaagtcgtcgagtagcttgttgttggagaatccatcttttgaacccatctcgtcgaaatcctgaagcaccaaaatccccctacctagcacgccactgtcgacgtttgatgtcgcaattctggtatttgcatagtatggggatcgtcggtgctaggatatatgcgagactgaggtaaaagagatggagacagggatttttatacaggttcgggcccctgaattgtcaggtaataaccctacatcctgttggccgaagccggtattgctcttattcatgataatcacaccagtacaatatttagggtagcctatctaactgttatcgacatggcagtctgactcgtagtcgacaacagggtagcctttctcctcgcatccgtgcctggcaagatcagagatagcactttcgtctctcctgacagtattcggaagtcgtgcttatccctgaagtcgatatccggcggcgtgtcttggcgtatgtaggcttccatgttgtggcttctatgtcgattgtgttgagtgttgatcctccatggtgggtgccgatcgtgttgatcgtctcctctcccctctcctcctaagggggcttgtatttatacccattggcgtccccttgtccaagtagaactagggaaacaaatatggatacaatccgagtagtccttgtcgtttccatgtggaactctggttgtatatatccgaaggttgcttccgtataggatatggtattagtgggtcctgctgagatttagtcaactactattaggtatgtggtaaccataaccctgacacaattattaaccaggtgacaaagtataggtaatcaataacaaaatggctataacaaaggaaataggtcatttccacccgatgtattcaaaaataaatgcaatagttgaatagaaacaatagctttaaacaggattaacatgctccaagggttgtttgggatctgtgtgacttgccttgctagccttggaattcttcaaagtcttctcctgcaaaatcggactctccaagaacgtcggaatctaagcataaaagagtaaaatcaccaaaacagtacacaaacaatcataaacagcacatgtggatatttttaacatgtagatctcaattttagaacaatttagagacttgaaccaactaaatccgagctaagatgaattagttatgaatttttaaagattaaaccggattaaatcatttatatagattttaattggattatgatgcaataaagaattatttttgaaacggaaaaaggatttattgcgtcagcggggctcgggttcatggtggaccgagtgaacagaagcggtctacggaacgaacggctgagatctaatctaaacaaaacgaacggccgagatctaaccgacctaccacgggtctacggctgacgtggcgctgacgtcgacgatgatgtcattgccgacggcggctcggcaccacttgctcgccggcgaacgacggcgcggcggcgcaaacgaactgcacctacgggtagagggcgaagcggcgaactcaccgagggctttgacgatgacggacgacaaacgacggcgacggcggcgagggcgaggcagcgaagatgttcgggtcgacgacgacggcgatgctccggcaatcttcggtggaaacggagtacgggacgaggacggcgacgacttggtgatcccgacggcgaccttcccgagcgacgacgacgaccagagcggcggcggcgcacggctggacttgcggcggcgacgacggcgcacgggctgacgcggaggcggcgctacaagcgacggcgggcttgggtgaaggtggcggtgaacagaggaggtcctgaggatccttttataggggctagggggcggcagctaggcccatggcgtccggcggcggcttgtgcgcggctagggcgcggctggcggtgggagatggaagacgaccccgacaggtgggccccacccgccagcgggagagaagagggagagagggcggattggcttgatgggccgacttgggccgagcgcgagcaagccggagagagagagagagacttgggctgacttttggcccaaaaccaaaagaaggatttttaaacctttttccttttaaattattcatgaaatgcaattccatttattataattactttcttggctcaaataaatccgagaaaaatctaggaactaatcaagtgaagtatttgataaaattttatctagcccacttttatatttgaatttattacttaaaattagatcttttcttctaggcttttaaaatcatttctaataattccatttaaacaacaatttataaatttgggatttttaggatgtgacatctaagctaggtggaaagaaaagagaaagagaatctattcccatacttctaatatacatagtatacatacattctagttaactgatatactagctaataccctctatccgatgccctcctagtacttcgagaagccacccctgactgccgagttccttacgacagcccgtcatgaccatccaaccggggctaaatacggaggaataccctccccaggaaattaacttaggattatatataggcgcggaggaatactcgtagtgagctatcaccatcagcggctcacctcttatccgcaatatgtaaccccaaataatgatatcccgtaatctagacaccacgcctaaactaccagatactactctaatatcatcgtcatgacatagagtaattgcataagcaaacactatacccgcaccaaagcatctcccagattagctagccgtatattcagtataacatgaacataatgtaaagttggtactcatatactcagaaagtatttcaataccagaaatatatttagaagagtattcggataaaagtacaaagcttacaaaagaggaaaggaaagctactagagccatacccgaactcttccgaaggcttccggactcctgattcctattctaattctattccaccagctagataatactaaactaaacttgagaggaatgagagacctcttgcttgaggtgtgtgagtgcagtgagaaggtgaaatccttttatagctgaactatgacagttgtgacagttggaatggtcggtaataccctccaaccgtcattggggcttcatctccaccgtccagccaaaacctggggctggcccaacccagcccaatttcggctggcggcctcctctactgctttacttcgtagactagtgaattttggcctgattcatcgtgtcaagtctgcgttcttcgcccattcatacataagtatggttctcaacatcgtccgattgattcatcgtctgagttgatgtcgattctccttcactttattgtcattctctgcaaaaggttagtagacctaatactagtggaatattattattctaacatatttatgcattgcaagcatcactagttctctcctgttttagtaatattgacagtcgaaactgatcgataacgaccgtcgacaaaaatctccatcccaaacttttccagacaggcaatcaatcccgtccatctcccaaagagctaaatcggcactagcaacgttaattgacctgtcggctggcacgatctcaatcttgtcaccttgccattgaatcaagcactgatgcatggtcaaaggaatacatcaattagcgtgaatccaatcccttccaagcaataggctataagaacccttcccatcgatgacaaaaaatgttgtaggaacggtcttgctactgactgtcagctccacctttggtctccaatggattgccgccaaaatctttgagaaccatgtttgttttgataagatcatctgaatttctgcccagcttcctgaatgtagcctatggcatcaaatttacagcagccccactatcaaccatcatcttagacatcggcttcccattgacaaacccgttaacatacaatggcttgagatgccgattctctgtcccctctggtttctcaaaaattgcttgctctggcgacaaaaccaatctagcagaggcctcttcaacatcatcaacatcggcttatctggcgtcaaattctgcaggtaacataaacaccatgttcactgatgtagatgcgacattctttcctctagccaacctttttgctttgtcggcctcaacttcatcggctgttgcaatcttactcttgacacgccactcatgcctgggttttgtcttttttagccaatgattgatttcttgttctacctcctggaaacgctccctgctcctcatccgttgaaccctcctcttctgattcttcgtgaaaataccagaagagcaccattgcatcttcctatcctcgttctcatcttgatgacaatcttgattgaccggacccaacctctaatgaacaggaaccctcttatcactcagccgattgcttctatcataagatcggcttgaacttcctgcgttgtcattgcagccagggcaatcttcaattgacggcagcctcatcccctcattctagcaaaacctgaagaactcacaaccctaatgaggaccaaaaccaccatcatcttgctcgtagtacttctcctgttgcttatcatgccttttctgatatttattgatgatcttggctgaattcaactgagaacttcgagtttttcctccatcagctgctctgccagctgtgtgcaccatgttgacgagaaaaggaagtctctccaccttcatcggctttttagaatcatcaaacttgatctttcctccttcaatagccgtttggatctgctgcctaaagactttacaatcattggtagagtgggaatcagaattatgccacttgcaatacttccttttccctagctcttcagccgatggtattatgtggctagcaagaagttgtatctgcttctcccgaagtagcaagtcaaaaattttatcagctgtagtaatatcaatgtcatacctctcttcctttctagaactcggcagtccaccgggtaggtttgtttatccttcctttttcgagtgtcttcttggatagttatagtggccgataggcgcagaatctgatatggaaaacagtgctttctgataactaatcactggaagcacccgattctctctactctgtttcacctctctttcttttggcttcttcttgagaatattttcacgttggatgaagggatgggccctatgctttttgcattctagttcaatagtttctttttgatttacagatcaaacaaaagaaaaaacattacagaaactcaaacaaaataaaatcacacatataaggatacacgtgattgatcttcttgaaacttttcttagcctccgcaaacctttgctcatgcatggtcaaactttcaaactcctgcgatgaaaatttctccttgatcggagctatcaaaccctggaacgcgagatcggttaactgggaatctgtcaaagacaagctgtaacacttgttcctcatatctctgaacctctgtatgtaatcttgcacagtttcatcatgcctctgcctaaccgccgttaaatcagagagcttcatctgatgggtcccgttgtagaagtaactatggaattgtttctccaagtcgacccaaccttgaacagaattgcagggcaatgaagaaaaccgtgtgaatgctgatctggacaaagacagaggaaacaaccgaactcttaaagcatcgacagccgatgcttctccacattgagccaagaatcggctgacatgctcgtacatcgaaatgttgttttgccctgagaactttgaaaaatctagcactttgtatcggttcggcagtggaactctctcaaaccactcaggataagggtgctgatacaaatttccaatgtcttttggcttaagcccaaactgctccctcatcacatctgcaatcatatcggcccatggcttctactggggcactccttgcacttgttgctgtggtgatcctccttgctgatactgaatatgaaggaggctagtattgataattcaaattacccccctgataattctggaaatttggctgtatattatgcaccaaatgctcaggaataacttgggctacaaccgattgatttggttgtacactatgtaccaggtgctcaggaataacttgagccacattttgttgcctctgctgattatcaggtgttctcaggccaggtgatatctactgcaccgtctgctactgaatcggctaagccatctgttctcttggtggtgtctactgaattggtgctgactgtactggctcgacaatcggctgagttgttgggaacattgtagcagtctgctcctgagtcagccgattgatgttctgcccaacatgttgcggctggtctctagacaagagacgaggattaaccacctgcctttgagctgacgaaggtgcaaccggtgctggagcataaactgttgccgtcggctggactgatggtgcattggaagcatgctgctgatttcctatcaccaaattcctgtagtttgggaagacaccacctggtaggtagactggccccatgttctgatgctcagctatcgtgccatcaatgacaaatttgatcttattgttagtgtattgacaagcactccagattggttgatcaaggcatgttgtacggcataatcaacttggtcttggaaatttgtgcacctaggaggttcctcccgcacttcagtaccatcttcaccaagatcttcaaccacaccatcttgaagcccatcacctttatcgcccgagccatctgtagtacctttaccaccttgggatgaacttgttccaacttcatcggcagcaaccaccttcaccttgtacttttggataacttttccttgtcgggttgctgcaaacgattccatgaactgctcctgagcgctcttcatcatcagttcatactccttcttttgttctggtgataacttgtctacagtgactaggactcaaccccaattgaaggtagattagtccctggaggtttcggaagcttggtttgaggaggcactggcggcttgcctgttaatggcggtgattgcttttctgctgacattgttattacttgtcggtcccaccaggcatgccaaaagcgtgttgatgcgaaaaacgcacactggcctggaagatctgcttaacttcagtgcagatccaaaatcttgcttttagtttcgtgagcgtgccagttgatttgatcctgcaatcaacaagaaagaaagacaagaaaaaccgcggttaaatccataaacgatagccgatcggccagtcgccgatgacatatcatgtattttgaagccgatgtcatatgtgaatcgatcggcaattataagtaagcaaagtaagactaaatctactcgatcggctgtagatattaacgctatgtaatccttctgttgatgtatatttaaaccaagtgattgggatagatcggtcgccatgctgagacagtataaatcacttagatcgaagtatacattaacacaaagattataaatgcttatagcatagccaatcagatagatctagcatgtatcggctagtactccgataccactctatattaagatattagaacaagtagaatatatcaaacaagtagcttaatatactttattgcaataggatcttaatataaagggcagacttagcatatcaatcaagcacataacgtataaagtagctaaatcaggtaagatcggctgaaaccccgatactatctctcttgataatcataaaacatgctagatatcataattacagatattacttaatagatcgatctcaaccgatgcagcattaagcataaagacaaatataagatctaggcaagatgatgaaaaactctaagagatggtagatacacgatacaatctagattaataacagaacataaccctatcgattgttttctagcaataagaaccagtcgataacaagttatatctcatagatctcactccaaataagcttcatgatgctgaaatctggcttgttgtagcacatgcgactgaggaggagcgcatgcctacctggaagagctgtagcatctcctactttggggagtaaagaccacctgaagatagagtacaacactctataatatggacgcaaccctcgagtagtccccaaacaatccttgggagcatccttctcatacataaaggtagtgctggtcggtgacagagcatcctctacaaagatatgtggacgactcaggtcatcatcatctaaccccaaagctgcagcaaactgtgccatagaaaccctatactgctgcccctgaatggtccacttcacaaaatcaatccccttcttggtggtgccaaagaaagtagtggagtagaactgtccaatcacttcctcattccaggaatactgcaaggccaacaaatctgccacgtgcttgcgctcacacaccttgcgtacctcattgaagactatgttgttttttcaggacatgtactgccagtctagccacttcatgtctactactggatgagatcttcccatgatcacagagttataccaatcaacctgcaccaaggtcctgaatctgtcatcctgagagtcagctggcagagtatcaggactaaccattctgtcctttccacacttgagtagattcttcagatagttcactcttgtgcgtttaggatcaggatcaacagcccttgtcttgtacagcctcaaaggattgctttcagatccaggctcatcctcattgccaccatcatctgactcagatgcagctggagagggagagcggggtgcatcacgaatgacaatgctaccagccctcctggaatggatcggaatctgactcccactgtaaaaatctccaactttttctttgcccaatctccccctaggaccacgaaccagggggctcgagtcagcaggaacatcttgag

SEQ ID NO: 80450 - DNA, 5639 bp, Oryza sativa
gccttgttcttcctacatgatacttcaagattaaaaccagctgaacaaattattgcaagcacctaagggtagtaaaacatttacctgctcttgaaacttcaatatagcagttatctcttggcttacgcattctagaaacatctacaaaaagagtaccaatgttcaaagcagttacaatttactagtttaccaaagaaaagagacttttttcgccgaaacacaggataataactcaacaagagcagagagcatgtttctcaaaagaatcagaacataagatatgccaacccatacatttcccaggtaacatgtagcaaagtgagtattgattaatcagactcagctgatgaccacgaaacatgcaaatatctaactatacaacgcaacacctcaaacagataaattcagttactaacattattcttgattgagtgtaaggacatggaactatggtttaaatcacataaagattcgatggatctacatgagctttgaaatctacagtaccaaaagactcatgtattatgactaaaatatacagacaggcaaggaaatcaagcaccattaatgttgttgaatagtatttgaactaaattgtagcagtgtgtaaatccggtatggaagttgagggtacagggcatacaattctcactgcggtgtgtatttggttcagcagaacttggaaatcccatcctgtcaatcacaccaggttttgcatcttcccgggtttctttcagaaaattccagaaaacccttttggggaaaaaacaacaccattccttcgaggaaggtatatttgacaagtaaaatcatctgtttcactgtttttgctccctgcatcaactttatctgcatcagctttggcattatttaactttcgtagttcactatatcttgattggaccctaaacggtgacattcttccagcagaaatttctctcctagaatccggagccatttccattctagaagttgttctgggaacaacaggtgccacatcagcactttctttccttgaatcagtagcagactctacccttctgcctgccttaaaaagaagaggtgcagaatctggggccacttccatccgcgaactagtcttcggagcagcagcagatgctacatcagtactttctttcctagattcaacagaagactctaaccttctgcctgacttgggaacaataggtgccgagtcagcgcttacttccattcttaagttagctctgggaccaacaacaggtgctgaatcagaggccatttctgttctagagtttgttctgggaacaacagctgctgccacatcagaactttctttcctagaatcatttgcaatctctattcttctaccactcttagaaagaacagggcccacatcagcagcatcactcctagaatcagtagccagctctggtcctgagctagttcttggtattatcacaggcaccacatcaattttgctaaaattctgaagactagaagagttgttactcttcagtgaacctctcttcaggttggtgccactagatgcaaaggttgaatttccaactgttttggtactggagccattaccagctctctgaggtgtgactggaaccaacccgcttgcttcaatatggtaagaacagataaataaaggacacattaggcatatcaagtgtttcaactgaatataaacgtgtaaagacagagaaaatcagtgacatacaagttgttgattttgtctctttcaatgcagagtctgaattttgagaaactgataatcttcctgtagaagactttatgttattctcagaattttgtagaactgataaccgcccaatgttagcccttgaaccactgtcattttgtaatggcatagtgctacttgacgaacttttcaactctgaatgaccatttaattttgttgaagtacccgttgcatatggctcaagacgctgaaaattgatggtttttagtacattataactaaaaacaaatggggaacttcaatgaaaataatatattggtgttagaactgtagcagggaagccagaaacataccgttagatctacaacccatattccaacacaactttgattaaatgaacaaccaagaagttttccctcgtggacatttagatcagacagtctagaccatcccacatcaacggtatcatgacatcttattggttcccaagagaaaacctgcttagattaagagaagtttatctctaggaaacatggagaagaaatttgttgccatgctgtaacatgagaaagtaatgaccatacctttaaactttcatgcaacccacacaacagagatcttccatcaggattgaatgtcatggatcgaacacctgttgtctgatattcaaatagagacgtcagcaagtaatataatggatcttttattttgaggttctcaggaactttgggcagcctgtgctaatcttgatgtatatatgctagttgtcactacagcagcatataaagcactaactacacttgaatgttgaaaggccatgctatgccataagcaaatggaccatagaattaggtaagcacaggtgattgtataaggacatgtaattgcgagccttctagcatatgcactagaacaggtagcccacatgttttgaggagataatgaggttatgacatgctgttgagagctgattacgacatagtaaaatatggttgggcacaccaaatagagaaatatcacaaaagaattaaaatataatcaatgatgtcatgacttaagagaactatgcagtatgctatttaattctagattggtgcttctatgctctaccaaaattagagtgacacaaatcctaaagtactgagtagtcgaacagcaaccaatgagtggctgaaaaccatgcagttaatgtgattaaaaaattaaaagaaagcctgtgtgttggaaactaatgattagttgttagtgtaatggagtaatataagaaagaacaaatatgaggacaaacatttgaagcactcctttacatgttcaagaagtcctccaacattttttggttgagaaatctgtgcctactaaaagtcatccggtcttgcaagcataacaaagctttatagcgaaaccccaaggttttacatacctcaggtccagtagacccaatcaattcaaaggtctccaaatcccaaaacttgacagttttatcggatgaacctgaatgaggcaaacaggagtcatacaatgaatctttagtagcaaagcgtacaggaaacaaaaaagaggcaagcacaacttctgacataaacagttatattcgaacagtgcccaggctgcaaaaatggtatgcatctccatgataactgaaatgggattcttattctacaccaatgaacaaaatatttctaactacattgttgtattgcacacaatttcaatggaggaaaagattataacataccaatatcttaaaaattcatgcaaatctttcatttcaaaaataggtcattaaaatatgcaaaaatatatatttcgcaaagaaataataaccgatgtactgacatagcaatttaaaaaatgccagaacaagacaatttgatgtttggcattgttggacagcaaaaaaggggagtgtattaaaactgccaggactttcacaatatatatatgggcacataccatttatagccataatatggtgaattgcagtttaccatttaaattattttcaaatactactatactagcatgtacagcatatgtttctaatcactaaacgaaggaagcccaagagttaagtataacagactacgctgtacaaccaaaagggtcaaagaaaagttgatgactaagtgtcagattagcattgtaacatctgaacctaacctgttgccagaaggaactcatggggatggaaatctatgcactgaatctggccttcatgacacttgaaatcatgtaataactttccagctgtcagatcccagagctgccaaggcaaacttaccataagaaaaaacaagttctatggaaaatttactgtaaggcaaattcatcatcatcatgttgagttcactaaaggaaaatcaacctgtttgctaaaatcttcacgctagcagaatctaccgcagaatcagcacaacgatgtagtgtatgatttgaaagattattaggcattgacaattcttaccttcacaacattatcttcaccaccagacacaacccagcggccatcaggtgtgaatctaattgcatttacacctcttgtgtggcctttgtacgtgtggatacagcccttccttcttatatcccatatcttcagatttgtgtccagtgaccccgaggcaaagaattctccaaaaggatggaaatcaactgacatgcagtttgacctatgtccagtaagcgtgcggacaactgcatacaaaacaaatcaagtggtgctaatcaaataagataggacacagaatgtagtcagtatacatgcgatagtaaaaagcatttgcattcacatatagacaaggaatgtggtcaggtatatatgcaacagcaaaaggcattcgcattcacgtactttttgcctcctctaaatcccatagttttattgttccactggctgctcctgcggccacgaaaacttctgtggaatcaaaattaacagactccacagcactggtgtgccctgataaactctgtataacaacaaaaagaagttaatcaaataaagtattccatcagctgaaacaacacagatgacacctccagtagctagacccactgtgatcgaacacatgtaaggtagtaggttgacacttcacataaaagtagcccctagttaataaaacaccaacatacagaaagtgatgctggagaagtcgacaagagctaaaatggtgaaattttcatctggtggttaattaaatgccccattgactattgggtagacttacttgcctgttttgctatagaaccacattttacatagtaggcatactagtcagaacaggacaatagagacttaccaaaattgaattgggcttcccaatagcccaaagattaaccttatggtcatctcctcctgtcacgagaactcgtgaagtcttcctcccaatcttgaggcagttgacattggatgaatgcgccacaaactcctctacgccaaacgcaagtcaaggcattccaatgtcgcaagttcacccacaaaatcacccccaaataaatcatgttgcaatcttcaggcagttcataagcacaaagcagcagtaatcccacttgtccgacaatcagacataaccacggtcactactaactagtgatcagcaacagcttaagtgataaaatcgagcaaacactaaatcccccattatcttaacgaggggcaagcgagataaaagcataataaaatgatgggttaaatttgaagaactaaatcgcccagctagcagaatgaatgcgacagtggcgatggatcggtcaaacagacacaatgtacctcgaaaaaaaatacaaaaaatactagtcaaaaatactggaaacgaattcgcgaggatacggagcttgtaggcgcgcttggtgttggtcgtcatggcaggcaggtcgtctccgaacaccgcgcctcgggctccaatctcatctccagatcacgccgccgccacggcgccacccccctcccccg

SEQ ID NO: 80451 - DNA, 14296 bp, Oryza sativa
aggaggtaaaggtggaggggggcatggggagaaggggtcggctaagtcctctgagcaggagcgccggaaggggatcgcctggacggaggacgagcacaggttagctttgccttcgttcctatctaccaaattgcattgctgctctagcctagacaatatttgatgattgcagaaactggcttctgttcggagcctgtacaacttcactgttttattgtggattaatccgtctagtcattgtaaatggaagttgaaattgaaatgctctgggaattttggaaatcgctgtttagacagtctagcagcttcttttggttgcagaactgcatacttgtaggtgtgttgctcttcagctttctttgcactggacaattaggtagctcccttttctatttcttgaataaatgattgcataggagctagaatagtagtttatttaatcgtgaattaggtaccgcttctgtgttgttgggaattttgccgattggtttgtcttgttattgcagcctgtttacgattttggaaattactgcttcagaccccaggaagtaggcttgttggtttgtgtgtgctaggttttgtcccgcatggtttttttatgggtttcaccacttggcagtttatgttacatcctgcatagttcttctcagatggagcggctgattacttgtgctgcatacttgttttcaactggaagtggttcattggagatgttgtttcttccttgctagtttcgacaactccagtaactacttaactcaatcaatttttgaattataaactgttttctaacaataacctattcacgttacttcttatggtggatcctatgcatttcgagctacatcccactgatttagttttaggtttgtttctcatttcttcttgctgaaggcttgtttaattgattcatcttagcatatttcaccttcctcctaaaaggatgagaaaattctgttcatagcacaattcgtaaaatacaactaagctttttctcactctgcttaataccatagcgcatcagttttttgtttgaaaaataccaccgaaagaccaaaataattttacttcaattgcaatgcaacaagacctacctcttacgcattcctgtttgctggggttcctctggcgcgttctccttctctttgttcaatctgacacctccattagctcatacatcatctttaatcacaaaccaacagatcaaacagatagtttatcaaatatctttgtcaccattacagaaatctcctatttcataggtacaaataaaagaaagaaagcaaatctgtctgcttgcatctactttgattttccgaacgccaatgctcaatcccctacatagctccagcagttcatggaatacaaaattaaacttggtcatttggcttcaaagtggagtgaagaacgatgttgtgcatgtgcgccttggcttccagctagaagatcgattagccattgacctgggttaacacgtggtgagccagcaggctagcgtcactggcaagcaaccatacggccacatccaccaagcgcgtttgctgtgtgcaggttggagggacggcaatcaccatggacgtcgctaagcttcgagctcacaggagttggttgagggtgaggcggtggcaccagcaagtgaccacactgccgcgtccagcaatcgcgagcatacaggggaggggaatggcggccaccactagcccgtgcctgccgagaatgacgaaacacaagcaggccccagcagcggaagagggggttagatcaagggatttgaggatttggaggagatggggaattattgttcagtcaggaacttacaagatgggttcgaatcatctaggctcaatctgagggacaattttgtccaaataaactcccgttagctcaaaagatgacggtagtggtatttcccctagaaaaacccacaacctgtggcattatgaaggtttgtgctattttctgaatttaatggtcagcgtgtgtcatggacgaattttccctaaaaggagttagaggaatcaggacaatggtagcttataactgatttttgtccatcttaaatttatttcagcaaaatgaacattttgaacgcatttgtttcacatttcatttttttttccgtatttgatatgctaattttagttgaaattttcctgctagctttagaccggaacaagctagtacatgcttgctgtgcgcatataattggtttttgtgtcttttagacatagtcctgttttcatttgcaacctgtttcttccatgatattgtggacagtatttctggtccaaggagataaaattttgatatcttattggcatattggtaatattgaatgtgttttatcagtatataaggcagtatgcttgtcagatccccatataaaatgatgtgattatcgtgtatttttgtctgtttgaatggctgaatgagtgaaatagacataacataccaagatgatgcagagcatgaaaatacgtttcaagtagaagtaacctgatgccctgatggatgctaatgtgttgttcgttcattgccatgtatgcacatgcatgatattgattacaactcaagtgaaagcatggttgtaaaaatggcacaactaacctccttttgttctgatgcataaatttgtagctattacccctctcttcaggatgagaaatatccaaagttgattaattcatgcagactgccctttactcatatggttattgatgtgtcctaccacttgattttaatttgcaggctgttccttcttggacttgagaagtacggcaaaggcgactggaggagtatctcaagaaactttgtgatctcaaggacacccacccaagtagctagtcatgcacagaagtattttattcgcctgaactcaatgaacagagagaggcggcgatcaagtatacatgacataaccagcgtgaacaatggagatacatctgctgctcaggggccaatcacaggtcagccaaatggcccatcagcaaatcctggaaaatcctctaagcagtctctacagccagcaaatgcgcctccaggcgtcgatgcttatggtacgacaattggacagccagttggtggtcctcttgtgtccgcagttggcactcctgttacacttcctgttcctgctgcacctcatatagcctatggcatgcatgcccctgtccctggagctgtagtccctggtgccccagtaaacatgcctccaatgccctaccccatgccgccaccaacatctcatggatgagggctttgaatactacagttcttctagacaaactcataatatctgtcttgtttagagtttcaatgcatgctgttatgtctcaataaagcaatatcaataaactcttgtacattacaaatggttattgaatgtagcattttgaggacatcctggactgtatttatcatctttgttacgcctgcacttcgttccatcttcaatgtacgcctgccaccctgccccagtcgtaaaatggttggaatgctgaatctccttcagcccagatgtagtggtttattatctgaaaagtaaatatcgagtcaatacgtaatcatgaacatatgtaatggttcagtaagtatccgactatctgattcgtaattatgaacagatgtattggttcactacctgattcgtactagtaatgaacctggtgcaggtacaaagagatcgaaaccttgccgtgctgctctaactccatttttgttgcactggttatttgcgtcacactaataatcatggtggtcgtacgtgacgtaataacgtattatgtcgtcagtttcgctcttatacatttttttttgtctgacaagtttctgctttttaagagcgtgccaactatagcagaaaaaaagaggcagcaaatcctggaaaatagcaacgttttacgttacattccgagtcatttccatccgtcacttcctggtttgggaggtgttaccgttaccatcctaatttaattcctcctaatcagtaatcacccttgtaatcaaagcttctatgatttaatcattcgtgtgaaaccaatcgtaaaaccccaatttggttattagcattaccacgatcccattggcttcgtgagagacgcgattgcaaaccgaacggtcatttccatccgtttttattgttttttccgctcccaacgggccgcggcccacgacatcaagaaagcttctcccatcggcccaactcctcctcccgatctcttctctctctctctctctctctctcaggccaagcgcgacgaggggacggcgacgcaaaccacaagccagcgagcagccggcgaccaccgcgccatcaacggcgttcgagattcccctggagatcgccgtggtgagaactcgccaggtatgcgtgtgctcctctaccctaaaccctagcccgatctcctccggccatcccgcctagcgcgaccaggtcttccattcccgcgcgcctttccgctgcgtcgagtcgacgccgccttcctcaaccagcaccgacctcgggccgccgccgtctggtcgctttccgctggatcgctgcatgttagatctgggcattccagttcttgaattttgtaaaacaattttgttcttgatgatatgatactgatcaagtgcgaatccgccactttggctcagctgcaaaacccctcactcatttcaaataatctgatgctgcatttttactgtagttgatttacagtttttttaatgtgtcgacaaaggatattttatatcaacaaaggttagagattatgtcatattttcaaaatgcaggaacatctctgtcaatatgatttatcatttgttaggcgattgcagcatccatcaagctgcaacccactcaacacatccgtataccctttttgtagtcatctgaatttgataactctagaatggtgaatagtcatgttagattgtggttcttttaaaaaaaaaaagttagattgtggttcactggtttcagtcttaatatgctcaagccagaatgtacttgatcatccaaaattccacatagtttgatttgtgggtaacttaatattgtaagtgagattcttatctaaaactgttggattaccatagtacatgtcttaattttggatttggtaaatcacataattgtaactttgtaacgattgagcatgctggcggtgttggttcttttcatttggtttttttaactatattgcctacaaaattttacggaagcattcctgaataaagtttataactatagatattcattttcttatgatttcagcatgaatgcgcaaagcaagtttcataatttgtctgtcatgtttcaggatgaatgtaacttatgaagcctacaaatcattgatgtgattttagcttagctcagatcaggattgtggactgtaaaggtgagcattcgtggaagattgtttctatctcattcaattttgaacaatctcacactgaattttcatgtggaggtagtgtatatgcaataattctaacagtttctacctatttatttatttttttaaaactacaattgatttattttcaccttgccttttttcttaacagtgtaacagcaaagtgagctccctttcccagagaagatttttttggtcatctgttcccctacaaaaaaaaaaaatcccccaaagtgaaccaagtcttcgaaatcaaaagagagcaggagggggcacctaccccttcaagcccacggctacttccaccatcggtccatcgtctctcacactctctcactctctaaacagcacacaaggcaaagctgcgtgctacgtgcgcgcgcatggctgatgctaggggctcctcttcttcttccggcgatggcggtggcggcgagggcaagggcggagcaggccatggtgactttgtggggggcggccagcacaactggtaccatgggatccttggggccgtgccgccgcccaacgttgggcgacaaaacatcgtgcaccatcagtaccctgctgctagcttgatccagcagcaccaccagtcgccaacaatgccgctaccgatggcgcagctcccctacgtgccccaatacaccgtgctgcctacgcccgccgtgctcccgtcgcaccaccaccaccacggccagtcgcagatatctcaaggttagttctctcctgctccacatacatgatactccttccgtccctaaatatttgacgctgttgatttttttaaacgtgtttgaccgttcgtcttatttaaaaacttttgtgaaatatgtaaaactatatgtatagataaaaggtacatttaacaataaatcaaatgataggaaaagaattaataattatttaaattttttaaataagacgaacggtcaaacatgcttaaaaaattcaacgacgtcgaacatttagagacggagggagtacatcttaattttctcatggctgaatttggcacgacagatcttttcccccatagggtttttttctaggtcgttctagggttacttatgtgcacgcagagatctgtgtgttttctcatggctcatgctacctagatgtgagacccggtcttgcatttcttgccctcgtcagtgttattattcctgccaacacttgatgcttcatgctgtttattctttagttccttctcgcttgtctcccaatatgacctatcattaataattttgtttgatcgttcttcagaaaacttccaagactgggttccctccaacaatgttgcagctccgcatgttcccagcgcttttcaggattggaggcaaatgtgcaatgggtcggcattcatgccttttggccaaactgctgccaatagcaatgttttttaccagaatctgaccttcaattcatggactagcaataacatgccgaggaaccctgtctacactagtttccaccctgctgcaattgaggatcaccatgctcctctattccatagcaacaatcatgacatagacccaggtacatatatatgcacgcatgcatggtctttgacaaatattaaatagaatatgtacatggattgatattctgtgcaattatatatagagggttagaaaagggacattactacattagggtaaaccctcagggctaccaacaaccctgggagagtaggataaagtgagtgtttatgcaaagtgtggaatggggatttgaagtagaaaactgtagtggttgtaaacggtttgtctcataaaccacttaccctatttagattagttgaatacgtaattgatatttaagatgattgttcctgctctaccaatatgaacttcgcactgtctcgtgcgagtcgttaaacaaaaagatatttaagatgattgtgctataagtaaaggggatatataggttatttcctttgaagatttaagggcatccacaatgtagaaattgagggggtcataagctagacccttaagttctacatatacattgtggagatggttcttacagagtttttgggaaaccgacacttgcatggagttgacatcgccggagctccacccgcaaaagccacctcacctgccaccgccggaggtctgctcacgaacacagcccctgccaccgtgtcacagatccatgcgagatgccgccgtcgccaaatctaccgctgctgtggccttcttccgcgagcacctccaccatcagatccgtgtgcgttcgcgagggccaccatcaccgctgccagatccgcccgcggcctcctctctcatttgtacggtggcttggtgttttggcttgttgggaaaaggaagctgggggagaaacgagagaggaagagaaaagtggtggctgggatggtaaatattattgtattgaaatatggggcccaacttaataactcttcttgctatgtacatcataatgttggatcgcgctcctctgacgtaaagtcagagggacgtgggtcactgacgtgtgggcccaacctttgtgggtcctacatgtcagtgacaaagtccctctgactttacgtcagaggagactcatcccatgatgttatactttagttgggcccatttgggacccaccataaggccaaggctgcgttggatttaacatttggagatggattttctaccgtatgcaaaataagacgggctattagcgcatgattatttgagtatttattattacaaacttgaaaatagatttatttatttttttaaagaaacttttatatatataatttttgcaaaaaaatgtaccttagcagtttgggaagcatgctaacaaaaaaggggaagttgtaatttaaagttagaggtaaggaggccttaagccatatatacacacattgtatttattaattcaccatgcatttcatgtaagtatgcaaatatatatggggaaactattttgatcccttgaggatcccctatatggctgtgtgctactacttttatgcattgcctcactctaagcatcttattatgtgcaggcttttaggctaacttttttctttttttttggagataggctttcagactaacttcaggatggatcaagcatttgtacctgcttcttcaccttttccaccggtgtcatcatcatcccatagtttctcctcagctaaaatttcaaatggaccaacatatactaagaaagccaagaaatcaaatgtaaaagtaagactcttttagaactcgttgatagatttcgggttcatatgagcagtcctaatgtgagatttctacaggatccaccaattgtcttcagaaggagcgatatggagagcgaaaaaaacgatgataatccagatcaaactccggttagtgagcctccaagcatgaatcagaacggtgaaaatcttattattgtaagtaacacaatgccattcatcttgaatgctactattctctattagtacatgaatgcatttttaactgttccattattggtagattaaaagtatcattaacaattggtagattaaaagtatcagtaacaatttcattactttttaggataatggcaactattccacaattttttaactaaatgattctacctttagcaaggaggattagattgacttcaatcaattcgttctgcatgtacatcattatagtacgcagtcttcccggggacactaacttaaatctgaactaactctgaacttccaagcagagattcaactgtagagaataccgtgttatcttgcgcaaggagttaacaaacagtgatgttggtaatattggaagaatcgtgatgccaaaggtaaaatcttgtatattctcttaattaagtgacatcaacatattatattctacaacagatactgttctagcacgaaccacacaactactgtgcgatatatttagttatgaagtcttgagagttgagtgtgattttatttccttccaaattttgtagagggatgcagaggctcatcttccagcattgcatcaaagggaaggtgtgacgctgaaaatggatgacttcaagtttgaaactacatggaattttaagtataggtaatccgatcataatatcatattactagtctagggaattgtgtacagatcaccagctgaagttcgaatattatgtctgcaatgatgtagtaacactatgatctaattctatcctattgtgagaaagtactttaaattatatcaagtgcacgtgacatcatttcttccatgtaacccaataattataaagaaaatcttaaacgtagaataagatagattatgctgttatctattggtttacaaatatacaaactcaaatgtgatctatacatggaaaaaaaatcagactatgtaaagtgcaatcgcatttatagtctagataatatgtcaatctgcttctatctctctagataaaatttgaccttcacatgtttgtggagcaatagatgattgtacaataatcttctttgttagttttttttcttcaaagtttttcgtaaatcgtaattatctgggtcacatgagagaaacgcgaacatatatggcttataatctgcgtcacatattactgatataattggagatacctttcaggttctggcccaacaacaagagcagaatgtatgtcttggaaagcaccggtacgtttaaacactgaagcatatacttttggatttttctaagcttgtactgaacttgatggattgctctcttcaggtggttttgtgaagcatcacggtctccagacaggcgacatattcatcatttacaaaagctcggagtctgggaaatttgtatgtcgatcataaccacaattccttattcatcatttacaacctattggatttcttgtttccacacatggctaatcttttcaaatgtatttcctaaagttgtattactgttgtatatgatatagtatgttgccttatgcctcttttgaaggttgttcgtggggagaaggccattaagccgaatgccatcatgcctgttgtggactgcagctgcaaaaatgaactcaacaaaagcgaagaatgcgggttcaccatcagcctacagaccaagaaaacctgatggaatggcagcttcaggtcttgacttaagatcagcataagagagccttattagaaggcaatgcatgttgtcatgttattgaagaaatgtgataatgctccacagtttttaactttgtagataaaaatgcaagattgtaaattattatttaacaatccttatttttgacaaataatggtccacattagagattgcaacagagaattagctagaaactctctttaactcatacatgaaactctcaaggccatgaatacaccatcttatacttgcaacatacagagcctatatagcagttccatacttcgcaagtcgttaatgacaaaacatattcctccgtcaaaaaaaaagacaaaccctatgtttccgtgtccaatgtttaactgtcgtcttatatgaaacttttttataattagtattttcattgttgttagatgataaaacatgattaatactttatgcgtgacttgtctttttaatttttttcatatttttttaaataagacggacggtcaaacgttggacacggaaacctagagattttctttttttttaggacggatggagtagatgcattcataataatctaacaatatatattttgtatcctatatcatacaacatcatcatccatcttgaagtctaggtcttttttttttgtaaaatgggtttttataactgaaaaagggatttataaaattaatttaagagtgtgccaactatatatagcaaaaaaaaagcaaatcctgtaaataagataactggccccatccttgatgatctctctggtctaggtgagctccgtgccatttacttccacaacgtacggagaatccgacggtgaggactacaacggtgatagaagcggccccggtgccggagaggtggccgacgaaggtgtgcgggatgccgagccgacacctcacacaagcttttgtatggaggcctggagagaggggggagaagtagaagaagattgggccagtgacatttgggtcacacgctgactcagccgccacgtcagctaaaaccgctcttaatactgtatttagacctaatgtgacctggttttataagattagagatatgttatatcttacattctggttcaaagacgtttttaaaacatgacgataactcgataagagatctcaaagtgaactttttcctcctcctagtcatccttctaagactgcattcggtataggaagttcccaacccttctccctcgttttccgcgcgcatgcttttcaaactaataaacggtgtatttttacgaaagttgcttaataaaacatatcgatctattttttaaaaaaaattagctaatatttaattaatcacacgttaaacgctgctccattttatgtgctaggggatgagggttcccaacactccctcccgaacgtagcctaaatgtggtctacgactctacatagtgggcccccacaaattccatggcccatcaacttttggcccagaataggcaatggcccagtgatgctaccgatgaagcgatccgacgcgcccgcattccccacgctgctccctattccccattccccccacgcgacagtggagacgacaagtgaagcgatcgccacaagccgccatccgcagcgccgactccgacgccggacgccgggcgccgcgtcggcgccgagacgctcacgccggccggccatcacggtatagccaccaccgtgtccggcatccggccaggcggcgcaggcggcaggggaaggcaatgctctatatactttctctccatttctttcttatattttaatcagtgtaaaacagtagtaggatttgctgcgttctctgtgactgtgattatattaacggcgattgttttcttcagatttcagaaagcctgagtttggttggtattgttgcgcgaagataaacaggaaagaaagtgagatcagggaacaagtgtctaaggagaaagtggtatgccctattatatggctgaaaattatctcatctaatagttttattgtattcttagaactccaactgaaaccttagagactaacaatggttacgggcttacggcaagctatcaaggaattattagataaattaaggatacaatcatacaaactacggtgatttgctagttcaacataattattggtgatatgtttgaaataaattagggaatgatgtaatcatcggtaatttggatgtttatactaagggctttaagtgttcattgatacttcctccgtcccaatataagtgcaattttgcactattcacctccaatgtttgaccattcgttttatttaaaaaatttttatgattactatttttattgttattagatgataaaacatgaatagtactttatgtgtgactaactttttttaattttttcataaaattttcaaataagacggacggtcaaacgttagacacggattttcattgctgcacttattttgggacggatgtagtaattgttattatttagatgtttatactaagggttttcgtgttaatatttagaaatgtagacctagtttgtcacctaattatttgtttctcaaaaaggataattggtttatttttcactcgccttgccttatttttatcagtgtgaagacgaggcgagctcccttttgggagaagattcctttttaggcatatgcttccctacaaaacttccccaaagtgaacctggaggagattttttttttggcgagagagagagagtgggaggggcacctaccccttcaagcccacgaccacggccgccgcctcttcttgtgcacaaggggacgttgtgtgcttcgtgcacacgcatggccgacacgagaggctccacttcctctggcggcggcgatgacaggggcagagaaggccacgatgacttcacagggggcggccaatacaacaggtaccataggatccttgaggccgtgccgtcaccccttgttaggcgtgagaatggtgtgcatcatcagtaccccactggcctaatccaccacccgtcgtcgacaatgccggtggcgccatgctcctacgtgccccggtacaccatggtgccaacatccgccatgctcccgctgcagcaccaccaccgccaattgcagatatctcaaggttagtcttctcctaaccgccatatacatcttgttgcaccacgatcatctgcacttgttgaattcagcacgaagatattttccccatagggcttcgtctaggtcagtctagggtttattgtgcatgtggggcctatgttttttcatggttcctgctacctacatataagatccggtgtctctcttcccttgccactgttccttgcatgtcaggtagggtttctgtctcattagaatcacgcatgttcttgtgagcataaaaatcattctacagtttgagatccactgcaagtctgcaacaacatggtaactaggatcttcaatgtaattcatgtatgttatacatcatcttgcatttcttatggtcagtgacgacatatatagatagcaattatgtacagcatatatataccatcttgcatctcttgctctggtcagtgttactattcctgcttattctttaattccttatcgtcttgtgtccttatatgttatttcatcagttttgtttgatttttcttcagaaaacttccaagaccgagttccctccaataatgttgcagctccgcatcttcctagcaattttcaggatttgaggccaatgtgcaatgggccgccattcatgtcttatggccagactgcttccaatagaaatgttctttatcagaatctgacgccatactccttcaatgcatgggctagcaataacatgccg

SEQ ID NO: 80452 - DNA, 10054 bp, Oryza sativa
acaaaatggttggagctcagggcttggccacccctaaacctcatcattagtgcatggtacaacatgctttcctcgccatgaaactgccagtgttatatcctttgttttttccccggttctccatgatatatccatccgggtgggagatatacttcatactagtagtacggagtatgtacacgtattcgtcgtacagttcttttgcttttcttgtgcacagcatcgcatcgtgattcgcttgcgagctgctcatgtgaatttctttccgctttgttcgaggagaggacggacgaaatgtgtaatcgtgaaagaaaatcttctttccgcaaaagtaacattttcatatgtagtaggagtagtccagtgcagactgcagagcaattgtgagcacatttcttcttgtttttttggttgtgagctcgcacgatagagtgcaatgtattggaggagtagcagcaaagcaaaagcgagtggcagaagggagggatatatactcctacactgcgtgcactgatgctgctactgttgcacgcgtaggctatagcttagctgaggtcgtaggccgcaatttgaggcagtttgagcaaagtgtatcgtggcatgcagaaaccgaccgatccatggctttggcttttgacgaagggggtgtacggatggaacacgggaaggaaaaggctttggctcaccatcaaacacgcacgcgccgcgccgccactgtacccagcattcactccacagaaacgcatgctatgaacagtaccagactgtgtgactgtacgcctgtacgtatcaacatggagcaccataccccccacgttatacgttccgcatttgcagcttgagaggtgagaggacaactcgcattgtgtgcttctaaaaatccgctcggtacatccggcaacatactagtaggagcactgtattttggagcggtgtattactgtgctctcggaacttcttttttttaaggtaaggttggggatagcctgtgttgtttggtactagtactagtagctattttgctcgaatatcagaaaaaagggagagaaatactctgggttttatcttggtgtcactggtcaagaccagggtttacgattctgacgaaatccggtcggatttcgcgaaatttcgacattccgacgagggtcgaaagtagaaactgtctgagattttgaggagtttcatccaaattcaaatttgaattgataaaaaagaaaaaaaaaataaaatctttaaatactatgatattcatagaatctattgggatataaatattcggaaaaaaataatgtattgtgtgtatttactaaaacttacacaggaaagaaaagaataaaaaattaaaaaaggaaaacacctatagggccagttaatagttgatccaaattacagattactgatcaaaatttcgatgattttgattggaatttcaccaaaaccgaccagttttcgagaacttgtcagcaaacttagataatttgtattcaaattttggtttatgaaatttattcggaatttaccggttttccaccgaatttcatgaaattccgaattctgccgttacccgaaacgaaagggtctgtcaaaatcataaaccctggtcaagacacaagcaaaacattttgttgattatcgatcggttggattggtttgaaccggcacagcacagtacatttctgccgatgtgagaggcagaagtgttgtggttgggtggtgtggcacgcagcggcaattcgcatgcgaatagcgaggcgtggtggtgaaaaggcctgcgcggttgtaccatgattacaagggggagctcgtacctctcgtagctgctgcttttgattccctctgacggtgacgtcatgtgacacgtcctgtctcccgagtggcgtggcgtgggccccgcccaccgcaacattcccgggattctgtctcccgctgctcccgccaacccggccccaccctctcatcacacacagttgcagtcaccgttctcttcgtcgtcgtcgtctcgcaggctgagacacggcacgacagtctcatgcccgaccgaaaatcctcgcatcccgacggcgacggcgagccgttggatccaccatccgacggccacaaacgactgcagccgaaacagtgcccggccgtacgcacatcggagtactacagtatacagagaaaagtacgtgtactgtacacttggactggtacgaaaaaaagtttcacgcctgcactgcatagctggacctgttcgcctgtggttgtgtgtggttgccgatgcatgcaaaaatacaacgcccaaatgcattcggtgcagtcgtttgtggcgtgtggtcaagcttgcttggaaaacctgtctctctgtactgctcggtcaagcaggctccgtacgtacgtacatgctccagccagtacatgaggctgtactcctacatggaaggcgtcttcttttggcacatctatcgttgatcgatcggtcgaatccgtcgttcgacgccatggtgatgcacaagacgacgacgcgtgtgtgtgtttttgtgttgttatgtgatgtgatgggcctcgctgagactgagtgcgtctgtgtagtactacgtgtgtgcatgtgtggagcgagagctcgagcttcctgcccgagacgacgagatatggatcggaatcggattccatgcgccgcgcggcgagcgatccatccatcgacgcgacccaagaccgaagcgtgtgtgcgggtgtgtagccgcgtcctggttttttcggctacgtcttgtatgacatctgctctgctcagcctcagctgaatcagtactagctcagcacaagattcctgctgcctttgtcacaccctaaaaatcctaaatatataaattgttgtttaattgaaattattagaatttattttaaaagcctagaagagaagatctaattttaattaataaattccaatataaaatagggccagataaaatttcattaaatactttgcttaactctataattcctagatttttctgggatttatttgagctaaggaagtatttttaataaatagaattacatttaatgaataatttaaattgaaaaagatttttaaaatcctcttttggcttcggcccaaaaccttctctctccctctccccggcccaagccggcccagtccgcccgcagccgcccgcccgcgcgcgctcggccgctgacaggtgggtcccacctgtcggactcgtcgtcctcatcgcgccgtcgcccggccggaaccctagccgcgccgccgccgctattccaaatccagccgtccctttccgtttccggtgaaatcaattgaggggaaaggatccccatgatccactctacgttttcccttttggaaacatcgtctaaatcgctttggaaattcgcggattcgatctcgaatcggattcgtctctctctcccgaaccctaatctttccatcgcgtcgccggtcgccgtgggccttcgccgccgcgccctagtccctatttaagcacccccaggtcctccgctactcgtcgccaccctcgccttcgtctctcgtcaccggtagaaccctagcaccgtgtagcctcgcgccgccgtcgtcgccgccgctccagccgtgtgtcgccgtcgctccagtcgtcgccgtagctcggggaggtcaccgtcgtggtcgccgtctcgtcgccgtcctcgtccgccccttcgccgtcgttgtcaaccgccggagcaccgtcgccgccgtcgacctgatcgtctccgccgccttttcctcatcgccggcgccgtccgttgcccctccgccgctactttggtcaccggtgagttcgccgtgccgtccgctaccagtaggtgccctccgttcgcgatgtcgtgccgtcgttcgccggcgagcatgcacgcccgagccgccgccggtggtgacgtcaccaccgacgtcatcgtcgtcgttccccgtggcccggtcgtggaccgatggatcttggccgtccgttgtggataggatcgatctcggccgttcgtttccgtgagctgccgccgtgcacccgattcaccgcgaaccctagccgctgacgcaataattcccttttccttttcaaaaataattcattattgcgtcataattcaattaaaatctaaataaatgatttaatccgatttaatctttgaaaattcataactaattcatcttagctcggatttagttggttcaagtctctaattttttctaaaatagagatctacatgttaaaaatatccacattactgttcatgcttgtttatgtacttttttggtgtttttgctcttttctgtttagatcccgacgtttccggagagtttgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattgacctattgtttgttatagcccttttgttcttgattactttattccttgataccttgggttattataacttgactagttgggctatatatattggttcagctagatattagatatgattgcttagccatgcttagaaacattagcacactattgggttgacttatgactcactattatttaacaatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcctacgggggtcgctggggagtccatgccttgtttataagggggtgattatgatctaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggctagagtaaaactattcgaatagccgtgcccgcggttatgggcgggtctaacaatgtctttcgtgattagtttcacacttctcaccataataaaagatgctataactggtaataatttgtttagctcttggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgacccctatattatgccattctttggtatccttgtgcacttgcatatttgctgcgtggcttgctgagtatgtcatatactcaccttgcaatcattcatcagagaaagagttctacagcgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttattattgtgtgcctcggctgattcctggacgagggttcacacacatgtaagcgtttggaattttggatagaaattccgggcgtgacaagttagtatcagagccccttgaccctaggttatgccaaatggttacccatagaagccctctaaaaatattggaaaagtagaactgttctcctccctttctcttttaattaaaccaaactaatggcacatgcacttcataatctcttttagtggttctcattcaaaatttattccagtgttattagtactgtacatctattactgtactaatggctcatttaccagcaaatgttttacaacattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttataactttattcaaattaatccaaaaacttgtgctattaattggataaatatcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggccgacactgagtatcgctaccatcctcgccaaccccagggaagtgaccgtggcggctaccttgagactgaggagattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttggaaaaggaactagccgcgttgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaatgtaagtgatgatgaaggagaaaaattgaagcgcacccattcaaaggtcgagtggggagctactcaagatgatggagacgagccgaacgagccttcaatcaactccgatgcccggaagacctagagtgccttgtcaagccgttgtcttagattgttgtgttagtttgtttgtttaagtttggttgtgtgtgtctcgcatgtgatttacatcagtggtgggatgtaagtgcatgcgtttgtttgcttttgagtgttaggaagttggtgagtttggtggtgtgagagtctttagttttgtagtaatgaaactcagttaagatcaataaaagttaagttagtagaaaaattaattctctgtcctaagtagttttccccggtttctcttcttgtgatcctacccatgccagatggtgctcactcgcagcaacgggaatggccccaacatcaacaataacaacaacaacaacaatggagagaatcccacacttgcccaagtcctggctcaacaggcacagctgatgaacatgatgatgcagcaactccagaaccagcagaaccagggaaataaccatgcacctccccagaacaagttagcagaatttcttcgtgtgaggccgcccactttctctagcaccactaatcctgttgaagctggtgattggctgcatgccatagagaagaagttggatttgcttcagtgcattgatcaggagaaggtctcatttgcatcacaccagctgcatggccctgcctctgagtggtgggatcacttccgccttaacagaactactgctgaacctatcacttggcttgaattcaccgctgcgttccggaagacgcatataccatcgggagtggtgtctctcaagaagaaggaattcaggtcgctcacccagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttcttcgtctgttgttcgtccgcagcatcagttcttcaacaacaatgctggcaacaacatccgcaatcaagctccacgccctgttgcagctccaacacagcaacagcctgccaagagggagcaaggcagcaagcccggggtgtgcttcaactgtggagacccaggacattactctgacaagtgtccgaagccccgacgcgtgaaggttgtccctgcccagaacaactctaccgcaccagcatcaaaggcccgtgtcaatcatgttgctgctgcagaagctcaaggtgctccagatgtgattttgggtacgttccttgtcaactcagttcctgcaacagtgcttttcgattctggtgctacacattcatttttatctatgagttttgcgggaaatcatgggatggaagtagaagatcttagacgtcctttgatggttagtaccccaagtaataattgtactctattatcaatttgttattgtgtgcctcggctgattcctggacgagggttcacacacatgtaagcgtttggaattttggatagaaattccgggcgtgacatgcctcgtaagcgttaccattgaatcgagattgttttcagccaccaggaggagcaactctaagagtaaggccattcatagtggacttatatgacattcagcctccaataaaaaatgaatattccttgccacatccttaaactgtgtagctttattaggttcgcgtagccaactttagctactcgttcctcgtctcaaggcgggacccacactagggcttgaggagagagaggggagaggggcgaggtagccgacggctcggaagaggaggggagagcgggggaggagaagaggaggctagtgccgccgtcatagtcatcactcgcgctcgacggggcggcgtcagcggcctgcagggagagacaaagattgggagaaaggaggaaggaaccatcgtcgtcgccaccgttcgaggatggatctagcgagctcaatgccgccctagtctaaagaggtggatatggcgagctcggcagtgccactatcgtcatccaccagagaggagagaaagacccagcaccgtctcctccaccgtagcgaccgaggtcaattcgtcctcgctcccgtgctgagtccacgccgtggacctcattgacccccgccgccagattcgcgccaccaacctcgcgcttccccggctcctgtgccgattccctccgtcgctcttgccgcgccgtcctctcgactgctgctgaagcatctagacccccggtgttaattttggtaattaatgacaagcactaattgtggactaaccgttgtctttgagctatacattttaagttaggtccacgtcatatgtgcgcatggatgattatcgatggattaaaattgacagcgcaaagcaaagggaaagaagacggtaaaactagcgctttaatttagaattgatcgaggtgtagggcgatctaatttgctagtttaattttagtttcgccgtactattaagaggggtaatgacctagcaaagagatgattttaattgccacattaggtcattgcattttcatttgtgctctctttttcattacacacacattcacttacaaattcactgggttcggcctgaccaggggcggtcagaccggccacatagtggcggtctgaccggcgtgccctggccggtcagaccggctacatagtggcggtctgaccgatggcactttcccggtcagaccggccccctaaaggccgagatggtgctgctcgggatggccgatacagagccgacggagccgtattcggtcagaccgagccgatggtggtctgatcgagccgaggccggtctgaccggccaccccatgccggtctgacccgccagaccgatgg

SEQ ID NO: 80453 - DNA, 10008 bp, Oryza sativa
aagtatcgagaaagagaaacgaatctggatctaaacgatagagcaaagggcgtttcggtcatttcatgtgcgaagtctggtaaaaaaatataaacaaaataaaaaaaggctcaaaacagtccaaagtggcattttattaggctgtatcacctatggagtggcatctttataaggtcatccatagtgggcattctgttaaacccacatctatggagtagcatattgttaaattcctccagccatattaggggtctgttcgcttatgctggttgggagcagtctgggggtgttgggaacacagccacacggggtactgttgagtactgtcaagtcaagggtggctattactatcgacatgtggacctctgacaaccaaaagagaggttacatggctatcacaacacatttcattgatgaatcttgggctcttaggaatataatcatgaggtaactattgtcaacatcaatatgattgcatctactttgtaattttgtgctacgaatctgatgtcatatattgtttattcaaatataggttcatttatgttccaagtccccacactgctgaggttattagcgacgagctctatgaatcattagttcaatggaatctcgatgagaaggtatccactagtacacttgacaattgcactacaaatgatgcaacaattcctattcttgtgagaaagattggaaaaaccaagcttattaatgatggaaaggtgctacacatgcgttgttgtgcttatatcctaaacttaattgttaaggatggattagaacatttgaaagatgcaattgagaacattcgtgatagtgtagcatattggacagccacaccaaaaaggatagaaaagtttgaggacatagctaagtttttgaatgttactatcaccaacaagttagctcttgattgcaaaactagatggaattctactttcaacatgcttagtgttgcattaccctacaagactgttttcactagagctagtcgtgtggataagcaatatgagtgtgaaccaactgaggaagaatggttgtttgctgaagagaaggtggaaaaggcttaaaatatttaatgatattacagaattattttctagaactgaatatgttacttccaacatatttttccccaaaatctgtgagatcaaacagaaaattaggctatggtcaacttgtggtaacagtttggttgaagccatgtcagttgatatggtagagaagtttgataagtactggtctgacattcaaggtttaatgggtattgcaactctctttgatcctcgattcaaatctgaaatgttgtatatgtgctttgagtggttacttggtaaaaccagtgctctttgtgatgtggaggttagcaaagttacaactttgcttgctactttgatggatgagtacaatgtaccagaggaagaagataacatagaaccatcgacattgtcacttggcagtatggaagtcatatcttcctttagtgaacgtgttgccaggaaaaggccagcatcagttaggttccaatctgagctagatcgctacttggatgatgagttgatcccaatatcaacaaaagacttcaaggttttggattggtagaaggtggctggaacacgttatcccactttgaggaggatagcgagggatgtatttgctattccaattaccattgttgcttctgaatatgcttttagcactagtgggagagttctcagtgaacatcgaagcagacttatagctgagatgttggaggctctaatgtgcttacaggattggattagaaacaagtacaaaggtaaacatcgtgatgtgcatgtcatattatgtttttgttcactacaaactaacaccaaacatttgtttttcctttcagttcaacacaatggagatcctactagcttttggtcttgtctgcaagatattcaagaaggcttgtaggtactagctgaaaatccacaacaacatctctctttatcaatttactgatttccttgtgccctttattttccatttatgacttatccaatagctaactagctagtttgtctacccatgtaggagctgacactttgattcaagatgtcaaggtgtgtgtacctgctggtgtgaatctctgacaagtgcatatgcaaccctttttgttattaggtatacttttgattgtaatggctaatgatggacctatgaattatctgtatgatgagggctgatgactagggactaatgtattttgttagactaatgtgatggacggatggagtgatggttgtggtgatgcacttgtgcacttttgctacccaacatattcctataagactctacaacatgtgacattgtggattggcacatgctaattatgcttatcagttgatgtgatgaacaagctaagactctacaacatgtgacattgtggattggcacatgctaattatgcttatcagctgatatgatgaacaagctggttggtaccatatgttatgtaatgagtaatgatctatgatgagttatcagattgttcactgatgcaaccattatcaatttattgttgctgctgaattatggtgatctagtgaaatgcttcatgggttatgtgcctgctgctatgctactctgcttcatctgctgatctgcatgattgtcgggtgtggggacccggcgggtgcgcaatacccgcatgggaacgaggatggggaaggtgacgggagatttttctgaactcgggggcagggacggggtggttaaacccggcgggggcagccccattgccacccctaaacacggggtactgttgagtactgtagctgctacagtactttgcagacggacgtctggaggcattaggcacggcatttggctgccaacagcttccgtgaacaaaatggtgccgtgcgcattgagtgctgtagaaggcaactttgcagggcagttaagggggagctgctacgcgcacacgatcagcaggtcgatttgctacgcatcaccatttgagaaggaaatatatgctatccattgacgtgtgattacatgaatggtgtaaataaacaagtagtttgcaaccaaggacgttggggaaccaattggaaattaaagaaagagctgaatgcttctaaatcatggaggaggagaaaaatagataaaattcactagaatatgtggctttcataattggccggtgtaaaattacaaaaccacatgaatagtaaattgcacatatatttgttgcaaaagatataaaactatggagacaatttttattaacggtgtaacatgtatgaataaaattcaaatgtggtactactgtgttatattagatagctggaatcggactgcgaaataaaaaagtagtactatagaagcaattcatgttgtattgcacaataaatggctcactccttacatagctgttacgaacagcacatacaactcaactccaagagaaagcacattatgctgctacacaactttgagagcgattataaacctcattcgcaatgcattcacgccatatgctcatcgcttcctcgctgtttgttgcgtagtacatcacattgaaagatgcctgctgtgtcggaatgggatatctgttgtacggaggattagtgtaaacgcagttcacatcctaacaataaccttcctaaaattatgaagagcaaaagcaaaagcagcatgtatgatccgtggtggaacactggcatctcggtaaaacgtatctctttgagtattttccaccgctttttaatgatgctgaaagttctctccacaatacctcgcaaagaggagtgacaatggttgaagtgctcttctcatccttcgagtggcgccgctcctcttcgtcccagtcgatccctgtgttaccgtacatgtggtacggtgcaagaaatcccatcctgctaggaaaaccaaagtccacaaatagataccttcctgttgaacatattagggaaaattaattaaatcgcactgcaaggttttaaaatgtagaggagtgtgcatcccgaagtttgtaagtgaacaagttaagtgaactaaccatacggaatctgtgggaaatcatggggatagtgctgcacagcctcattcagaatcctttgatcgtaaactgatcctagccatccgaaatcacagaaaataattctaccatcatgatcacagatgacgagaacatttttcgtcgtgacgtggtgtctgtttatgtgttgcatcgtcgtggccgcagaagtcacaacagatacgtgggttccgtcaactgcacccacagactggtaaaatggtttgtaccattcctccgtttcaaacattcattgaaatgtactgaagttgggatctattgatttcaaaatattccctgccaggttgttcaaagcttccaatacttcagcgaaggaaatagacacgattgagttcgaccggacccaacgattgttagcgtctcttgttggacggccgccagccataatgaacaagaaaatcctcagtttttctagtgaacaattcccgcctatatcgacaagtccataagaagttaccaggaggctgtgcaactgtgtatctcgtcagcggtcagccggaacattgcccgaacatttcccaaatattgtccagcatccaactaataccagtctgaattggaatttggttaggtgctctcgcatttctctctaactcactgtccaacaggccgatgatggcatcgtcctcctcgctgctgctatggtctgcaggctgcagcccagccatagggaccggcaccgctactcatcgccgcaatcctttaaagaatatagcacccgaaaatggataaacgtagattggtcatgtaagtatgaaatagagtaatagatgtgaacatgatggaatataatgcgccaggaccatataaaaccaagtcgcaccaatttattttaagcagaaaataaagcataacacatgtatttaaccaaatgaatgttcacgccgaaagtgatgcatacactctaggggtgaaatcgggtcgggttaggtcagatctcatccgctggtggagaagttctttttagtcccggttcgtaaccctttgtagtctcggtttttcaaccgggactacgaatccaggactaaagatcgttatctttcgtcccgagagaattaactgggagtaaaaatccatttttagtctcggttggtgttaccaaccgagactaaagatagagttaggctagctagatccggttgcttcattatttttttcttttcttcattgtttttaatatattgagttcactccatccccatcccaaaatcccaaataaattatccccaaatcctcaaatcctcaaatccccaaatctatcatatccaaatacatcacaaaatcttaaaaaaaaattacatcacaacttctacaaaattcatcacaaatacatcacatattcacatcacacacaaatcaaatacacagatccgaatcacaaattctcaaaaaaaaaagaaaaaaaaaacacccgctgcggctgcggctgctgcgccgctcgccgccgcgaggccgcccggccctctgcccgccggtgcgccgccgcgaggccgccggccgcccggccctccgcgctgcagatgagaagtggggatgatgggggagggaaaggaggagaggagttagaggagaggaggaagaggaagagatgggaggaggaagagataaggtcagggaggaggagatataataggttagggaggaggagatataatcgaaggaggtaaaggctacttcaaggcaagatggtggggaaaaagactttgcctaccttactgaggtactcgattggagaagagcgtttaataactgatcccgtctcctcctcctcgatcttgcgcacgcctcgtactctccgccgcgcatgctgatcttttgttctggttggtgttaccaaccaggactagaaataaatctttagtctctgttagtaacaccaaccgggactaaagataatagggatctttttttcctgttggtgttaccaaccgggactagaaatagatctttagtcccggttgataacaccaaccgggactaaagataaaaatgtagctctaaccttttgaaccgggactaaagataatctttagtcccggtttttattgcaaccgggactattgtggattttggccgaccaactaaagatggtttctccacccgtgatccttcccatatcctaacccatatgtaatcagaatcggatcagacacggatagtgtcgaatacggatacaaacacggataatatcgggtacaaatacggaacgaatacgtaccaaaatggatatcaacgctatcggttacgaatacttattcggataccaagtcaaaacgacgaccatatataccacataggtcctgttcttttttccaacaagagttggatgaagattaatactttcgtggcacgtttttcaatctactaaacggtgcgtttcgggcgaaaactttctatataaaagttgctccaaaatatcatattaatctatttttcaagtttgtaataattaaaatttaatcaatcatacattaatactacctcgttttgcataaaaaaacttaatcttcatctttatcttcaggagaaaagaacaccaccatagacaatagatattcaaccacttcgtgtatccataatacgattatattagaccatttcatatatccacaaatttatattacaactgatacatatcaccataacagtgctcacaaacaaatgacttagccagttgccaatcatatcagctacagctaggacctagccaaccataccaaccatctcaaaccatcagttgcttcagatgggggtgacgccttttgatgccgtgatggccttcacaggcgcatgccgtgcagtggtggtggggcttcgaagggcgcggtgcagtactgcagcggcgcgatggacgcggcggcggcggcttcgaagggcgtggcgctgacggcgctctcctctcagtctcggtggtgattcgtggccagcattgctaaaaatatgtcgccataaaatatgatggatttcagtcgattgaaaccaaccgtcagatgcggatgcgaaattacggcatgtcacatgtgtacgcatatcatccctccgatttacttctcttcacggcatatgctatagttgacttttcttagccacttacacagtagttacacctcacttacatatgtaattagtatgtaatttttgaatttacatgtgtaattttagaacttacatatgtaattttgagatttacattgtaaatacactaaaattacatatgtaatttagaaacttacaatgtaaatacataccgattattttttggtgaaaaaaatatgacgccataaatatagctacacccaagtattatgatttaattaatggcgcattttccatctcgacacttccggccgcaacccactagtaatttagtccattacaaattaactcctttaacacggttggattagagcaagcatatactctggtggagaaagcgtttgtagtcccggttcgtaacccccctttagtcccggtttttaaactgggactaccaatccgggactaaagatcgctatctttagtcccggatgaaataaccaagactaaagatcgatctttagtcccgttttttttttgcatggccctgttgctgcatggtttatatatatatataaaccatgcatatatatgtttcaatacatatatatgcataaataatatatatatatatatatattatatttatatatgtttcaatacatatgtacatgcataatatatatgtatttatacatatatatgttatgcaaatgcatatgtatatatatatatgaccaaaatatatatttacattatagaaaatgtgtacacatgcatatagaaacatagtcatgtattaattataatccattatatgtcctagctagctacgatttcgacgtagtagtagtcgatatctcagaagctaaggacctatgaattgtatttccgtcgtagtagaattcacccttgggatcaaggatttgttcgttgatgaatcccatgagttgttcgtgaaccgccgcgataaattccttgtgtgtgatcaggttatccctcatgcgaataaactatatgaatgtatgaaattgattagtaattaaacaacaaatcgatacgtaatgaaattttgaatttatttgtacgtacatcgagctctcttgtggtgatgatttggtctgcaaggcagtggcaatactcgcacacctagtagccgcacaagttagttccctgcttttgctttgcgcactataaataaatgacaaacgatgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaactataacaagattcttaattaacataggaacttatgacagtacctgtctataagttcgaaaaccttgtcaaacatagactcttttttatccattgagtcatatacgttgacggtgcaggcctccaggtcgaagagtaaaagcacccagtggaatctgcaatgtgcgtgggatgcattacatatgaaacacttagcatgttcgtacgggattgaaatttggtataggaagacagtaaaattaaactaactctgtgttgtacggcaacagtatgaacgtcttgtaatgctgcgccttcaggagatggacgagattgtcctctgtggcttgtggatattggtcgagcattgcgacgtttactttccgagggtcgatgaatccagtatcgaaaaccccccgccgtcgggccctttgaatctccattctacaacgataaaagggagtatatattatatatagtctacttatatacaaggacctaattaattaaaggaaacgtagtaagaaatctaactgaacgatatacttacaaaatccagcaactcataatagagacgtcgagggcatccagctggtatagttcgtagattcccttgaaattgatccagagaatgtcatctccttgcaagaagtccgtgtccctgatcctcgatccgatcatctctctaccggtggcgctcatctccatgtacagctgatggaacttgtacatttgtgtgggtagggactgcagcagctcaggcttgacaagcggtttaccgagttcgtacatgtatttcacttccgcattttcgattggtgcgtctcgtagcaattgatacgtagttagcccggtgtcattaataaagtcttgtattccaaaatcttcaccggtcaccaacggctcgatctcctggtttggttgctctccaagctgagggactggtttggactttccagaagatgctttcttgagtgttcgctcatagtccgatagctttatggcctccttggcaggtgcagacatacccctgaagaagttcctgacactcgcgtctataggaatcttcttttctagacttcgaggcttgaattgtctcctgacttctgatgccacgtaagcgtcaagctcctcttgcgtgcagtcgtacccccgtcaactttcgccttcttcgttgcccttgtgggggcaggcggtggagcttggggggcccttgacttggaaggtgccagaagaggagcttgcagaggagtcggtgtaggagcctgaggaggagtcggtgtaggagcctgaggtggagacggtgctggagcatgaggaggagacggtgcaggagcctgaggaggagatggcggagccggaggagatggtgcacgagacgccgcttgtcgcccagggaggatgatgtaccgcttgcaccatagaataatggcgtggcttgtgtctcgtagatgcgtctcaccgtctcctccagggtaatccagctcgaggtcctcgtacgcgccttcgaccaactcaacttcg

SEQ ID NO: 80454 - DNA, 2917 bp, Oryza sativa
cctgcagtggtaagtatctgaagggtccgttgggatggccatgcccgacgccaccttcatgtggtgagaggttatttattagtaatcaacatatataagcagcaactagcggaatggccaaatctaaaatctataaactacaagcttacctttattgataagttcttgaagggagaatatgcagctcacatggtgtccgctgagtgatgtcatcaacggggcaggtggtttcgtccagggtttgcatggtgtccatgctctgtgatcctacctgccccgttgaggcgcagctcctacgatttcctgatgggctcagcattgcaggaggaatggtcggctggggatcatgggaccgatgtgcggccatgcgttcatcaaccttccttgccacctcctcttgcatgctgagctcgtagctcgataccctgaactcaagatctgcaatcttcacctcggtatctctcttgctcctcatccgactcctgtatgtgtggatgtcctccttgaacccaatcttccaaggaatcacccatttccctcgtgttcgtcctggatgctctggagtctgcagggcaagtgacagctcgtccctctctctgtccagtcggaacgtgccctgagaagaggcttccactgcgtctgttagtcgacgcgcagcctcatgtatctgatcgccgaagaccagggagccatcagctgggttgagcgttccaccgtgagcatagtaccagaacttcgatcgttccggccaattagtggtggctggttcgatacccgtctcaaccaagctagcctccatctcctcccacttcggcatcgcgacgctatagccgtctgaccctaagtggtgatggtacttcttcttggcggcattttctttgtttctttccatcatcgcctgcccttgttcacctgtcttatatgcaacgaactcgtcccagtgatcccttagctttggaaatgtgtcaaagttcggtgtctgccccttccggatatatttctggtacagatctcccttgaagctttgaaattgttctgccattttcttcagagtccaccttttcactttgtcctctgtacccgcgggaagggtgaatgtctctagcattgtggtccacagcatctctttcactgaatttgggacaaagctctcatgatctccgcgtgcccttattctgcgccagtacaccgtgctgacaggcacgttatcccgcacaacccaaccactatgacgtacatagttcttggcggcttctgccagggcactaggtcagccgtcttcgtccacttccgttatgatgtgccggccctcaagcttcttcgcggcacctcgttgcctgcgtgccctcttctgtccagcggagggttgacttccactagcctcctcctcctggttcccctccacatccctctccacgtgcccctcctggttcccctccacatccctctccacgttcccttcctagttcaaatactggtttggatcctcgttcccctcttcttcattccagtactggctgcttccctccgcgattgtatcgtacaatatttgttcctcatcgcgatcagccatctgttcatacaggaaacagctgctaagtcatgagacatttatgttttaacaatcttatatactaacaatcatatatgctaagtcatatatactacgtctaactgtcgtatatgcgaagtcatatatgcttagtctaactgtcgtatatgctaagtctaactgtcgtatatgctaagtctaattacaaatctaataatcgtatattaaaacaataataatcttatacgaaaacttaaataatcttatactaaaactcaaatagtgatatatgcttagtctaggtgacgtatattataggaccctagctagtcaataattatatactaagtctaattacaaatataataatcttatattaaaactcaaataatcttatactaaaactcaaatagtcatatatgctatgtgtaactgtcgtatattagaaccctacacaatcttaattatatgctaagtctaattacaaatctaataatcttatactaaaactcaaatagtgatatatgctaagtctaggtgacgtatattataggaccctagctagtcaataattatatactaagtctaattacaaatctaataatcttatattaaaactcaaataatcttatactaaaactcaaatagtcatatatgcgtagtctaactgtcgtatattagaaccctacacaatcttatatgctaagcctagttacaaatctaataatcttatattaaaactataataatcttatattaaaaccaagtctaagtgtcgtatattaaatctaatagtcttaattgcattacaaatataataatcatatatataattacgtcacttgcctgcgcgaattccttcgagggctagctaccacttcggcttgagggacgacgacaacaacgtcttttctgcaacatacaaaaatatgtattaggataaacgcgaagtaacatatattacatttgacgttcacgtttcattcacgatcgttcacgttcgcgttctcgttaaggtcacgtttcattcacctacgttcgttcgttcacgttcattcacctgcatatattacatttcacattcacgttcgttcatgttcacgttcgttaatgttcgttcacgctcgttcgttcacgttcgttcgttctttaacgttcaattctcgttcacgttcgttcgctcgttcacattctcgttcacgttcgttcgctcgttcacgttcacattcacattcacgttaattcgttcgatcacgtggcggcagcggagcggcggtgtggcggtagcagagcagcggcggggcggcgcggcggcggcatggcggcggcatggcagcgcgcgcggcatcggcgtggcgcggtggc

SEQ ID NO: 80455 - DNA, 8740 bp, Oryza sativa
ccgggactaaagatattttcccgctatttccaaattctttttaaacccggttagggttaagaaccgggactactgataaatccactgaatattaatttccattacatatgtgtttctaaaatagaaaataatgcgttaaaattatttaaagtagaaaaattaatgacaattacttcgaaaaattattgttgtctgtaataaattaagtggataaaacgtaataagaaaatatatgatttaaaattaataaaaattctaataataatatatacttagcatatgaatgatattaaattgttaaaaactctaattaacatatgtatatacatacgccatgcatgatttaaaattaataaaaattgtaataatcatatataattagcatatgaatgatattaaattaattgttaaaaactctaattaacatatgtaaatgccacatgcatgatttaaaatttttaaaaattcgaatagtcatatataattagcatataaatgatagtaaattaattgttaaaaactctaattaacatatgaaaatgccacctgcgtgatttaaaacttttaaaaattataattatcgcatataactatcatatacatgatttaaaattgttaaaatctctaataatcgtgtgtaattaacatatgccatacaacaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggtcaatcgtcatcgtgaaaggggttgcccacactacaacatactatttattccgtaacataattttagcgacggtttcagaaaacgttagcaacttgctctcatttatattaagcccaaaaaaccgtaatgttttatcaattccgtcacgattcggcccagaacactgtaacgtttacacaaatccgtcgcgaacataaattaaaaattatcaggttcctatgtgaaacaaaattttaaaaaaatctgtcacgaacataaattaaaaattatcatgttcccatatgaaaaaaatttatacataaattaaaaattatcaggttcctatgtgaaaaaaaaattaaaaaaatctgtcgcgaacataaattaaaaattatcatgttcccatatgaaaaaaatttataaaaaggtgcaacatgcagggtttgaatccccgtcttgaattccatcagtaaagtgacctaccactataccatgcattgtgatgtggtaatgtctagtgacaaaatttatttttatagtaaatcaagtatttacccaaaaaaaacccagctcccccgaccgcttgggccacgtcactgcccgcctgcgccagctccccggccacgtcacgcgtgcgcgcccagtcagccgctcccagaatttaatccggcgcgccaaaaaaataggcgacggggcctggaacccacgacctggaggttaagaggcgtctgcattaccactcggctacaagtccggctgtgttggaacttagaagttttgctcttatatacttgaaaagttcgttgattaaacaacaacattcaggcatttggaaatttccccgattcagatccattccggcacgtgacggcgccgcctgccattgctgccgccgttcgccgtcggcaccattaccccaccgtccgtgcacgtaccgccgtcgccaccattagcacgccatcccggccaccagtccccaccacgccgtcgccgccgcccaccacatctcgcatcaacggctgccggaggatgacagcaacggcatcataggcttgcccgccattgccgccaagcgtggcgccggcgtggtgtgatgccgagcgtctcgtcgtccagcgacaggctccagcatgcgccattgcagacaatgacactgtctataaagtattctcggacgtcgttcgccagccccacggctacctccttcccgcgccacccctcctcaccgcctcccgcctccggtgcgccaggacgagcgccgccgcctggacgcctctttccatgacgccggtcgccgacccctgccgcgatctccttccttcggctcgtccgtctcgccggcctccgtcgccgttacgccggccgccgttccctagtgcccctcaccgcgcctcgctctctcctgctcgggcgcgcgcgcgtgagaaagagaaggggatcggaggtaagaacgagaaggaaagtggtaacgaagaggagaaaagaagagaggagagatacacttacaggtgggacccaatggaccccatggttactaatcaagctttgtgcagtaaatccctctttaatccccctctattatatcactgacatgtgggtccgattacactaatctctgattagatctcttttaatccctcagatgattacgtgtgggacccactgttctccagccgctcgcgcacctggtcctcatgcgccgggtctatgaccatcgggccccacgggccctaactgtgaaactttgaagctttgcattttcaaattttgaattgtagaacaaatgtggtttttcattttaatctctggctaaaacttgtaggtagtctttctcccacatactaacttcaaatttgattattcttttttctaaaattttctaaattcatgatctatcaatttgttgtgttattacaactattatttttgtcatattttcatgtgactttgttttatcaattgaagatttaaatttcaaaaagtggcaacttcaaacgatattttgaagcagtaaatgatttcagctaaaaaagtcatgaacacaaaagttgtagaactgattgagatctacaaatttatttttggtcatttgttcattccgcaaagtgatagtaatgtggatcacaagatttacacatctcccttataaattatgaaaccatgtgggagatatgtaaaacttgtgaacaatgttacaatcactttatcggatgaacaaatgaccaaaataaaaattgtagatttagatgtattatacaactttgttgttgatgactttttcagttagatctggatggttgagaatttcgtcagatagttgctctagattgttctgtcagtgttgcgcccttgcgctaattgctagactatatggttagtgaaatccaagttgtctcgtcaaactccatcttagagtttcaaagatagaaacgtttttctttttcgaatcacagggaataacgggaaaaattcccctcttcttagtattgataatatttgtttgtatatgcacgatcatctaagtatatacttgttcttaggtgcaaatcagaaaactttattgaggatatatgaagtagtgaatgttgaatgaccttctcaatggatttaaacgcctcagcattgcctgtggaagatgaacaaccttatgaacaacatgtcgaggttgattttgcataggaggatcatgttgagtctgctgttgctacaatgcaaagatttcactttttcatacagtgaacagagtatgcaggtagattatcaatcatttagttaacatcaagacacattttaaattggtcagaaaaatcatataaataaatgcatatgagttgaatactatacatgtatttggttagtggagataagattagtaaagaacctattagattgattatgaataaataaattggtatatggtgacagtagtagtttatatttaatcaagtgaccatagagggacattcagcagaaacactctgtaggaaattatgctgagcacctaaagataattggaatgtatatcttaacggtagagcatgtaaggaacgaacttgttcagagcatagcacgacaaatactagtttgtacaggtcatgagtaatataaagtttatccaatcgttaattgcatctcgtgagtaatataggtgcaagtctgtaacaatatcaaagattaatattctcatatagtgtgatgctagcagtatgtagtatttatacgattaatatgaatagtgagtgtattgatacatcttgcgtttaatgcagatctatgagcagaactagtaggtctctatagcatatcatcttaaaaaaacagagcagtttagagtaaagcagtcattagaccattcagagaaatcaatcaccatatgtttgtttcttgataaagttcagtaatcgataatctagaattgacatggttatataagttttcatccatataaataaatatagtgttaaagtgaagcttcataaggacctgatcatgatagtgtgttattgactctagtattatttaacttactgaatgcaagtatatataaggaacgatcatattagagtgatttcaaattttagtactgcattttcatatgatgatttctggaagcagacattcattcataagcatattggcataattcaatcatattaatttaattgatcaagtattactattaggcaatcagcggagcataccatgattccatgaatattcataggttgaccaataggacttttctaattagttgttgtgactgttgtacaccaagcatatcatagtgcatttcattagcatcggtactctttgtatttatttgtttcatcgtttatttcagttggttgttatctttgatttcttggagttcttattggcttattcgttcttcgatttcaggtatctcaggcaagtccaacacctttgaccaactcttgttatattttcgtaattgcaatctatatgtatcacattgcattaaattgtactttctataattaaaatatatgttccaaattgtctgatttatcttcattcctataggtttattctggtgacttatctagtggtgtgcttgttcaaccatcgacattgcgtgattatgatgacagagataggttctgcatttttcttttacctgggggtggcaacagaaaggttagttgctcttacttttgcggggtttcgtcccatagtttttatttttatttatttaagcaagcatatcttccttgagtgagatatctgcagttgacaagacttttatattaagaagagggcctctagtaaaaacccttgatgaagctagtgtagaactaattttttatagaaccattctaaactgccatttggttatctttttctagtgaaattccactaacgatgtgcaaacaacaatctctatcaggatattttgccaccgtatatcattgaagttatagtaaatagggatgttactgaggtggccttgttcgtttgcactgctataggcttatttgcacttccagttcactgccttacatttttggtttttggtcttgcaagcagctagaggatggcatgaactggtggactacatccagaattttcaccaccaacctggagctgctggtctgatgcaagatgctcctggttgagcttctgttctgattcaagatgctgatggttgagctgtcctattgttctttgtcctttagacttaggggcaattgcaaatttaccactactttgaatcattattgcaaaactgccactagaaaattgcaaaaatgccactagaactgtcattcgagtggtatccttgcaatattcaaaaaaccggtggcaaatttgcaaatgccccttagacttattgttcttgtgttgagcttgtgctcctggtgttgcaagttgggctacgtctcttagactcatgatttgcatgcttctgatgcaaaggtgaaacttgcgattgttcgcattgcttttgcatggatattgagctgttttgaaatggtctggctgcttctgttctgataatggtttggttgctgttgtgggctgaaatcattgtggactgaaatgtttatgggctgaaatcactccgagcaagaatcattgtgggctgaaatgtctatgggccgaaattttgggccaaaagtggcacacttctaaaatcggcccattaataaatggcccatgaatgtaaattcaacgtctatgtcagcatgcacgtcattgtccatgtcagcatccacgtcatcatgagtaccatgtaagcagcgacgtcattatccacgtaggcagccatgtcattgtccatgttggcagccacatcactattggctgccacgtcatcgtccacgttggtagccacatcactatccatgtcagcagccagatcactatccatgtcagcaggaatccgcgacgtttattttcatcgctaaaactgggctttggactgggctgcatgggccttggactgttctgcgacggtcaaaaaccgtcacggatcacttcaatccgcaacggttttgaagaatcgtcggtcgatttaatcaatcacgctcgatcaataacgaaatctgaaaccatcacggatggtgaattgtaacgaattttcaacgacccgcgacaaaatgattccgtcacagaataaatagcatgttgtagtgccatccaactgatcgtaatccccatcagtcttgtcctcaactccgccgatttttcttttgcctgggagaaccacgtgacgcttaggctcatcaggccctctgcccttctttcctttgctagacatgtccttcacgtaaaagacttgcgttacatcattggcaaggacaaaaggttcgtccgagtatccaaccttgttaaggtcaaccgttgtcatcccactgtcattaatcattacgccttcaccagtcaacctaacccattggcaccggaacagatggaccttgagaggatcatagtcaagttcccatatgtcctcgatggcaccgtaatacgtgtcagttgttcaattgtgtcccatggcatcgacacgaacagcgctgttttggttcgtgctcttcatgtcttgggctctcgtgtagaatgtgtacccattgatcttatatccctggaatgtcgcgatcgacccagacggtcccctcgctaggaaggcaagttgttggttgatcgactcgttacccatgagatgttgtcgtagccacgcggggaaagtatcaatgtgatgccgtgtaatccatgcatcggacttgccgatgttcctggcgcgaactagagccaagtgctcctcgatgtaaggagttaccaatgaagattgttgtagaaccgtgaaatgggctttacggaataaattgttgtctaccgtcattattgctttccttccgagagttccctttccccgtagtctcccttcatggcgtgattcaggtacctcgattgggcgaaggtcttcgataaattcaacgcaaaattcgatgacttcttctgttccataacccttggcgatacttgcctctggacgagcacggttacgaacatacttcttcagaacgcccatgtacctctcgaaaggaaacatgttgtgtaggaacacaggcccgaaaatactgatctctttgacaaggtgacaaagcagatgcgtcattatattgaaaaatgaaggtggaaatatcaactcaaaactgacgacacattgcaccacatcattctgaagggcttctaatctatccggatcgatgaccttctgcgaaattgcgttcatgtatgcacatagctttgttattgttgcccggacattgtctggaaggataccccttattacaactggtagcagttgtgtcatcaatacgtgacagtcatgagactttaggtttgtgaacttcttctccttcgtgcttattattcgcttgatattcgtggagtatccagatggtacctttatgctctccaagcattcaaacatactttccttctctgccttgctaagagtgtagctggctggactcaagtaatggcttcctttctcctttggttccgggtgaaggtcgacgcgttgttccatatgcttcagatcattacgtgcttccagagtatctttcgactttccgtatacacctaggaagccaagaaggtttacgcaaaggttcttagtgaggtgcatcacaccgattgcgtggcggacgtccaagaattcccaatagggtaactcccaaaatatagagttctttttccatatcgccgcgtgaccatcttcgctctctataggctggcttccaggcccctttccaaacactactttaagatctttaaccatagcaaacactgttttcccgctgcgatgtttaggcttcgtacgatggtccgccttatattcaaagtgcttgcctttctttcataccgggtagtttgctgcaaggaatcgacgatgacccatgtatacaaccttcctacagtgcttaagatacgtactttctgtttcatacatacagtgagtgcaagccttgtaccccttgttggactgtccggataggttgctaagtgcaggccaatcgttgatggttacgaacagcagcgcttgtaggttaaactcctcctgtttgtcctcgtcccacatggggacaccttccttcttccacaacagtttaaaatcttcgaccagtggtcttaggtacacatcgatgtcgttaccaggttgcttggggccctgaataataatcggcatcattatgtacttcctcttcatgcatagctagggggaggttgtagatacacatcgtaacgggcctagtgctatggccgctgctcatctctccaaaaggatttatgccatccgtactcaaaccaaaccgtatgtttcgtgcgtcctttccaaagtatttaaattttctatcgatgtttcgccactgcgaaccatcggcggggtgtctcagca

SEQ ID NO: 80456 - DNA, 3270 bp, Oryza sativa
atataggatacaatcattcggacatgcgtgaatcttctaaacttccagtcctagagggtagactatcttcttagcctcgtacgttgtctcaggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtacaacgacgttctatggtcctctaacatcttgtccaatttatgggcccccttttcactttcgcagtcctccttggcatcctgcaacatctgaccaagatcatccgcaacgtcgttaccatcagcatccctttccttctcgcccgtttgatttccttcaaatccaacgtactgagcaaagtccggaatattgtcgtcttccacttcatcttcttccatttcaacaccttgctcttcgtgggatgtccaacaattatagcttggcatgaaccccgactcaaacaagtggaaatgaatagttctggatgcagaatactccttctgattcttacacttattgcatggacaacaaataaaacccttttgcctgttagcttcggccactctcaaaaaataatgcacgccgtcaataaactctttggaccgccggtcagcgtacatccattgccgatccatctacatgacatgaaaaaaaatcgtacacaaataattattcttacaataatgacagtcatacaataattataagataattacaaactctttcaacagtcatacaataatgacatatctttattcatacaaaaatcataaaatattacaccaaataattcttatttactatttctattaatgtgttttacttcttttaattttaattttactttgttttctattatttaagattaactttcactatattttccttctcaactattttataaaaccttctttagcaaatcaactaaatttctatatattctttcttccccacacaaattttctctctcatcaacttacaactaaattttggagacaaaaaagtatgcaaaacatagctccaaatgtaatatgacaaaaaaaaactttggaggatgaagttgcaaaccttttaggcacctctgatttgtaagtaatcaccaaaataaattcactagaaattttggcatgacctcccctctcttttttgaagaaattttgaagcttgcttggccagctaggggaggaagaagacatatatatataggggtgagactttagtcctagttggtaacaccaaccggggctaaagatccccgggatctttagtcccggctggtaacaccaaccgggactaaagttaactttgcctgacaggccctgacagcatttgaaccgggactaaagatcaaatatgcccgttaccctttttaaccgggactaaagatcatctttagccccggtttttattgcatccgggactattgtggaattcggccgaccgacaaaagatggtttctccaccagtgataggacggatgatggatgctagctgctcgtgcaagggggtaggcttcattgggccctagcctaccctctgatttttaaaaaaagaaaatctgaaaaaaaaatctaagatgggcatgcattggagaagagaccagcgttgggaattgaggaagatatgcacattcagcgcttggggatcatgattgggatggacactcccatttggctaattcgacacttcacaccacaaatccactgctccctccgtcctaaaaaagacaaaccctagttttcgtgtccaatgtttgatcatccatcttatttgaaaaaattatgaaaaaaaataaaaagacaagtcacgcataaaatattaatcatgttttatcatctaacaataatgaaaatacgaattataaaaaaatttcatataagacggacagttaaagttagacacggaaacctagggtttgactttttttttagaacggagggagtagttatttggctgagggctccttagccaggattggactgcagcaagagctagacgtcatgttattatatagctagcgagacagtctatggagtatcacattatataattatctatatctagtataaaaaggagttcacccctaacaattctacaggtaaaatcatcacatctcatctcatccgtccatccgtcatctcatctaatctcatccgttaatcgctatcctgctcgctgtagaaatcatcaccaatctcacccgattcctccaccgcactttctgcccgcgcgatgactccgccgccacgaatccccgctgcctcctccctcctcctccctcccccatgcctagggaggccacgatgggctcctggccagtcaccgccgccagcaatgcccgacaacgcaacgccctactacgccaagggaaggccacgaggggcttcccgcttgccgtcgcggccgccatgccctcctccgcactggaccgctgccactcactccgcgcccggcgacactatggcctccctctgtcgcaccaaagggagcttcccattcaccgcctccatcgtgtcgtgagggacctccacttgtggcacttctgacgctgcgacgcagtggagggcattgcctctggtggcaccatggttctactgccatttaccggaatcatatcatttagtggtttcaatctcttctcccccttccaattcattgttttgtttctgcaatttggttgacaaagcaagttcctttattgtctggacatactgtattttgcccagtaggtgttcaattaaatgccactgaaataatctgaatcagagccggtttaatcatgcatctacgtggacacatcctttagttttattgtctaataggtattgattatgtatatagcagtgccataagaatttttctctacagctcattcaagcattcaacaatgctgggctgatttttggaatgagcaatataagtttaacattgttccatgtttttgcttgtaggatgtatacttctattgttgtccttaccctcatacctgcgtatgtgtagtaataaatattggttgcataagaatgacacagaagactgagtgggtctttgttgcgaacccaaaaggcctatagatcttactggtaattcctacaaggaccaaactccatttatagatatttgcacatttatgctatttgcttttgcttgttctgtacaatattctcctatttaccctctggggtcaacctgtactcaacacgtgccacaccaat

SEQ ID NO: 80457 - DNA, 68721 bp, Oryza sativa
gccaccgcccccgtgggaccaaaccaccctcctctctcccgccgccgccgcctccccggagatgcggcgagaggagggcaggtggagcaaatgcggtggcgatttggggtttggtgcgcgcgggcgaggtggtggtggaggcggaggcggaggggggaatggagctgtctggttggggccgggtggtggagaaggaagacgcagccctcctccgcttcgaaaattttgaattaacaaagggttggggttggaggcgataccggattaaaaatggagcgccagtgttgggggaaatgcaagcccagatggatcttgtccacttctcggttggttcgcgaacaaaagttttaaaatctcagttttaaatccatacagtttgatggtttcacggattcacgcaccaccagcagctgcgtttttttgaaagggtgaatttgagttttggaatttgtctgggtttctttgtgttttgtagtagtgggtttttaaaagtggttgagtagtatgtgccatcgagctcaacaaccgaatgaatgattaaactagttaacactaccggcgtgtacaattgggacggcaaatggtcataccatttgtttaacgttttatggggagaaaaatatcttgcacttgttggacacaacatggttactaggagtgcacgtttgcttgttgcatatccaacactccatttatgttcgtggttgttacgcttaatttgttgtttaagccttcaaggtaagatttagtttatctgtggcttgaatataactaaatgcaggggggggggggtttatataatcgcattgtaattttgcgtagacatataatagcacattcaaattagctcactagtagatttcctcgcagaatgaatgtgtataaaaacgaatacgtacagcaggacaaacgaaacagtgtgacacttgaaaaaagagactccattagtgtgcatggtgcgctcgtattttaatagggcggggccgtggcagcttggtgagttcatgattagcagtggttaagttggctaatcgcagaggaaaaaaatcgtagtattataatcaagtagagcgatcccatcccttataacattgtccgcccagtagttttctccttttcctgacgtatgcgtagtgattagataaagaatcacctaattaagcctctgaaaatataattttgctatctacattttttttgtcattttcaaagtatgggagaaccgtacaaagtactactacaaacgtatacatacgacgagtaccctgtattttcgggggacctgtgcgttgagacgggcccatcagttcggaatttgagagtcgagattacttgggtgtactagtacggttgggtcgtccaaatcaacgaaaagcacgtggcctccagcctccttgcgggtcccaccaccaagggatccttttgacgtggccgcgacctcctctctgtatcgttttccgctgtgtgtgccgcacccatacatacgggcatactacctcctgccacaatatgggctccatacatgtacccacgtatagctctacatactaataacatacatgtaccccgtagctgttcgtgtatcaggggaatggatacatgccacgtgagcattaaatctcttgtaagaaatactatgtatgcaaattcggaatttcactattagaagttactactaatattcccactatgcagttgttttttttaaccaaaaaaaatacaaaccaagaagccggcgagttaggttccttacggtgaaatttgtttagatggatttaagcactcgactttgtacgactatttatatttacggttagttatttttttaagtgatgtttgacatattagttgatagcgagacgcttgtatgaatatgagcatacgcgtgcttaccgtgttttgggaaaaaaaagtgaaaaatatatgccgtcgaaagagtgtttggtgatcgaagcctgtcatccactgctctagcacaacgcacggacaaagcgtccttgtcctgtaaactgtgtctaagcgaagagttttcagacagctctgcctccgctgctgctgtatagatgagcgaagttaaccggcagcaggaccaacggcctcaaccgacaggtatacaacttcccagcttcagcaacaccaccacggccggtgaaaccgaaacactagctagtgatcctgatccggacctaatttaaaggcagaaaaaatatcttagcagcaaatggaagagttaatcgagctttgcaactgaaaagctagtataacagtaatggggttaggggaaggcacgcagaggagacgtcccggagatcattgtaggggaccaataatgcacaaagcgtaatacaattatgccaccatcatcctggcctctccttcacagatgatggatggagctgcgtgatgtcgcgcctggccacatgcccggcgacgacgaccgatgattgtcgtgtgcgtgacccatgtggaggacctcgctacccccaatctctcttcagcctttcatcaccaaattaggctattagaatccggaataagcttagttaattattgattaggtagctagcttaatccaccatctggagtagtattattacaagtagtaggagtagacgagtagtacgaattgtgggattggtttgatgagcatatgtcgtcgtcgaggctggaggctggacgttacggtcgttgaaaggtaaagggcagttggtgtgcaggcaagtactggagaggttgcagtcagcattggagctaaaacgagtagtaggagcagaggaactgagcaaattttcagcttagctatagggtggcaagtgtcggtgcagggtacttgcggatagctgattttcagcagtaaacgcgaggatcgcaacacgcgaccgaccgaccccggccggcgtttcagtacaggcagccgagcgagaggcaaggcacaagacggacagggatagctgctgcttctgctgctgctgctactgcacatcggattccttcaattgagacgcatcaaccacctggtggtggtgttgtgcaccgcgccgcacgagcaacgcgacgtgggattctatagccccccgcgttgtgctcgggcttggcttggcgcggcgttgttgttacgggggattggattggatcgctcaactgcagccgcgagcgcggacggacgcggccgggaaaatccaacgggagatcgcgcggtccccgtttcatgggatcccgcgcgtggagttcgtaaattcttctcgcccgctccgcctggccgccgtgcgatttatggtgcggcgcccaaacgcgcccgagcagacgcgtccggccgcggtggggtacgatacgacgcgacgcgatgcccacacgggagcgccgctgctgcggctacgaggctgcaggaaacagcaaatgaagcaggggctcggctagcccttcacagtttataaacatcttaacaagtgcattatattcgagttgacacaattgaacggacctccaagttagcgttaagttagttacgatgaagtttgttattgtttcatgacagggcccttttcacctcgacgtgaataaccagcacgttttctactccgtattactgattataacgtactgatctaccacatacaacttgtatacatgttatgtttgattaaaccactggaactaagcctgctctcgtactcggctcacaatgccaaccgcgatggtgtttccctgagatcgtaggaacactcggcctagcgctttcaggtttgagaattcttccacgcatacctctttctccagcttcacctgaaagaaaacaccaagcgttacagagacaacaaacatgatatcagcaacaaaactaccccatccatctgctgtaagcttacctcgattacagcagtctgtctcgaggtgagaaatcgtggtatcttctttgaggctttgccggtcttctgctccagcaatgacagtattttcaccatgcttgcagacaccttcgcatgatggatgtggagctcaaactagaaacatgggtagcgaccatgtaaggtgtcgatattaggcctgaagttctctttaaaaaataaatgaagcatgaacagttgaagagatatgctcccctcttttgcttacctgcaagccaaccagtattggtacagtgatatctaggaccaaaatttttagctccaagcaagaagccacggacacaggataatctggatggcatatgactccgccaggcatgatatgactagggtcaatcccttgcaaaccaatagcgacattgtccccagctcttgctaaattgcaactagaggaattccgctcaatagttttcaccacagctaactccccaaaaggcatgacgaggatctgaaacaagagtaccatgaaatcaggaaactgcttgaacatcttacaggcaaaagcatagttatttaatcattgagcacaacattatttagacggaaaagtggtaggacaacgaaaacagtgcaaaagatatagttagaacacaagtgatgttcaaccatacataaatatctcgcactaaggcaatataagaaacaaagacaaatgtattgtagtatgtgcttagaataacagcagggtgataccttagaaccacttcgggttgctccaacctctactttaccaccaattgcaacttgccccagcttatgtgacgaaaagacatcacaaattggaaggcgcagtggctttgaaacatcacgagaaggaggcggtaatgtgtcaatggctttcaacaggcaatttccatcatacctgacaccatgcatcaattacgttggcgaacaaccaccaggttttaaggtcaagggatatgcaggtttaccatagggaatatctattaccatgatgatagtcgagtatctgaagctgttgtcattaagttctcattctccattgcactaattggaacccaggcaactgctgagtctttgtaaccgcatgaccgcagaaaagcaccaagctgtgatttgataaaattaaatcgctcttttgaatattccaccgagtccatcttgttaacaacaactatcaagttatccacgccaaagcttctaacaagctgcgagtgctcctttgtctgtccaatcccattgatgcccatacctgcttcaaatgatcctatagaagcgtcaataactaggatagctgcatcagattgtgttgctccagatatcatattaggaacaaaatctttgtggccaggggagtccagcaaaacaacatggtaatttttggtgtcaaagtatgcaacaccgacagtcattgtaatgccacgctccctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtttgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcagagataataccttttctaaaacttctcgacgattttagtcctgtagcgaccacgtcatccggagatggtgtatcaaacttgaaaggcactgtgaacatgaagatatgcagtcatattacagatttctccatcaggaagtctaataaataaatgaaacataagttcaacatatggatctcccattggaaaaacacgggtcaactgaatgcttaccctaattcaggggaagaactgaacattcataagtaggttaaaatttacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccaacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagagaggagttagtaccaagcaaaccctatctagatgttttcatgaaatacttgtgattctgagaaaaaaaaagtgagcaccaagtaaattccgtaaatccaaacacccatcaatgaaggcaaaggtagcaaaagcactctagtagtaactcaccatctcttatgatgagatcatcaactttactgtctctaggattgccaccagaccacacgcaccgtcagaatctgggttgatatcaaccatgttaaactctgcctgattatgcaacagaagccctaccataatatgcaattccatcattcaagcagtcaaaaacagatctgctattgctatatgagccagtcaatcagaactcagaactatgaattttctcaatatatatatagagaaggaaactccattgggcattaaccagcaggcaacattaaaagagtaatgggggcgcagatagcaagcactggaaactcccctacctataccattcaccaccaaacaagacaaaatactaatagggctcatgaagctcaacatggagaagaaaccaaattcagagcgtttctgaatcggaatcgcgataagaggactccgcccgagatcctccgccgccgctccttccccccgacctcctccgagcagcaagctcccgccgccggcagtcacagtctcagagtcccaagctccacactaggatcgacgcatcgcgtgcagtaatagagatgagagagccatcagagacgagcgcgcttacctgattccaaccgaggatactccaggccaaagagagcgaccccgccgccgctctcgcgcacccaaccgcggccgccggcgacctacccgattgcgcccgcgacgacgagcaggggagaagggggaagacgacggggagcgattgcctctcttctcgtcgcctctgcagcttctgttcatctcgatgccttccatggaattttttttatttataatttttcttattaaaagttttacaaaaataattttccattttgaaaattgacggaaatagtcgcctaccgccctcgggcggcgaaaatgacgtggcagacggccgctcgctctcgggcgacggccgtcaacgaaatttgcaggcggcccccttgccgccctccgcgagggcgatttttgcctcccccctataaagcccagcccctcccctatgaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagttttgtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtaatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagtttagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcagacgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggagtaaacacttttgtttgtttgtactcttgtttaatatgtgttagtaattcgcttagttcaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttatacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttctagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgtttgtgactaacatttcattcttaactgtaggcggaccttctacaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctatggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttataaaaaatatagagcacagtacaaaatcgcccttgcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccaaagggcggtaggcgactacttccgtcaattttcaaaatagaaaattatttttgtaaaacttttaataaaaaaaattaaaaataaaaaaaattcccgctgcacgcctgcaactgcaacggcaaccgtgcgtgctcccatccacccatgacagcgtgcgtacgtgctcgtctcacaccgaacaactctccatgtactatgcgactaccgttcgagtaaacccccctcgtcctacttacatgcgcgaggccgttgcgaatcaatcaacactggcgtcaatcaacaccaaacaattcgttcgatttcttagtttagtttagtttctcgcttaatactctattctaaagcacaagggaagcagccaggaaatggattagtgatgaccaaacggacaatcaacagtaacgctgttggctgctgacgactattttagttgacatgtccatacataaatacacataatccagagagatggccagctccgtgaccagcaaagagacaaggctggggtctgataaaagaagccctacctgagcttgacctccctgtctcgagccccccatactgcatacctcatgccatactctaatcagtataatccaggcattaatgagatgcatcagctttataatacaaagctaatgacatgccaatacatgctgccaaccttgcattcctccagcctacatatgtgtccatcgaaagatacaccattttggaattgccttctctctgcatttaggcacgcaccaaatccttgtagccatgggccatcactcacctgccctgcttcatgttagctcagatttcagcctctcaggaccatttcttgtgatgcatatatactaacttgttgtctcatatagcactagttacatgttcatggatcatatgtaataaactgccatcatcaaggatcagcctgtatatgctcatctctatcaatgctagaagtctacgattactaacaaaattagcactgcaacactcactgacagacaacatcaaatcaagctcctactatctgacgacaccatgctgtccatgcagctaggatggaggagataagccaacattcagacaccatcaccatgcgtgatgccgtgatgagaagaaaagtttgagcagctagctagcatgggtcatcagatcatgctgttagagcagacagcattggtcaatagtcagaattttgggtgttttcttgggtgttgggtcctcatgaccttcacctttgtcagatttagcagggatctaatgagcaaaaaattagtaacaaagaagcctacagcaagtagccaaatgttgctgtcccctctgcccctacctaataagcacaactactgtacactccaaacatctgctcactcacatgcatgtgacgtttatggtccacaaactacacatgattatggcaatagtgccctatgtctcggcatgttttgcataatggagtatggatctcaatcatgctaatggctagcttagccttttgtgaactaacctccttgcaagtagtattattcaggatggggcctggtttgcaaatatgttagagtgcagacaccatggcccatttctgtcgctgcaaccttcgccaatttatatataaacctcgaggagacatgtagagggagcattcgcttcatcagttcatcttctctccatctccatttccagtagttagttgtcaccagtcatcagcacaaccatggttattgatcagaagctactctgcttagtgtttgtctcaggagtactcgtcctagcaaatcttgcagatgtctcttctgctgctgcttcttcactgagcaggcagcaagatcaagtggctcgagttcttggtcgcagaggcagagaactgataggagaaggcttgtcaggacaccaataccggcatgaaggcaagcacaaggagcaacatgaggtgagttcattattcatatgttcataaaatgcaaaactgaatttttatgtgttttcttgtgcctgcctctgctgcataatctttttttaatgtcagtgaatagcacattgtgcactaccatcttcagctagaaatgcagatgaaaaacaagaaataattgtcaagctcatggtgtgtccatgtccaggtagtggctatggaggcgacgacgaaggagactgcagagacgaaggcaggttgggtggatgatgatgagggcgcaagagaagggctgatcgacagcgctgattacagcggggtggcgatgcactctccgtctccacccaaacgcaagcacccaaagaaaccataggctgtcagcttctctgtttgtccgtgtataatcttcttgtctagcttagttagtaggagtactactagtactaagtactctcttggactgttaatttcgtcatgaaattacatgtacccttcttcgcaagagatcgatcgatgttctgctgctgcttcttctgtatgtgttgccattgctctgttcatgcattgctgttagctagctgcagagatgacacagccagggtttaagttttcgacgaaaaccaaccaaaaaccgcaaaatttagatgttttgacgagggatgaaactaagggtgcaagtggctacccgcgaaaacctatttataggctaaactaacccgcgaactcacttattttgacctataaatgggttcgtgggtgacccacttgcacccctagatgaaagaagattatgagtgaaatttcgaatggttttctagaattcaaatttgaaacagtaaaattcaaccaaaatttgatcgaaatttggtgaaaaatgtcattccgctacggattcaggtcaggcactcgatcagaaaggtgaaccctgaccacagctgagaactaacaccagtccatgatggtcgagtgtcaactgtcaaattatattctccaagtctccaatagtgacgttttcatcgcaactacaggtttagcccgggataaaaaacaaggaaacatttttatttcgagggaaggacgcaggactgaagaaacttaaaagtgtccctgatgtgtttcatcatccgttctgtcactcacaaatggactcaaaatacagacccagatcaagtgtggtgttcaaccaaaatgttaactggcgaatggaaggtggcgtggttttctagaaactgcagatttgtacagaccaatccccagacagaagaaatacaagatcaagactggtgggcagcaaacaaattttgctgggatttatttgccccgattcatcgtccaagttcttcataccttcagggccaacttcttagcagcaagaacctccgcttcgagggttggctcccaaagaattgtggtttcagccaatagcgctgtcacgacgtacgggtccatgtttgatgccgggcgacggtcttccaagtagcctatcagcaaggagatttagcattgtaagggcaagttaataagattgagttgaaaaatgcaaatactaagttgcacatttgtgaattgtgaaaacaacattacaagacatgcatttgctgatgttgtgttctttcatagtttcagaaaaaaaaatgtttgtattttcaactcaaacctgaaatatttggagcgtaacaacgaagtattgaattacggaagtacaaatgagcaataggggcagttactacatgatgtgcttatttgctataaaaactatgttactctggttttggagggctcaattggttgcttaatataccagtggatgttagtgttttctgaatcccaaacacaacaatttcaggggacatggaagaacatataccttttcccttcgcctcggtgtctcgccccacccgaatagagcatccacggtttgccacaccctttaatgaaatgtttcgttagtatagcttaaaaatagaaattaaaacataaagatataaaaaggccgctgaaaccatacccatgagaaattgtcaatgctagctgtctcgtgtaaacctgtcaacctcctttcatttccttcaccatatgcacttatatgcaagtcatggcgaagtgataggtttaggattgccttcttgatcacctcaaatcctccatcttcacgcatactcttggtgctacatttgcaagacaatcagtatatttcaattgtttgagaaacaaagaacattcattcagtcaatcgaagtgaatacaggcttattctggatttgtattcaataacaactagtatggtggcccgcgcaaactgcgcggctagctaccaatattccttatttctattccaaattttcatttttttttctaaattgtatttttatatagattgtaaactcttatttcaatattttttattttttatttttataaattaaggttataaattgtatttcaatatagactcaaacttctacttatattttctttttttaattccaaagtttagttagttctaaattgtatactgatatggagttttttctttcaatattcctttttttaatttcgaatttaagctatttaaaattgtatttctatatggactctattattatttttctctgattccgtatttcaattagttataaattgtacaccagtatgaactctagccttctcttccaatattcattattttttaattatctatgtaaattgtttttctatatggacttcgattaatatgagaatttctaggccatgagagcaaacgcggagtccaattttcttaggctgtgtttagatccaggggtgaaaatttttgccatgtcacatcggatatactgacatacatttgaagtattaaacgtagtctaataacaaaacaaattacagaatccgcctgtaaaatgcgagacgaatttattaagcctaaataatccgtcattagcaaatgtttactctagcaccacattgtcaaatcatgtagcaattaggcttaaaagattcgtctcgcaaattagtcgcaatctgtgcaattagttattttttcgcctatatttaatacttcataatatacttcatacaggtgttaaaacgttcgatgtgacagagtgaaataacttgtcagcggatctaaacatgcccttattacttaaataagttaatgcattagttcttaatccaattggttaaattagaaataaactttgtgcatgtggtttgtttgatcgtttccatctcaagttttttttactccgattcctatagttactttaagcttccgtaaaaaaaagatttatattagttgtataaccattatggccgtgtttagttgtttaggtgtaaaaattttgaagtatacggacacacatttgaagtactaaacgtagactaataacaaaacaaattactgaatccgcctgtaaactgcgagacgaatttattaagccttattaatctgtcattagcaaatgtttactatagcatcacattatcaaatcatggcataattaggctcaaaagattcgtctcgcaattgacatgcaaactgtgcaattggtttttttcgtccatatataatgctccatacatgtgtccaaacatttgatgtaacgtttttcgccaaaattttttggaatctaaacacaccctatattaaatctaaactgttataatctggatctactatgactcaatggttattttttttctctttttcttgattaacattggaatttctatttttcttgtctgttttcactttttctatctttcttgtccgtttctattttttcttttttgtccgtttccaactttttttttgtctgtttacaccacacccaatctttgtttttttgtccatttacacaaaacctaatcctaatacccttctatttttccttttttcttgtgcatgtggtttgtttggtcatttccatctcaagctttttttacttcgattcctatagttactttaagcttccgtaaaaaaagatttatattagttatataactattatggccgtgtttagttgtttaggtgtaaaaattttgaagtatatgaacacacatttgaaggaattaaacgtagtccaataataaaacaaattacagatgctgccaggaaactacgagacgaatttattaagcctaattaatctgttattagcaaatgtttactgtagcatcatattgtaaaatcatggcgtaattaggctcaaaagattcgtctcgcaatttgcatgcaaactgtgcaattggtttttttttcgttcacatttattgctccatacatgtgtccaaacatttgatgtgatgtttttagaaaaaaaattggaatccaaacacaccctatattaaatctaaactgttataatctggatctactatgacccaatggttattttttttctctttttcttgattaacattggaatttctttttttttgtcccttttcacttttttctctctttcttgtccgattggatttttttttgtccgtttccaactttttttttccgtttccaactttttttgtccgtttactctttgtttttttttccgttaacacaaaacctaatcctaatacccttctatttttctttttttcttattttctttcgattaacgggggattttctagaccgtgagagcaaacgtggaggcttctttttctattactttatagatataatagatttaacacctacgaacacttgatattcggtccgtatttggattggtattttaggtcttacacatatgttttctttcctatcaaattcccaaggaatttatttttgtctctgaataggcattagttcggtcaacaaagttgttctctcaaaggaaaaatgtcagcaaagctgtgttaagtgttctaagctttgttcttatgctgcaggatactttaacatcagaagaagataatgaaacctgtagtttgtgtggcacccagctccattccagtctccctgtcagtacattatatatgttcagtctcctttaacgtttgattcgctttaaagttggggacaatttactaggacatacctgaattggtttggggtcaagggtaagcactacaccagcctgctccgttattctctgattacagtgagcaaacgataattagaagtgcttttactgatgcagaaattgatataagcaaaagtatagccattcataggatgcaacattctgatgttttgaacaaaacaaagatgatggctttcaacaagcgatttgtaagaatgtcaaggtggatcacaaaatgtgcacatgtaaacgtcttggcaataatatgcatgcagcttgatttttaaaccatggtttgaaaattaagagagaaaaccaaaatttcattatgtagggaaatattttattattattatttgaaccaaaatttcattatgtagggaaatattttattattatttgaaatacctcaagaatatatcttgaaatccatatgtggtctccagcttcaataccgacactaggtccaacctggtactcccactgcatgaataaggattgtgaagtttcacttgttaaacactaggatttgttcttcatagaagttaaaacatatccactgattcagaaaactaattgacaaataacaacacacatacctgaccaggcatgacctctccatttgttccactaatgttaattccagcataaagacatgccttgtagtgagcatctgatatgtcacggccaaacgatttgtccgatcctacagcgcagtagtatggaccctgtaatatccagcatgatagtgttttattaagcatacacaacacatggacttaaaccatccttatctttattattatctgatcaacaaagctccattcttgttcagtataatacctggggcccagggtagcctccaacgggccagccaagaggccagtttacgtctctctggagcaaagtgtactcctgttctattccaaacctagaaaaatagtgcatagaaaatgtctcaacttcacatgtaaacaaaagtagatggaaaaaccatgttttctattgtaatttatagcacaaaagtgcttgatgtttagttaccatggcacttggctgacaacctttggatcactgaatacttgtgcagccctgttacgtttgttagtagggatgggttccccagctggtgtgtaggtatcacacataacctgaaacaacagattttgtatcagctagcatgcgatttttcacatgcgccactaaccattgcacagctaatcttttatgtgcaggttagtatgaaaagcacatttgaaaaggataaaacattaaggagaagggatggtaccaatatgttgttgccacctcgaaatgggtccttgaatatagcctgtgggctgaaatcaggggggacagcgcaagagaagagacagaattagaaatctagaatgctttactgaagaatcacatgtactgcaatattttttcttactataagatgacttcactatcttctcctggagcttgccctgtgcttgatccatcgtagttccattttggtagctccgaggggtcctccactggttttgatattgtctgaaatacaggcattcgatttttctttcaagggccaaagaggtagaaagtaaataacgaaaggaggcgctgtgtacactgctaatcccctaaaaacgcaacttctcttcctaaagacagcactggtatctttatccaagaacaagaacatttgtgataatgatgataccaagtgcatacccttgatttgcttctgaggtcaattccagttcctccaaccctgcagaatgtggcaaaaaggattgcagattcgttaatatattgctgctttcaccaggaaaacgcatcggggattcgcactcctgaagtattattattcaagtgtgggaactgaaaagcagctagtgtgagtcaccaccagccaccaccatgcttgagaaacttttatctattttaaggcaaaacttgtactctactaatgtttgctcacagctaatcctatgattcatatctcaaccatccaattccctaatcgaacggtgcagtgcaaaacctacaaactgtagcagtagtactaaattggtgctagtaaaaagtgcggatttggcttatctgaaatctgaaagtctgaaactgctgctactgctactgttgtgtgggtcaaaccaagaacagaagcgtcactgtgagatgcagcatttgcagtaccagatgtactcggcgatgatcttgtcggtgaagggggtggtgtccatgttgagcagctgctccatccgcgtcaccaccccggtggtctccgtgctcacggccatcaccctgaaccccgacgtgccgcgcccggtcctcctgactccccacaccctcccccccgccgccgccgcagccgccgccggcctcgcccgcacggccccgacctggcactgcatcgccggcaccaccgcctgcgccattttcaccccctacagataatcaccaactcactcaacctgcatcaaacaaacaacattgtcatcacaaaaacaaacaaacccaccaaaacacaaaatgcaggcattgcacggactcaccggaatgcagcgacgaggaggaggaggagaggaggcgacgtcgatggaatttttaatgcgaggaggtgcataaatatttttagtggcgggcgggaacagcagcatcttggcttttgctgaggggatagggctccccgcggtttgggtggacgagatttctggcccttgcgaccatcggaggcaaccagcacacaatccaagcgtccccaggataaaattttccccaaaattttttcttcttcgatttatcaaatcttttctcttctcctggatatggaagatgcggctctccttgtcacgtctacctccgatcgcagcagcgacccatttattgttgtttatgtgcagcgttcattgacctgcaaattgtacatttagtatttgtttgttatttataatcttgggggggggggggggggatgcagccagaaattcagaaaatacaagactgtcactgaggttatgactgaccctcagatggtgcaataattgggggaggagattagcggtttagaaacgtcatctctttgcaggtgcagcgccaacgggttgatttggggtccagaggtcatagattggattccatctggtcggtggcaacaaattgtgtttgtttgcttatcaacttgcagttttgtagcagtagatcaggtggtcatgtgagagtgtgagacttgagcagagagattctgtggagctttgcagcatgagcaagtgattcattttttatcattagtcatatcatgacaatagtgaactcaagttgtaactaatcagaactgtaagaccacaagacaaaagaccatgatagttgagttaaaatctaatcagaattgtggatgattgaggtggggcaaatgtttccagacagattttctagtcagggagaaatgatacacctagctgatcactgaactttatctgtcaggagggaattctccaaactccagaagttaaatttcatgcttcctgtgcaatgctagcattcccctcgtgtactgattcctagtcgttctatacatctgaagcaacatttcaaagctctcacacgcgtcttcgtacgctacgcacctacaaaatttcaacttgaagtctgtaaattcagttaaggattgctcaaggttgcagctgactgcctcaagaagctcttcaagggctcccaaaatgttgcagaaatcgacttggtcatttgtgcctccgtgttgcggcagatgccggagccaacacatccattggaagggctcatcgtttttctctctcactgcgagcccaatgcacatcaatgcctccttgaagttgcagctcctgtcgattttcttaattatctcatcaaaaaatgatctttggttgcttctgagagctttcgagtgagttgtcgtacatgaactagatggtggaagctttgctgcaaccatgcatgccttcctgaaggttgcatcatttttcgaaagcagcctgattgccacatgcaacaggagagcaaataacgaagttcgtgcctcctcttgggacttaacaaatggagagctccagtgtttctccgtccaacaatgaagggcaatatgcgtaaatccctcccacctgcaacaacagtaatagtgagatgctgaaacactagacatggaacactgagaattttacatagatatgaagagtacttactcgaagggtggctcaacctcaatagcaagggtcaaatggagtgagcaatcaacagttgagttcacttcaaatccaccaacatcaacatcagtgtgagcctcgtgaacaaagcctctaggaacatacattatgtctccttcaagcaaaatttccatcctcccaccacaatcatccaccaagtcatctaaaggttcaaaaggttcatatagtctaggcaaaagtaactttgtgtcaggccaaatcatccatttcttgcatccaagcagttgccaaacaagtacacagtgatcatcataatgccgggccaggccctgagctcttggaggggagaaatatatattagctcccacagaaggttgaccgaataaatcagctacagcagaagctatagcagcaatcttttcagaacggaactccataccacgcaaggcaactgagaaaccatttttaaatgcatccttacatttttcaacgaatgcatctgcatcctggaaggtcatcccatcatcaaagaaatgttcctccatcgcataacctattgaggtctgatcacattggtcatttattcttacaactctgatatcttgcctatacttcacagtggcacccaaggaaccttgaacctcacggagaaatgaactaatgtcaagttcatctgaagcaatagcggggcaagaaacaatcccatttacaagtgactggatgatagtatcaggtgttttcagatcaaattcattaagcagtgaagtgaatacactatccacatgcagattcttctgtttcctagtgaccaagtaagtcgacttctcccagtagtttaggagaaaattttcatagtcagataccgattgtccaaaaatgcttcgtctgacttcatcaggttccaggtgggctggacaggcaatattcattgaaagcctaaaaatagcttcagatatctcatgttctttcctttgaagttgattcttcgagttgatgcagtcagttgacgatcccagtttatcaacattcttccagattttatgcaacaaaggcagaacttttctaactacatcctgttgcagattatgcaaggtatcaacttgacaggaattcaccatgaataccaatgtgtcaaccatcaagtagaaggatttatttgctttagaagcactttttgagcactcagtgcttctgatatcaatgactccagaaataaattccacctgagaaaatagatatctacaggaagtgaattcaaccagtcgaagatattcatcatatttaaaaggcctggcaatgcttcccatctagttataaactatcaagccatcttcatcataacatattaacatgctaccagaggaagtttatcataataactgcagacttgccattgatctatacatgggcacattggttaagttgatcttgtgaacataagagtcaagcggttcttgacatttagtagtatatatcagtatagcacaagctactaaagccgaaatacatattgaatttgaaaaaacaatcagatcaatcagtaaatatgcttacaatatgctctgcagaacagcagagcccgcaagatgctccctgccagcagaagaagcagagagatccattatagcattacaggcagcctctgccactcgctggctcccacgccgcagcgcccgtgccaagcaatcggcaatggcggcatcggacgcaagcgtctcgctagcctccatggactggagcgccgctgcacccagcacctcgcagctcagcgcggccacagaagcagagctgcattgccaatttctgcacaagttaaagagaaaaaaaaagaaaaaagaaaaaaaaaacagaagggggaggaggataggagaggctctgtactgtacctggaggtgaggaggagggggaggatcgcgacgagggaggccgggagagggtgaagcgacgggcgggagcgcgagagcgcgcggcggaggaggcgggcgacggtcgagtcggagccgtgtggagtccgccggtgagtggatcgtgcggcggcggcgagcaggatggggaagacgctccggtcgaaggcggcggaggcgccaccgccgcgcctcttccgcttcttcatctcgacctcgcgaagttcgattcgtggcggagctccggcgaggccgccgccgtggagaggagagaaggagacggactcgcgaatacgtgagatgaatatccgtgtctcctatagcggttacgtattctcagaggtgactcaagcaaattacgcttttcttccgaagaacctgcctttgtactttacgccaactgcattcttggaaatgaattgaacatattccaaagtgaaattttatgatcaattttaccatataacatttgataccttgaggtaccaaattttacacacaaaattttttgatgcctcaaggtaccagattttacacacaaaattttgatacctcgaggtaccaaattttacaccagagagtatctcaagataccaaatgttggatggtaaaattgctcttaaattttactccctccgttccaaaaaaaagacaaaccctgggtttccgtgtccaacatttgatcgtccgtcttatttgaaaaaattataaaaaaattaaaaagacaagtcacgcataaagtattaatcatgttttatcatctaacaacaatgaaaatactaattataaaaaaatcatataagacgaacggtcaaacgttgaacacggaaacccagggtttgtcttttttttttggacggagggagtacatgatggatgatgttaacacaacaatagcaatttgaaaaaaaaaatacttcaaggtatctaatttttacaccaaaaaaaatacttcgaggtaccaaaatttacactatgtgtagtatctcccggcattttttttaagatgataaaattaccctattccaaaaggcaactaatactaagaaaattagtctcaacatgatggatgatgttaacacaacaacggcaatttgatctttcagaaccaattggcagaaatcacttagtagcaagagggaatactgtatgatatcgactttgagctttagcaatcatactgttaggttaggtgatggaatagttcgtgttctgcatgctctgattttaaactcttatctttgtaccaaaagtccaacacgattagctcacctaacgcaaatccgtaggcgccaagaaattaaaacccttctctcccttttgctgtttcctgctgataccagtgctatatataagaaggctaagctctgttcattaagcagggagtaataaatcacccatcctgcttaattaccatctattcatcattatcctctcctctcttatgtgctaggtttaattttgtgtttttttttcatgttttgagtctgagtttaatttctggcttgtaagtcgaattttcttcttttcttcgtatgttttcagagtttcagtggttcgttaatttgctgatttaagttggcgctatttgtgagcacggccatggaggacagtgatggaaacaacgaaggctcgctcgccgaacctaaacatggcatttgctcatatgcatgcccttgatgatcacaatcgtactgtgcactgagtcctccatgctcttaaatttgtgctgtttcgttttagttgcctgttttatctgatggttagataaaagaagtccaaaaattcagacattcagtgctgtcttccgagtttttctcccgacagtgtttctccgtcctttgtctcgttttgtttttagtgaggattctgttggggctccttgattttttttttcggttttgctagtatttcacttgcgacagatttttatatttctatcttttactttttcgttcataggatctttatattaagatttgtgttcttgtatatctaacttgtagttatactcatttacagtgcacttatactcagttacatagcacttgcatcctgttacaattcaccaaaactagatttttacaatagttcttttctctaaatttatgatttttgacatatttgtctctcttttttgttattttatttaaaactagctatatccattagttgaaaattctgtaagatttgaagacataaatttgtcgaagtatcaataggtagtccttttttcagttatggattaaaaaccaacggcctctacatcctccaggttgggcctccttgatatgccttggaataatatctaaaacttatggtcaccttaatctgtagactgttcagaatcagaatgaacagttagaaggacctcaagtcatcgactaaaccatttggcaaggcaaggcaaggattctgccttcaggggacaaggattcttcagaattgttccaaaaaaaaagttgtaaaaggaaaagcaagaattctgaccagcaactgtttacgaccatcttaacaaaccgatgtggcacattgtgattgaatcttggatcgaggctggacttcccttcatcagttcatccattttgtggaaatttcagaattcagattctggagtaatgatcgtgatccgtacgttgtgatgtgcatggaaacagattttgaaggaactacgttgcttcgagaaattttcacgatcgctgaggctatgttggctcttggctctggtacgagtggacaagcccggaaaaatcttggataggaaccccgccgccctcaccgattgtgcactgttcgtggccgccatcaaggtaacagttggagatggacgaaaggcaaaattttgggaatccaactggataggagatcagccgttgaaatatctagccccaaaccttttcaagcactccaaaaggaagaacaaatcgactcttgaggcaataaccaataatgcttggatcgaagatatccgcggaaggtgacaatacagttgcttcaggaatatatatgtgtatgggaagtgctccacaatgcaggagatgtgatccatgaaggggctgatgacacaatcctccggcggtggtcagccagcggcatgtatacggcgaaatcagcatatgccatgcagttcatgggcaaaacgattttcggaatcagccgagcttgtatggaagacttgggcaccgggtaaacacaaattcttcgtgtggttgctggcaaaaaatagaatatggacgacggattgattgcaatgcaggggctggccaaataattacttttgccaactctgtgttcagaaatcttgaaatagtacggcacctcttcatggagtgccccttcacgcagcaggtatggcgggacattggtcgcaagatcaggctgtcacgtttcctcaatatgaccatagacgatactctcctcaattggtggcgcgagcaaacagatgaggcagaaaagttgcaacagaaaaggctgcgttcagtattcttggccacgctttgggagatttggatagaaagaaacaattgcatttttagaggcactgagtctacgccgccggcacttgctagcaagatcatagatgagcttcatttgtgggaaatggcaggcgccaagggagtgcaatgtattatgttaagagagtaggcttctatttttctaaagcgtgtagacaggaatagtcccttttatacatttttgttttcttacttcttctataatataaaaccagctcgctaggttctttaaaaaaaaaaaggattctgaaggaactcgtgtattctgccaaggcccggtatgagctgacgacgttgttgtatgcttgagattatttctctcaaaaacattatataagatgctattatgcccaaatattttcatgggccttgtctcaaaaatgctccaatttccagcatctgcttatacatacgaacaagtacattttttctatacttgctttgccccaaaccgtttctggatctgggaacgtgtccgtgtgcacacactatacatatcaactagtaataaatatcaccaaagatttaaaaaaaataaataaactgtacatgcacttttagtactattatctatttataagatcttgtaacgccctgcaaataattagagaaaaaagaaaaagaaaaagaagagaagagaagaaggaaaaagagcaaagctagctagcaggccagcccatgcagcccagtagctagctggcccagcagcaaaaggcagcccacagtagcatgcaagcagcagcgcagcaagcagagcagagagagcagagcagcagcgatgtactgtagcaaaaaataatcccacctcgccaattcaacctgagagggagaccagcttataacgatgagcagcccgaaatttttcgttaaagtgtggtccaactgaataagataatccgatactattttttgtcctggctcatcttcaattttattatatgtatatgtattttttctataattttcggtaataattatttagtgagcaagatgcatagacaaaaaaaatatgccatggcttctcttccaaccttacaaaaaatgaaaaaatcagtcttactaatgtctacatcctccataaaaaactatttttgaatttaaatctcgacatagtttaccaatgtttttattatagagggagtagttgtctactctacagtgacaagattagaatagataaacaaaatcagacccttacacaggacacaacgcaatcactgtctcactggtatctacagtaacaatggctgcaaagtcaagttgctcaatggaagtggtggggcaagatactaataccgaccatactgagaactccctccgtttcagacgttttaactttggtcaaagttaattttttaaaattttaactaaatttatagacaagtaatatttataatactaaattagtttcatcaataaataattgaatatattttcacaataaatttatcttgacttaaaaatgttactccctttgtcccataatataaaaacctagtatgggacgtgacattttctagttctataaatctggacatgctgcctgtccagatttgtaatactagtaaatatttaatgtaatcataagttcttatattttgggacagagagagtattattttttttcaacaaacttagttttagttaaatttaaagtagttcttataagctgaaacagagtgaatggataagtaatgatgtccacgtagtgcattgaacgtagggaaagctatccagtttccggaacagtacactgtacagttcccttcctcaacggcggagcaggattatgcatgataggagaggggggccagtcaagaaacaataaaaacaaaacacacgtataatattaatcacaagcgatggcttgtatagaaaattgagatacggtgtcattatatattgaccatacttattacttaaaccattgcgttatcctctatgtacaagcaatcagatttcgtcaaaattgtcaggatcacctgaccccgacatgttcattgcttgtgctagctgttgaatgctgatgcttgcaagatggtctaaactctgaatttgttgatggtttttaactatcaatttgatatattatgtcacgttttgcaaaatatccacaagtactgactgggtttcggactttcggttaggtacttgacgagcaggcataggtatatttgttccattttagacccggtaagcttgttaagacgtattcctattccaccgagacaatccagttcgttgccatctctactttagaccacttagtaaaaccagatcatttagtatatagaggatatctatatgttagaaggatatccgtgtaggatcaccgttcattccgcatccaatggcagcactggttcctagcttctcttcagtcgttcggcctagctcagagccaaccagggggaaacgtacgccgctacaagaaaccccgtcgttttgccgcaggattctgggccaaattacgacggaggagagggtaggaaactatgaattgatgctgtcgttgaatgctgggtaaacaacgatccggcacagatatcccctttgatgtagaaatcctcttcatcagaagacctggttccgattgagtaaaaatgggctctcacggttaacctttgcatagaccatagaaacatagcccttgttaaagtgcccgttaaacctttgcacagaccatagaacgcaggcacgcagcccatgattcaaacaaaaaaagtagattaagtagagtaattaagtatatccttttgttctagtacatcggagacggtgttcagtttggtgactacaaattaattaaagtagagtaacgaaatatccactgaatgtgcgcctgtgcgagtgcgacgaatgtacctaacagtcaatgctgttcctctatagttcgtctgaaaccagcgaattaatccgactaggcaacattgaactagtgctatcaaagatcagcgcagctgccgtgcgtggttctctcattggctggatcgatgttgaaatcagaaccaacggttttgaccggtttcttaaacagttaaacccgtacataaaatcggcgccaattcagcttgttttgtggaactgtgtgtttagttatcggcaaatagcacacgccaaattgccaactagctagctatctcgacaaattagagcctcatccaaaacgataggttggcgatgcgtgtcgtccaaaactaccttagtacgttaccgtacctataaatatgcatgcaatgctcgacgctttgctgcacacacatcgatcgctaatccatcaacctatagcttaacgatcactgccattgcaatggcgcggtgcactttgctcgttctcctcgtggcggcggcggtggcggtcgtcccgctcgccgccggccagccgtgggctacctgcggcgacggcacgtacgagcaggggagcgcctacgagaacaacctcctgaacctggccctcaccctccgcgacggcgcctcctcccaggagatcctcttctccacgggctccaacggcgccgccccgaacaccgtctacggcctcctcctctgccgcggcgacatctcccgcgccgcctgctacgactgcggcaccagcgtgtggagggacgccgggagcgcgtgccgccgcgccaaggacgtcgccctcgtctacaacgagtgctacgcccgcctctccgacaaggacgacttcctcgccgacaaggtggggccggggcagctgacgaccctcatgagcagcaccaacatcagcagcggcgccgacgtcgccgcctacgaccgcgcggtgacgcggctgctggcggccaccgcggagtacgcggcgggggacatcgcgaggaagctgttcgcgacggggcagcgggtgggcgccgacccggggttccccaacctgtacgcgacggcgcagtgcgcgttcgacatcacgctggaggcgtgccgcggctgcctcgagggcctcgtcgccaggtggtgggacacgttcccggcgaacgtcgacggcgccaggatcgccgggccgaggtgcctcctcaggtcggaggtgtacccgttctacaccggcgccccgatggtggtgctgcgtgagtaggcgctggccatgcgtgaagctagaataaaatggcacaaattaagagtgttccaccagaataaatgtattgtatactgaataaacctgcatgcaggatatctatctaagctgtaaccggattatactattgtactatcaaataaaaaaaagtgtctatatgattatatatcatcgttaaaaattatagcatattcttacgctcatggagtcaggatcgatcgatatatatatatatatatatatatatatatatatatatatatatacacacacacacacacacacacacacacacacgcttgaccaagacgtaaatctcgagctattaatatcaactaggtatcataagtaataagtaattggatcccgattgttcaagccttttataaccaaggttcgttaaagagaaatgaccacaatgagtcagactaaatagaattggatccataaatggatccaagttcaatccttttataactaaggtttgttaaaagagaaatgaccacaatgagtcagactcaacagaattggatccattcctaattgcgataattaggatactcttgatccctctcacaccctctttgaaggagagatgtttagtttccgacttacttcatgtattttataaactagtaatatatctgtctaacattatagcgatatttgttaatgccaataaaaaaaatcaaaagaaccaaaatttctttcttttgaggtcaagctgaggtgcctgctgatacatccctgaatgtgtacaagcatgggctgaacaggcggcctggtaaaaagaaaaaaagagcccgattcagcacgggtgaatgaattggaccggcctgctaaataatgaagccaataaaaaaaatggaacaagtctattttacctccctcatctcttgcccctgatcaaatcgtcccccttaactgcaaaaccagttataccacctcatctatcaaaattggtgcaaaactgggtataacatctccggtttttaatgtttgacacacttgattttaggtgtcttggatatacattggaccatttgtcttatttaattttattgtaaaaatataattcatagtaagaatatgtttaataataaaaatcatagtaaaacaaaaaagcacgagatttttgaaggagtaaaatgtatgggcggcccctaaacttgtaaggctatgtcatctaggtccccaaacttagaaaatacagttttgggtctctaaactcgcttagccgtacatcacctgtccaaattgcatttgagccagtctactcgccgacgtggactgccagcgtggaggggcggggacagctagggtgtcaaatatgcaaagaacccccctattccctcatcctagaaatcatatcgaatcccctgtccccattttttccccaccatgctgagcaacgaaatccctagcaagctcttgttcgattcactatccccttctttgattccctagtgacgctgtgacgacgtcaagatcaactagagctgcgtgcgattcgtcatgtcctaccatggctacagcaccaacaacaactccgtcggtgtgtggccgtcatcggcaaggtttacaataccgctggtaaccgcgcggttacagcggttaccggccttaccgtgggggtacggtaataaaaataccacggtaacctccttaaattcaaataaattaaaaaataatttaaatttttgataaattttacatagtttcgtatggtttttcacgattaccgcggtaaccatgcttaccgccggggcgcggtaaccccgggcccggcggtttgggaaaccctggtcgtcggatccaccaggagctcgacgacgccaagctcggcactgtcgcctagcccgagcgcaactacatgtcctacaactactgcgcaaatggctggtgtggttacatggaatcccgttgattaattgctcttaatacagctgagaataaaggcatcatcttttacatcaggttatttcttctctcctgttgtagagcattggtgtcttgcaagcattttgagtttacatgtgcaagttttttcattgagatggaaatggatgtgagttttggtattgggaggatcaatataaggagtatttgacaaatacaggacatctggctcttgcagcttctggtatccatgcaaaatgtccagctcctgttgtgcatgtgcagagaaatgaattggttgagctgggttcagacttcatagggacatgaacatgctgcagagcaacttgttaggactgaaatgtgtagtagcttgttgtgtatttgttgtggtgaccaagatgtgtactaccttcaggctagttgaaaatgtgcaattatctgaaatgtactgaaaatgatatttggcgaatgaaatgatgagggaatagattttttttttcatatttcacaccctagctgtccctgcccctccacgctggcagtccatgtcggcgagcgactaggtcaaatactatttggacaggtaatgtacggctaagcgagtttagggacccaaaaatgtgtcttctgagtttggggacctagatgacatatgtctataagtttagggcccgcccatatattatactctctttttttaaataaaacgaacgagaagttaacggcgttcaagcattaaaactagagagtaattcacttgccagacctgagattagtctggatggacatggaccgacaaaagcctacttctaaagatggtagtactaattatgggccgaactcgagtccaatgtggagttggacgcggctgggccggcagctaatctgggctttgggtttcgcatcccaggctgacacagcttccgccgcatccctcgctcggcccggacctaagctcgagccgacgttgcacgcgtgggagccgagcggggtccggctcgagcccgagccgagccgagctgagccgagcagagcagcgcgtggctaaacctagtcgtcctctcctcctctcctctccccgacacgagcgattcccatcgccccccaaatccccatccgattccaagccctaaacctcccgaatcggtcgaggcggtgctcgatccggccgctgcatctccggattcgagcggggggcgttgccgcggtgcccggatccggaggaatcgcgccgcggcgggttttctagggttccacaccgtcgcgcgtcccggcgggtgttcatgaaggccatggggtacaataacccctacgattccagcggtgagttgcgtcgggttaggaggatttttgtgctggtaggtttgggcgcgcgcggttaagccctctccaggatttgtagtttgtatgttttttttttgtttccgtcagattggttgtctgctgcgtccctgcctcgtttcgataacatgtgtctttttttttccttcaaaattattgcttcagtaatatcggttgattaggtgcgtaggtattgtaagaaaaaaaatgttttgttggcaggttattggttattatgaatttgtaattgaggcggtcaatgcagtgaaagacatttatttcatagttttactatgcattttatgaaccatggcctaagactctgccactatggatgaaagcctttgagacgaggttggcaatagttgcttctgaagtggatctgcttactgtgttctaataaagatggaccttttttttttttatctttctgatattatgtgaagttttaaggaaaccactgtttctgtttatgcgttcctgatcaactagagaaagatcctgctgccaaacccttggtgcagactgatgacatgacgtcggccagctctagattctggcttatcttgccaaattgtgaagcccaattgttgtgggcagttattgaaccctgtagttcacaaaatatttatgtcttttttctcatatagtgaatttcatggtatagtgacttgtctgttcattctatcaaaatttcagggactgacgacgatctccctccaacacaaaatagaggattaagagtgcgatcttttagtgcgaatggcagggcatctgttatgccattttcttacattaggccgcacggtgatttggagagtgaaatacatcaggttgagcaagaggcgtacactggtgttcttagagcatttaaagtgcaatctgatgctatatcctgggtatgtatgtataaaaaaaagaatcttgtgctaacagttttagtagccattctttgcacatgccttttttgtgttgagaataaaaaatgtatattttttgtccaggaaaaagaaagtttgatcactgaactcaggaaagaattaagagtctctgatgatgaacacagggaactattaaacaaagttaatgaagatgtggccatccgcagaatgaggtcttcatacaatcattcaatttttgttcatgcacatgtttaaaccaaccattttattttttcgttagtaatttatttatccttcgcaatattttgcagggagtttagacagggaggtggatccctgagtgcacagcatcgtggcagcagaatttttcatgatacagaacctggcccagctgcaaagaggcaaaggacacccctttctattccttcacattctgctggcctccagtcccctgcgatgccttctccctcagttccttcatctacaaagtggggaccattttcaggaacaaagggcaagaagactaggacggtgtgttttgaatacgacaagtcatgtttgttgcattcccatagtagtaatatcatgagttctttttttatgcattacagaatacaccactcgctgtgccatccgcggatccaacttcattgattaaccggaaaatttatacaagatggccagatgacaataacttctatgaggccactataactgactataatcctgctacggtttgttgtttaatttcactattatttttgctacttgctgcagatttgcatttttgtcaagtaagcgaagcttatggacacccctgatacttttcagggtaaacatgctctcgtctatgacatgggcacagtagcccagacttgggagtcagtcagacttagtgatgtaagcagtattttcaaccattgccttgtttctatctgtagatgtttttttactaatccataataaagtttttctttcttgatctgtggccgtgggatattcatatttttatgttacatttgatttgttgcaatgacaaactagtgactgtctgctcgcgtgcccaataacatagaaattaaacaggaaacatttttctgttgctgcagatttattgtcataattacgttgatagtagttctgcaggaaattacaatagtttagatggcctaccaaaactatgtgataccttctaagtaactcccctggagcaacttggaatatgatcttagtatcttaccactgcagctgatgatgcggcaattattcaacaaattgagggtcatgggggttaagtagaagctagataagatttgggagagtaaaaactagataggactttggaattgagcagcatggctagtgcctgagtagtcatggaactggatgtaaaagagggtttttatgacaccttacacccattttgcgatgagtttgtattttttgttcgcggagtcattaccatgtgatgggccacattatttgccttggtggcaagaccaccgtcagggccgccttgaggagatgtttagatacgttatttttttcaagtatagtgggttttaatgttttgtcaggtgggacagttttagaagtcaaaatgtatttttttcctaaattttagaacctttggttatctaggtttctgaagctgaactgtagtgtaaccggtaggagtactaaaatttagttagttattagagtatagagtttgttgaatagcatgtcatctgttataaatttattaagttttacttgtttttagctagaacatgaaaattgttgaatcgtcctggctaattgccactgtttgtttaacatttaatcaaaagaagatgataaatcatttctcagttggcacctgaagatataatatgggaccttgatgatcaaggcatctcaaatcgagatggttggggtcctcatcctgggatgaggaggcacccaggcaacaacggtacaatggcaatggcaagtaggggaggaggaaggttttctcgaaatgagcctactaaggatagtgctcctccccaaaatggaattaacaggaatattggtcacattgatgtacctaacactcgaagtgttgtcatagaggtaaattatctcatgagatcagatattatgcattcagatattggttttttacctcactattgtatgttccaacccaggtggagagggttttgtccaatccaaatatgggtgagatcgaaaaggccaagaaacttttgcaagtgagttggcttgtctgttgttatgcaattttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaaatagtatctttgaagggtgatgagtattagccacattagtatatttggtttttttatacacaacccaataattagaaagagtgaaacctggaacttcaaattctgcccaaacattgagaaattttggatgtgactcagtatgttttgattgaaaatttgtcagtctttcaaatttgtttcagctacttctcttcagctattattctaactagtcattgtatattacagaagatatggccgtcggggcccaaatggtttctgctggtgatcacatgggcaggaacggcgttgcttgttagtaacaactggcaaagtgttggattttgaggattgtgtttgtgaaagcgcctgtgtagatcaccggtcaaaagaaatcatcgatggggcattggcatgccaaaaatggatgtactgaacatgtccctgagaagggcctcttcttaggctgcgaaaagttcaggtcacaaggcgcagggcgcctttccttcaatgataacggtggctgtatttgccctctaacatacttgaaggaactctaatcatctagaaatgattattaacattccaaaactgttaaaccctttgccaccatctccaatctgtctttgatgattaatcaaacgctccgatctgtcttcgatgatatcttgtgtggtgccggcttccctgccctcgacacgggcacgacacgccgcaattctcgtcggatctcgattctcaccgccggacggccggtcaggatggagagctccagggcgtccagcatcacacataaaaaacatgcagtttgagatgtggttgctctgccataaactctgcaatctgaatctggttcggccatgtagaacagcatggattctctacttctcttccaacccaccaaactgcagagatacataatgctgtcactgtctcactgatgtctacagtaataacaagaatggctacaaagtcaaacttagctcaccggaagtggaggatacaaacaaataaatagaggagtaatatccacgtacattgaacctagggaaacgatccagtctcccgtagcaatacaacacgaccatcaaatccagggtcaaaagcaacgaactatggtgatcggtcaccagcaaacttattgttaacctaaggcatactcacccttcagcttacttcagccatcagaatacacgtatcctactccgagtttctctccatttaaccccgtgagatttgaattaaaacatgtatacatggtggtacacaactacattgggtaacttttaccagttgttttttaagcatatccactactcccttgcccatgcaagaagcgcacgacaacacaagttatgttgtcactgctctccctcttgtaggcctcttgcaagagcttctttgcagcttcttctgggtcatgaatcgatctggtcatgtcgacagcctcctgcataagagcaaatgcaaaagggggctacatcaagcacaaggaatacgattaagatacataaaaatcttctcttttcattttcttgaatttacctcattggttactacatcccacagcccatcacttgcaagaatgaggaactcgagagagtgatcaataacttcctcctatgacccacaaaagcattactgaacaaggtcatcatttgtgaaaggtgaatataaaggatgattattctgaagcctaaaaaattaacaacatatattaggaaatggttcttcaggtcgactaagaagctggcagtagaacagatcagaagtgcagctgtaagacattgataacaaaaaggccaaaaatgaaacaatgctgaagacaaaatatgtccctggtcgtttatcataccgccctattagttttgctatggaatatctggaagtgcctcaacaacaaagttttcagcaactacgacaagacgctgtgcggaagacctccagtggtcccatcgcagcacaaatagttttagctggcaatgtatactagattgggggaacaaatttctcgcactttgtaatatataggaccctttagcttccactcaggccctcatcccccgtacctcttcacaatatgtatgtaacttggtacaaattttgatcaataaaatgttcaggctggtagaaagccatccttaatttttccttcgaaaatttatgccacaaatatcccctcaataagtatatcatgattaagatggcaactactatcaatatcactcttgacattcaatccaatgacacaagggaatcatgattccaaacgttcacctactgtcatggtgatacctacatatgcattttgagaggtaagtagacataacaaacattaaattggtcaggattgcatacccgaatctcaggatccacaactacatactgctttaagagtttgtcaccaaaagcgcgagaaacagcaagcacaccaccaacacgccatgttcctaaggaacaaaataccatcattaggaacacgatcatagtccattcatatacaaaataagataatgtagtgcttagcacctgcccacattacaaaacctccagcatcttcgatacgttgtcgctcatctgtctgatcaggcttgtgatcttttgaaacagctatagctgcaaaaaaccagcagagcttctatgtgaagaactgataaattatcacagataacctacagattatttctcatggcactcatttcatcaccaacaaatcttgattctcatgcctggtacaatgcagatgctcagtggtaaatacaacattctaacaaaacaagcaaaaatattcgtaccttaagagaggtctctattaataatagaatatgccaaacataatcggctctcttgaatttttaagcataccataaaaaagaaaaaaaataatgtgtcatgctatataaagtcagaaagtatcaagtaaatgcaaccaggaagctgaagagatggtacagtgaactgtcaattaccatttccccccctgcatatgatagccctagagtctccaacgtttgcaacaaagagacggtcaccaacaaggacagcggttgatgcagttgatccacactggttttgactgctgtcagattctaagaattcactgtcggtacttttataagcatcatctacagcaaacaatatcacgtggtagttctgtcaattctatacacaaaactcaacatctagtgaattatggaaagagaacaaaccaatacctattgccactttggtgtcactgatgaactttggatgccttagaagatgactgaagagattctgtttaacatactcagctactttagcaccaccatgacctataaaatgaactgtatgtttagcatttatttttcctaaaataagctcaagagcttggtatatccacacttctagttcaatttaaagcattgtgccctagtatgagtaatctttaaaactttctccatggacttctcaccgtcatactagctctaactgcggaaataagaaatgttacaaggcaaatgaattattttgagcttttttatactatacaagattagcaaaggaaacataaatggtatgttcttttggtacaaaagagaaaggtctaaaacttggaagagtgtaatcttagaaatgttcctttctaaaatgataaagaattatcaatgggtagagattatgcacgaatgtgacaaattcatacataccatcaaaaactccaaaaagaccaataatctgcccatcaacagagtcaattcttgtctcgtaaaagtcttccatggaagcccttttaccaggggagctcgcatacccatagctaaacttaccattctggctggcaaaaaaagaatgagaaatgttgagcaaataggagagcaacagtcctaataactgcatttacaccataaaatcaagctaccatgacaacgttgattaattggaaatagaatattattcataaagtcactactcctaaacttccagacgcagccagattgcaggcactacaattattacagttcactggttcaaaaagctagaaccggttgtgttgtgtggtgagctacaacaacatgacctattgtatatgctgttactgaaagaactaacatggcatgatgcaagatgtcatattcatagaaaatgcatttgagaaatgagggagacgaacttccagcttgcaactaacagtaccaaatgcccaaaccgtgcattactcattagtttccttgatctcaacccatagaatgtataagcacatctaaggtggcctcttaccttttgctatcatgcccattaggacgtgctacacttaataattctccaacgtaacatcacataagttcattttagtctgtattcagaataaccgtccaaatttattcgacgcaactgcttatgctcagatcaggtatgtagcatatgaatatcctacttaaacggacaacataactccaaactggatttatcttgtttatagtcccaccaaaaagtactaataaaacaaacaaaaatgggattgcatagcttatcccatactccagccttgcttttgagcttaaacagcgtgttcaaagcaaaggaaacccacgcgagcagttatacgaaattcgtgcgatgcagcaagcaacgtatcacacgcctggaccgtactgaattgattagaactaaacattcagccattatctactagttgccagattatccattatctaaaacaaaaactgctagtcgccagagctaagctagacaatcgaattgactagatggagtactccaaaaaaaaaacccagaattcgggtaaagcaaacacgaatcagacccaaaaaaaaaagcgcaaaaagaggacaggagaggcgtcccgagaatcaatcgctcccacctgaggccgccgccgctgaccggcgatccatccgtggggatcacggagctcaagtaccccatatcccccccctagatcacacgaacgcgaacgcgaccagctcgtccgaatcccagcagcagcagcagcagcagcagggggaagcgcgccccacgaatcgggcccctcgcgcgagtcaaatttggcggatttgggtttgggaggagcggaggaggggaagggggcgacgggattgggccattttctagtggaagcttctcttgcttcgtcgggggagggtgatgggtgtttttgcacccaggtccttggtgttccgcgtatttgcacccgatagagggtgagggagtgtttatatccatggatgtaaagttttggcgtgtcacatcgaatacacacgcacacaagtattaaatataaattaataacaaaataaattataaattccacatgtaaactgtaagacgaatttattaagtataattaatctgtcattaataatatttaagcaccatattaccaaatcatagaataattaggtttaaaagattcatctcataatttagacacaatatgtgtaattagttatttttttatatatttactaatattttattaaatatttgatgtgatttggtgaaaatttttgccagcgatgtatacgggccctgagatgccgtgccgtggcgtggctatgcgaaaagcgcgaggtcgagggggtgaggggcttttttttttttaagtgagctaacatggctcgtcgtggttttctgcgggatccttcgagaacatcgatgatggatcaccgtcctccccgtgtggtggcgccactggattcgtgcgttgcgtgcatgtccgctagttcatttatcccctgccgccccgtactagtgactagcgtaccgtattgtttaacttcgacatcgagttgcggaggctcacgctcagaaattcaacaatggtgtactcaatgatggggtattttcgatcatcatctgtatctggttaggaaaaagagcagatgatggagtactacgtaagctcttttggttgaagcctttgtcaaccttgtcaaaataattgataatgctcatgggttttgggttgagtaaatagaacatgtcgcaaatccaaaatctataacagatcaaagaacagtgcaataagtattatttggaaaaatagcatgtgtaaaatccttttgaatatagaagtagcggagaattagtacgtaatatatacaaaatccttttgaatatagaagtagcggagaattagtacgtaatatatacaaaatccttttgaatatagatatacaaacagtaatgcaaactgaaatgaaatactctctctagcaaacattcagactggccgtctcggtggattcgaagtgatggtctcaactctcatctctgctacgtgctactcctaccttcatcctagaatattgctatctaggatgagcaaaattcctagatagcaatactgctaactgctgtgtaaatgtaatactgaactgtattcacagacttgtttgaatgtttcttggcacgcgtctgtaggatcgagatatcgactagaggggggtgaataggcgatttaaaactaaataacacctaatcaaaactaacctaaattgctaggcttggtaagggtgaactctaactaagcaactaagttatgttttgtaaacctagggtgatagtggttcaattatatctcaaggaaagtaaatcacactcctatgtcaaagttttgcaatcctaggatgatatgatctcaagtatgtctctagaaaagtaaattgcacaaatgtaaatgcgacaatcaaataagacaaggagacaagagatttttcaccgaggttcggaaactcgccggtttcctactccccgttgagacgagcccaactccaccgctcaaccacgaagccaccgcacgcccccttcgtcaaggggtgggcaaggcgggagccggcccacggagaggactacccaagcctcgatcactcggggtagttcttccttcactccgaaggtggtgaactccaacccactcacaaaccggcgccgggcctcctccacaatcttctcggagaggtcatcgggcaactcctccacaagccgtctaggaggcggcaacctccaagagtaacaagcaatgacccggcgtggagatgatcaagtgccacactagctctacaatggaagcaaatgcacttgactcttggctaaacaatcctctaacacactagatggatgaacacaaagctcaagtgagtgtgagaaaggtgcatggggtgtatgcaattgaattgggtgccaagagagcccccttgctgctggtgggggagtatttatactcccacccaccaaaactagccgttgggggcgaaatcccctaactctgtgctctgccggtctgaccggaggtatgtggccggtcagaccgtgctactctgcaacggctagaaaactagccgttgtagccctgtcaaagggccccatcggcctggccggtcagaccgacatggggtagccggtcagaccggcctcggctcggtcagaccgccatcggctcggtctgaccgaatacggctccgtcggctctgtatcggccatcccgagcagcaccatcccggcctccagggggccggtctgaccgcgcatgtgccgccggtcagaccagccttacgcgtcggtcagaccgccttcttgcggccggtcagaccggccagggcacgccggtcagaccgccactaccctgtgaagtcccctactatgtggccggtctgaccgcccctggtcagcccgaacccagtgaagtgtgtatgtgtgtgaaatgtgagcacaagtctaaatgcataatgacctaatgtggcaattaaaattatctctttgctaggtcattacccctcttaatagtacggcgaaactaaaaataaactagcaaatttgatcgccctacacctcgatcaattctaaattaaagcgctagttttaccgtcttctttccctttgctttgcgacgtcaattttaatccatcgataatcatccatgcgcacattcgacgtggacctaacttaaaatgtatagctcaaagacaacggttagtccacaattagcgcttgtcattaattaccaaaattaacaccgggggcctagatgcttcagcgtcccacccgtactccctctgtcccaaaaaagacaaaccctgggtttctatatctaacgtttgaccgtccgtcttatttgaaaaaaatatgaaaaaaaataaaaagacaaatcacgcataaaataataattatgttttatcatctaacaacaatgaaaatactaattataaaaaaaattcatataagacggacagaaacgtaaattcaaggtttttttttattttttttatacggaaggaataggtgacacggcacgacaaactcgacgacgcagaaggccgtgagaaggggcggcatgcagcgccgtatacttgtttgtcagggtcaatatgccggacaccctgttgcgccgtaacgcttcaaggcgaaaaggagacgtatgcagccaagcaccgcctcgaattaaacgagccggccggccgacacgtacgtcgtaccgcgcgcgccacccccctagcttgggtcgtgatgatcctccaactccggccgaaaatcaacgccgccgatttcgctgtggcgacgcatgcaccaacgcgtgggtcgccgatggcggacgtcgttattacgtacaccgtcggctccgatcacgtacgccgaggtgacacgcaccggacgatgaggctgccgtgttgctcatatcatcagccggtgtctctctggccggtaatctggtggagctctcgctgtcggcgccatcaatcgtacgtgtggacagccgcgtgcagggggacaccggacacggtcacacggggttcgcggcttcgcgcacgaacactgaactagcttctcacatcagccttcgcactgttcacaaagctaagttcgttttcctggtaggctgatagaaaccttgtcgatgtcaagacgtacaccaattaatctgatgatgcgatacaaagcggttcacggtgccgagccgactcgttttcatgcctcacctcatgtacgttgtgcgcagtactccctccatttcaaattgatctacatatttcatagatacaccaagaccaaaaaaactaataactctctcataccatatttactctagcaacaaactcaatgtatacaccatccccactattttctagccaattgcaaatcaagatattgcatgtgggttataaatacttgtgtgcatggatagatgcatcaatgtccatttatttcaatgcacaaataacgaatagacttaataaataaattcaaatatgtaaatcatttaaaaataacctcaaaaatactatatgtagatcaatttgaaatggatggagtaataacaaaaaaaatatatatactacgtattacgtcaacgtgacaaaggttgtgcgcgacgtgggcaatgaacgtgacagagcctatgcagagaaagaaaaggagcccgttaattaatttctctatatgaaatctgatccgtatttatactaggaatatatatatcttactactatgtcttggcgacgtttccgcttttccgtttctgcatgcatgtaatgcacctttacgatctccatcaggctatttttcccttaccgatatcgaaacgatcgacgaccggccaggggcggctaaaaccctaattaacgcgactataccagcggcgagatgggttgctgcttctcggtgatcgacgacgacggctacgagcacgacgacgccgtgtcgggctcggtgaacgaggtgccgagggtgaccggcgtgcaccagttcacgatccggcagtacagcggcgtcaagggcaagggcgtcggcaattccgtcctctcccggaacttcaccgtcgccggccgcgagtggttcgtccgcttctaccccgacggctacaacagcgacacgtccgaccacgtcgccttcttcctccagtccctctaccggccatcgtgcggctccgtgtaccacgtcgagttctccttcgcgctgctcggcggcggcggcggcggcggcgccgtactccacgacgtgcggatcgatcgcccgtgcaggttcgacaaccgcaacaactcgtggggcatccgcaagtacatcgcccgggagcagctggagggcgccgccctgggcgccatccacgacgacgcgctgacggtgcgctgcaccatgcacgtcatccagcgccgccgcggcgccggccggcccgtcgtcaccggcgccggcggccccgtccgcgtgcccgtgccgccgtcgtgccacgccaggaacgccatggagttcctcctcagcggcgacgccccgttcgacctggagatccacgtcggcgacgcgacgttcggggcgcaccgcctcgcgctcgccggccagtcgctctacttccggaagctcctctacggccaggtcgggaacgaggcgagctcgccggcgatccgcctccgggagatgagcccggaggcgttcggcgccgtgctccactacgtctaccacgacagcctgccgccggaggcgaacaagggccggaacgcggctgccatggcgcgggaggtgttcgaggccgccgacatgtacgccatggagaggctgaagctgatgtgcgcgagcaacctgtgccgcttcatcggcgacgacaccgcgagcggcatcatggagttggcaaaagcgcactcgtgcgatccgctcaagaaagcgtgcgaaaattacatgaaacgcagaaggattccattcaaccctgatagctgaactaagcacccactagatagctcccattgccttggggaaagttttgcaggcaggttctggtctggtgccacgaactgattatcaagaagaaaaattgactctgtttaagcattgttctgtatatacctgtctttctttatttttccaccattgacagagtgattatatatgttctgttaccagtttatatgactagtaagctaaataggggaatctaaaattatatgattttgaatccagaatgaacaaaaatggtattgcagtcaacgagaaataccgggaggtatcactttttaatgtaaaatttagtaccctgatatgggaaactattaactcttaaggggttatcctttcgctagttgcatgttaatatgtgataaatcactccacaaacatgcaagctcaaatttaatttacatatgttacaacagattataaatttgagtgcgaatatatgttaagccatagtttaatttgttttttcgttgcaacctgtaaaagttaaattttaacttgcatgtttgttaagtgatttatcccatacctattaatctatcttgttaaattttttatagccatttggatgacatgcaaacaacgagggaatgtccaccgagccactattggtacctcaaattactaagaggtattaaaagttacaccataaatttttacattagaagatacggttttatatgtcaaaatatcaagaggtatcaacatttatatcagaatttcttacagtagaaaatatcgtacctttaggtactccatccatcccagaatataatgaattttggacagatgggacacttcctagtactacgaacgtgcaaaaggattgcacgtcaatatattaaaaacaaaagagtttttgttacacacacaaacggccagacatgcctatgtcatggggaaagaaaaggaaaaatcagagctgcaactggtgaaagaaagggaaactaccaaaaaaaaaagagagggcggtagcggagccacactacacttccaagaaaccctccaaaattagcaatgcctttagattcgtagtacttaaaaaaatgtgttttagatggaggaaatattttcttaaaaattgttaatttatctgtccaatatgtatgtcaggtttctctgtatagtatatagtgagcattttttctctagtttctttgcaataatgagcatgtcacaacataaatagcggatgtccagagaggagcatatcccgaattatcaaaaaccgtctacccctctgtcaaaaaaaaaagtccaatcctagttacgaatctcgtgcctaagctcatagctagagtttacctttttttaacagactagtatcacataattctcatgtaggcaccacatgtatcattgtaccatactatattttcacatatatcaaagaaccaatctatataggcaaataataataatctcgaggaaataaacaaagaaaaaggccgcaaatcactaccacgtagaagtaccaaccacctcatcgtcatcggaaaggagatttgctcccagcctgtttttatgcccagagatgtgaagacatcatatatgaacacaaaaaaagaaaccctgatcttctacaccgtggctttattcagccctcgtaacccgtatacagaaaaaagttgtcaaagcagctgacaagaagaggtgccgttgaccccacccgtaatccatgaaaacgagcccagtgacttgtaagcaagcaatgttcaattcatccacgaaaaaagcaacatgcgcattgaaaatgatccataaccgtgccgctaattcccagtcagtcactgtcaaaatgtttgtggtatattgtgcatcctttctaatcaacataaatttttggttggctaggtttggtattaaacctgtgactcgattataacataatactactacagtactactcccttcattttttaatagatgacaccgttaattttttctcacatgtttgaccattcatcttattcaaaaaatttacataattataatttattttgttatgagttgttttatcactcatagtcttttaagtgtggtttatatcttatatatttgtataaaattttttgaataagacgaatggtcaaacatgtaagaaaaagtcaacaacatcacctattaaaaaacggaggtagtactaatatgcagtttagaggccttggcaaactacaggcgctcctagaaaccgacaattttgacgtgtgttcttgtagtacatacaggctgtgctgcagttggatttgtcaggaggctactatacaatgattcaacgaacatgagcagcagcctcgtctgctcgtgccattttgtacttaaaacaaggcgcgattccggctgtcgatacggcagagttatcccccaagtttctttatccaaatcactcaccaatccagtgacaacgctagcttaattggttagtggactagtatatagtagtactgtatagctctcgcgtgttcactcctcagtcctccctgtagtccaacgagtcaaatttgaaggcttcactgagcctttgacaatggcgccgcagctgccgctcgaggtggcctctgctcccaagctcgacgacgacggccacccacaacgcaccggtacgctctctgtcgccgagatttgttcgatctgtttggttcatcgacgagaattcaggcatgccggcaagtagtaaggtgctcttgagctcttctcttctaattttccttgtcttcttcttcttcgatgaactttcagggaatctatggacgtgcgtagcgcacattatcaccgcggtgatcgggtgcggcgtgctggcgctgtcgtggagcgtcgcgcagctcggctgggtggccggccccatcgccatggtgtgcttcgccttcgtcacctacatctcggccttcctgctgtcgcactgctacaggtctcctggctcggagaagatgcagaggaactactcctacatggacgccgtcagagttcacttaggtaattaagtaccttgattaatcctacttcagctaagttagttagccaatcttttcctcaggaagtccaattggtcaaatatagataccacttttggattgtatattgggtagcagtaaattaatggtatggtttttgtggcaacttggcaatatgtttagggaggaagcacacttggttatgtgggttgctgcagtacctgaacttgtacgggataggaattgcttacacaatcactacggcaacttgtatgaggtgaattttacagtttttttttcatacagatcttcaagtagaagattaaactgttgtttgttcaacctgtgcttaattaacttgttcccgttgacagggcaattaagagggcgaactgctaccacagcgaaggccgtgacgctccctgcgactcgaacggtgaacacttctacatgctgctcttcggagcagcccagctgctgctgtccttcatacccaatttccacaagatggcgtggctgtccgtcgtcgcggcgatcatgtccttcgcctactccaccatcggcctcggcctcggcctcgccaagaccattggtatagtagcttgattgttccatttgattgatgccgatgtcacaattcagcagtgcttaattaattagccggaaactgtgtaaatcttggtgcatttgcttcgtgtcaggtgatggaactgtcaaagggaacattgccggtgttgcgatggccaccccaatgcagaaagtttggcgagtggctcaagcaattggcgacatcgcattcgcctacccgtacaccatcgttctcctggagatacaggtgcgcacggccaatttcagaacacgaaaagcagacatttttttggacactttttagctgaaattagtcaagattcatctgaactgagactgatggaccgaacaggacacgctgagatcgccaccgccggagagcgagacgatgcagaagggcaacgtgatcgcggtcctcgccaccaccttcttctacctctgcgtcggctgcttcggctactccgccttcggcaacgccgcgccgggcaacctcctcaccggcttcggcttctacgagccctactggctcatagacttcgccaatgcctgcatcgtgctccacctcctcggcggctaccaggtgaagctgcgactcaaacttctccaaaatcgcattgcttttctctgaaaaaactatcctgatcgaatcctgcatgaactcgatgcatcagatgtttagccagcagatattcacgttcgccgaccggtgcttcgcggcgagcttcccgaacagcgcgttcgtgaacaggtcgtactccgtcaagatcctcccgtggcggcgcggcggcggcggcggcggcgcggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcagcggcggatctcgccgtggacgccgcggtgggccgcgctgcaggcgttcagcgtcgtctgcttcgtcgtcggcacgttcgcgttcgtcggctcggtggaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttattacttcctcggtttctaaatatttgacgccattgattttttaaacatgtttgaccattcgtcttattaaaaaaattaagtaattattaattcttttcatattatttgatttattgttaaacaaactttcatgtatacatatagttttacatatttcgcaatttttttaataagacgaacgatcaaatatgtgctatgtcaaacatttagaaacagatggggtgccaaagtatcagctactcagaaattctgacaaataatgatagctgtttgttactgtcccttccgtttatacccatttcatatttcatattgtaagtcgcttaattttttaagttatttttttaagtttgaccaaagtcaaagtattatctaccgctttgaaaatatgtaggggctaaattcgatcgatgtactcatgcacgcacgtggaaaacacacacaattatagttgtgaacgcctactctctctggtttttaacgtttgacgcgcttgatttttggtgtcttcgatatatgtcttattaattttattttaaaaatacaaaaatataagtcatggtaggagtatatttaacaataaaaaattatagtaaaacaaaaaaacatgaactttttaaaataaaaagaactagaggttaacggcgttcaagcattaaaactagagagtaacacttgccagacctgaggtggtactaatcatgggccgaactcgagtccaatgtggagttggactccgattatagacgtcgacgcggctgggccggcagctaatccggtctttggggccccatgtatataacgtcgtaacagaaagggagacagattccgtgtccggtttcacatcccatcccacgctgtcgacacagcttccgccgcatccctcccctcgccgtcgcaaaatcccccccgccgctcgcgccgccgccgccgagagcgagacccgcacgaggagccaagcatctctgcgttctacagctccgggccaccggcgatgaagctcgtctaccgcaacctcgcccgcaacggccccggctccgtcaaggtgtgaaccctcccctcccctccccatctcgctctccgtttgatcgcttgcactaggtctagtgttgtttgggtttgggggtacggtggtgatccccttttgtgggggttgtgtggttcgtgtgctgattggatgacttagatcgatttattgtgaaagcgcagctggtgccggaggaggaggacgacctgtggcatgcctacaaccttattgttccgggggataccctccagtccgtcactgtgaggtgagttcctccgttttatgtagtgattgtgtagtgttggttcagttagtaaccagagtaatttatttcggtttagcaattttgagctgttaatttcgaactatcctcgatgtcctagtcctaccctggtagaggaattagggcacttagatttaggccgagtttagttccaaactttttcttcaaacttccaacttttccgtcacatcgttccaatttcaaccaaacttccaattttggcgtaaacttagggaaggcatggttcactacgtgataaatagtttttggctcttggactgggacttaagaattgggattgcgggaagaaaaggaagtgctggaattagtgttactgtttcgtttactttaaacatccattttattaaaaaaactaaacctaacaatttctcaatgccattatgcttttatgtgattatagaaaaattagatatgtaaaattacttgaaaggctttgatcatactcatacttcaaccttggtggtaatgtagtttgtgttacttgaagattctgtcccctttattcttgtgaacttctatgtttctccatcaaaatatatctagatccttcagtgcacagtgagaactcataatccccttaaacatatttttatcctgttgattcccaggaaagttctgagagagatggcatctggaggacgtgatgctgagcgtgtgaggttaaagttggaaattgtagtcgaggtgatatatcatctgtcttccttctatctgcactgagtgcttatactagtgattacagtcagatgtaacctatgtggattgcaacctgtgaatttgagacttgagtggcactgtcattgtttgattatttgggaagagagcctagtttacctacacaatgcgtgaactggaaagagattgacaatctaacaaaccgcaaaggctgtacaatgggtgacctaaacataatattattggagtgaaattctgtactttttaaatgcaaaatttctgcctctgccttagaaaaataataatttagagttgcataatggagtaatgggaccccccaagtcaagcaacaagcatcgtcacttaagcatttgaattacttagagctaagtggcaccacagccgaagaggtcgagaaatctatttctccttgcatactaaaaaataatgctgtctttagttttttagccagtgatgctcttattagttttgttccttattgtttccaaatcaaaacttacctattttcttgatgataactgacatgctcctttgttttgcacatagtctgtagattatgataaggagggatctgtcttgcgtgtacgtggaaaaaatataactgagaacgatcatgtgaagattggacagtttcatactgtggagcttgagctgaagagacaatttactttgacgaaggtatgccctaaaatttgatcaaactgcctttacctgtttactaggggaccacattatagtcttcagctaatgatggataggattgtcttaaacactacactaatggttcaaaatttggatatgattctaaatggttaaaatatggcaccaatatccggcacattccaagctgatgtgggatttgttaagccttacctgaaaagtgtggttattcatcgatggtttaaggtgatttagcatgttaacccagcccagcccaaagaagtacggtttagatggtctggtttcacgggttaaactgtttcctcaacaagagaaagaagcagatcaagagtccttcgggcagaggagctagaaatggccatggcattcctttcctgtgaagcacagcagagcacacaaagattgtgacaggccactggacgcagccacgtccacgagttgctgttgaacatgcaagggacgccccgactacagaggtgcagccatcgagcgcgcgatgtatcgtcgcatgtgaggggaagtcgccttcgagtgtgagatgacgcggccacggtgaaggcccatcgaggggttggggtcatggccactattgggacttgtcaattgtgtggggatgtggccgtggctctggagaactcgtcgcttgtgggggacattgccatcggggacatcggtgggggacatggcctctgtgaaggtctttgccggtgggtggacacggccaccgcttgagattgcaaagatggctctgcctgcgtgcgaggacgaggtcctgaagaagatgaaggagtcatagtgtttgatggattgtggaggaaacccaacctacctatatatacaagagattaactggtttcagttggtttggtttggtatgttcatcggtttgagcccaacctgtgaacaggcctacctgagagtgctacaaacagggtgctttgagctagtagatttttaatagataaactttctatcccatttgcagcttgccctttttttaactgaacctataagtgaaataggatatgcaggcatctgtgcacatgcttttttatttactgtcatatatcttgaacaactaggttggccaaatttggttcatttcttttaatagcacttgacaatgggacctttccttagctttgcaatatttatattatacaaatacccctttgcaattaaacattactatggactcagttatataaaaaaacttggcactttcatcagactgctatccttttctttccctaattttcttaatgaatcttgcacttgcatatgagttttttttgtccctgcccatggaacttgtatcttttccagcctctggtaattcatagtgtctacgatgactacttaggagttggaaagcataacgattattgacataatatagtttccttctttcagtggctgatgataatgttccccaactattctcagatacatatcgttgttgaaaattttatcaccattgtttatttttgtaaattgtggtagtccatttagaatgtaccttcttttggtctgttgtagcttacctgaggagagattgctatttctacttttgcaggaactttgggattggttagctcttgataccatccaacaagcatgtggtatgtgagaactgaaatgttactatcttctaattctgtacattccatctgtcttttcctgtcttattgctcttatattctatgatggattgatctgaatggttacatggttatcacattaggaatgctacctgtacctcaaattttagcctgctaatgcttgatatgcccattcatctagattacttaagccactgggaaaaaaacatgtggttgttttttttcagtcctgatgaattatccaacaaagttggcactatgttgattgtacaatgatacttagttactcactgaaactcataatctgttttttttttctggagaatttgtgggaagaggcctaagcttacaaataggaccttaagtttagcaggaaagcccatccgggtcctgcctgttaggagggcctaaatatctcgaagtattaaccctaatttcaagctgtcttccaaccataataatcagtataaactgattgcacatatctccattttttctgccatcacctctgagatattttgattatcagagattttgaacatattgctccccttcttatgaatagattttaatgcagagaaactcactcataaatagagtatctcttttctttcaaacctgatgtgccattatgtccagtgtttatatattgtttgcgttccatcttctgctctgcaaaattattggtatggttgtaccgcggataccaggagtgcttgacaacctttgcaaacttgttactttgacctattaatgagaactattgataattaatcaatttatcatccatcatcttgaatatgcattgagacccctagtgatatctatcttgtgatttctattgagacataaacttctacttttgttttatcaacttatcatattttctgttattattctttcttgagaaatgcaatgttctaactgagtgcatctaaacctctattagacccaactgcaagtgctgatctagcagttattctcatgcaagaaggacttgcacatttgttcctcattggtagaaggtaagttgagtcattgactcattgtgccatggcacgaccaagataatttttattgtacttcccatgatagcatgctaattgtgatgatgaaagagtattatcttaatagtagccctgtttgattccctattcttttaaaggcttgagttacctcttgcggtgattgtatttgacttattagctatggttatctaaacagcataacagtaaccagagcacgtattgaaacatctattcctcggaagcatggccctgcgattgctggttatgagtcggtatggaaactggttctgatattgtgtaatctaattgttctatctattcccaactgactttgttttgctcttttgtaggccctcaagaagttctttgaacatgttttgcaagtaaatgaaaaatgtttcctcaaggaaatgataatattaatgaaaccaatttggactgatgcattacttaatttgcctacaggctttcctgaagcatattgattttgaagtagtccaatgtgctgtaattgcaagcccaggttttactaaggtaatcctcacgtacttacagttttggttttataagttggtttggtatccatgtgtcaagcacatgatgatacaattttatgaatttagtttttgtttatcgtttgcacatgtttctgattctaaacatgtgcatgttagtgagaaaaaaactacagtaaagcctggtatcctgttagtccatttgttgctgttggtactttcagaaccatgcttgtatgacaaacaaaaatatcaacttatgcaattctcttcttgtactttctcttcatatcttaacaggatcagttccgcgattatatgcatcttgaagctgcacggcgagacttaagattaataattgagaacaaacagcgcattgttcttgcacatgcaccttcaggttacaagtaagatattctatctttgttagacaattgttgccatctactcgacctattctctttcccccctacattttaggtacatcagaacctattctgaactgtgtaatatgtgccaatttatgttatgccttctagctttctggcttgttggaaacttgattacttggatcttctctgattcatgtgttccattttcctgtgaccaattgcatggtcctagtgaaaagatcttaatataatcctgtactgaacaccatttgatagatgacctaattatgatgtatcacaaaactacagatttaacactaaatttatcacagaagtacaaatataaggtggactatcgcaaaactacagatttagtaacaaagttatcacaaaactacaggttttatatcaatttaatcgcaaagcttggacattataactcaaacataacattaatgctagatatttcaaccccaatgtctatagttttgtgataattttataataaaaaatgtggttttgcaatacttagccttaaaactgtagttttgtgataaatttattgttaaatctgtagttttgtgatacatcaccttacatctgtagttttgtgataatttggccaaagtatatgtaattttgtgaaatttactctaattatatatctattcatttggttgcctatattcccccagctgtctcaatggtctctgttttttgtttgattggttatgtttgttaaaggcatagcctgaaggaagttttggatagcccaagtgtgatgacactaataaaagatacaaaggcggcgcaggaggtaagccatattcagaacaagatatatcactaaatgccctaatgtacacctatggtgctttctcaaacagttcccccatgttgatataatacgcactaaggcactaagcacattcaaaacaatttctaagtacagacagcttctcatatttgttttctgacgctcttatatttcctttctaatttgcaggtccaagctttgaaggacttcttcaacatgcttacaaatgtaaagcttcttgaagaaaaactaccttctaacagttggattgaaatatcctactccatccgtttcatattgtaagactttctagtattgcccatattcatatagatgttaataaatctagacacatatgtatgcctagattcgttaacatctatatgaatgtgggcaatgctagaaagttttgcattgtgaaacggatgaagtacttatgtgttactgcttagacccttttaatatgcatatacattatttgtatttcattttggaaggaaatattgtttttataatatttgtggttagagctactgattctgcttagttgaagaatataattaaacccctgtcgctctgttttttttttttttgataattgcaggattcagctcgagcttgttatggacctaagcatgttgagattgcaaatgaacgtcttgctatccaaactcttttaataacagataatttgtttcggtaagttgtgttaattaaagagaagtttacgagtcagctaatttacctctatagtcttgttattttcctactgctttgtttccttttttctgctgagttcttgaatttctagttttgtaacactcacagtaaactaacatctcatatcaaaactgttggtatgttcataaaattttagtggtgagaaataacattgattcttctatttctacctgcaggaactctgacattgcaacgaggcaaaattatgtgcgcttggttgaatcggtaaaaaaattcggtggcacagtgcacatcttttcttcaatgcatgtctctggtgaacgtaagtattcgtatccatttgtacttcactataactgctcatcaaaatgcaatagaccagttcataaataattgtcacattttcatattaacctttttgaacaaggaatttattaatttgtaatttgcattagtttgctgcattgtgttctctgtgtttaaggtggatttttttttttcatttgagcagagttggcgcagttgacaggaatcgcagctatacttcgatttcccttgccagatttagaggacattgagatgtgataattccaccgttcagaattggcaatatgctaacttgtaattcatgtgtaatcctattcagttgatttgatataggtaactcttaagaaatctgaaccacagtatatcctagctgtaaatggtttgcatgccatatttgttgattgtttttttacttaacaaagtgctactccctccattctttattttttcactaacgaactttcaaacatcgagggatgtaggtagtattaacagtgcaatgcatgctttaggccaagtagccggattagccatggctgaaagcctgaaactgacttaccaggatgttggcaaatgctaatcaaatcctttgaggctttaaactggatatgatttcaactaattctgtgggggtgttctcaacaggataaatatgtgattgcgaatgcctcctctctctctttttttttcaataggactccattttatgagttaacattaatggtcctgttcctttcttatgtaaggagtggattaaattttggatactcatggcatgcttttcaaactgttaaacgatgttaaacgatgcgtttcgtgagaaaattttctatatgaaagttgttctaaaatatcatattaatctatttttcaagtttgtaataactaaaactcaattaatcacatgctattactatctcgttttacgtgaaacacttaatttttatcttcataggatgcaaacaccaccattgaatcgcctttatgcaaccgtgctatgctggagctctcctggaatcgaatactcctagtcctagccaacctgtgactattctgtcatgcattatgcctttgatgcgctttctggtattgcttgattcttgtttcttttttttttcccgtcgtcatgcacgcatagcatcctggatgttatctatttgatttttttcctctcgattatttccagattacagtggatacaagatagttacttttttttccttcaatggacggcagcaaaagctgaattccaggttaaattaaaattgaacctgtagtccagtaccgtttgcatcggtaatactacaaaaatgtgcgtggtagaactatagattatcctatgtcaccaatgtgcttctcatgacatgaaaaagaggatactgatcacgacctatcatttcttttgatcatagtttaggaggattgatcgaccacgagttgcgttggtgccatttctgattcctatctggagctatctcgttggcctcatgttcaacttgtcctggagaaatgacaatttttttgactagattatggatacgataggcttgttactgttgacgtgtcaattagttagctgctgagtcctctcattacaactttgccggtttcaaacaatattccatctagaaaaaaacagagcctaaagctgatccaaattggtaaggagtccaacaatattctgccgttactttcttttcttcgtcatgctctatgaagtgacaaagcatgcaagagaaacttgtgtggcaattctttgattttgaaatatttaaatcaaaatgctacctaggctttagaaatggaacgaattgccggctgctagagtcaaatctagctaatcagaaagcattagctacctgggtaaagcaaagcagagcacactatagctgaagtaacccaagatgatattgttatcttgggttattttaagcagaccaaattggggcggcgatgccacaggccacctacgagtggactaacaccagactgt

SEQ ID NO: 80458 - DNA, 2896 bp, Oryza sativa
tcctgcagccctaatgtgcagcctctagacatattgcaaggaatttggcatcaatgtttttctgttactgtattttctatgtatctgtcaatgcttgactgaatattttattgccatttaaccacccatgatgtgttaatgccacaagcagctatgatagacggtgatgatgacaacgatgatgaaagttatctcatgagaggtcaaggtaattatgactcaatttctactgttggtcaagtttatcatgacaagtatcacagagaagagcaggctttcagatttattatgaatcgatttcattttcatgcttatactacattacaaacaatgcacatattggtaactctttacatcataagtggtagatcattttagaagccctgttcacttttagaatttacaggttgaatttgattggaaatcagctctgcaatgtcctctcaatcaaggaggagcctatgtcgattacttgagctttttagccatgttaatgattgttgatatcgcttgtaatctttgtctccaacaacacattgctcacaagtgggctggttgaactccatatgaatgtgcataaactcaaggtgactatgatattataaatctttctgttgatatttcccataagtcttccacttgagatatattagatattccaaatccatattaacctgtttacagtgaaatttggggccactttaaagaagaggggcgaagaagatctgtaagttagaaggtgtgctgcttcattagaatatatcatttgcgtatttctcaaataaaatattttggttgattatttccagtatgcactcctctgaagtaattcatggtctttgtatttttcttatggatgtatacttggtgttttctgttgttggtgcaaataggtgagcaacatggatggtgatggtgttctgacgtccaaatatgaaaccagccaaccaggtcaccactatgttgcattatttttcttcgtattgtctactcaatatattgctgattttaagtatagagtcaatcgttaatccatgtgtaggatgttcagaagcaatgctaggcttaattagtgcgattatcatggtgtggcagatgaggttgagttcttgagtttatagccttcagtgatgttttttaaaactaattcactgctgcatgtcactgttacgttgaattgctgaactacgtccctgtggcattagaggatccaaaattcttgccttgctacatgctactatgattaatcagggtcaattttctgccatacatattcatttgagcagtttttttgttatgttcaatcagtggatgaaaaaagtcaatgccatgcattttaatataggggaatacagaaatccacctcagttgctttcactcaattaggtagtctactcgaatcctctgctattatttgactcaaaccaaatttaattatatcttttttgtgtttggaaaaatgtgtctaatttagtttgagcatgggatcagagtaggattaaattaataatcaatatttgaattcaaaagataaatgataataatgctgatacaattaatcaaaattctaaaaatgaactaattgaggattatagataatatcttggtaaatatatggaggcattgtaagagaacctacagatcatatcagttgaaatagacatgcagattaccttgtgatgtgcccattctccatgttaatctggtacatctccatcaatttttcacgagttacatgagataaattgattcaataattgatattttatattttcagcttggcagcctgaagatcttttggaccaaaagggcaggcctctttcccaaggtgaagcacttcgtagctacaatatgcgagtgctcagcctatacaccatatccttatatgagtatgctgagagttttattctccattgaggtgaagtatgctcaaaagtttcgttaaaatatattcagtttagtgattttgttcatgaactaactcacttcactaccatgaactcatttctccaaaattttggatcttttattagcaaatctatggactgaagtggggttttggccagagctccaatcccctgcaaatcccaaatgcagtacgagtaatattttgcaaaattatgtactccagttctattggaattgatgtaaaaccaacaaattcttagttttgtcagttattaaaacgcatagatgcatattgtgtatgacattatatcaaacgtgcgttgcacgtacatgattactagtaactacaaaaagaacgtgcctcttggaacgcttgctaattgagcctgtaatattttatttagatattatttggaatatgagattcttttaaagcaaatagttttaagacttataaagttgatgtaaatatcatacgttaagtatcctttagtgtgttctagttttaattttgtagaataccgaggaagaatatcatggtgtggaataactttcagctccatccttaggagcataatatttgcaaataaaaattaatttatgaataaaacttttatatatgttcttaatgatctaaaagcaaatgctgaaaaataaactacaatgaaaacccctaaaatcaactctaaatttagagttaaaaattgaaatttaggctgataagtataagcataagcgaaaagataagttcgtttgttttaaattttaacttattggtgaagatgatatttttaatatataaatgcttattttttaaaatattctacaccgctttggtaatttttaaagttttgaatacaaatagttataataattagaataaaataatgtttatatttataaccttccacccaattccctgcatccttgcatcacatctccaacccctgcctccacgcgatcttccacaatcgtaccccccacctct

SEQ ID NO: 80459 - DNA, 3464 bp, Oryza sativa
gatatttaatctgagcacaaccttgaagtaacagaaagccagaaaatcctcagagaatgtgtaagaaatgtggcaaaactatataaaatttcagaaaagaatactattatgccgagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaaattttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggccccttatgccacctataagacagcaatactgaacagctgttcaaaagtcaaaaaaattccaacgatttccaccaaagttttctacattattatttttttacttctgcgctgattaattcatgatatcactttgcatatgtttcaaaatttctttaatacttgaagattgataattgtattcctgttaattccattctaaacaaatagctgttgaattcttgtcatttgtattgtgccttcacacatttactataaactgttcaagatgtccacatatgatcgattaataactcgatctttatcatgatgaattctagagggatgaagaaattagtatggcaccagaggaaccagtactggtagacaacaacaaccaagaggaaaacagtttgcaacaattgaatctactggctgatacatcagagtggttcaagaacatggatgatgatgatgagtcacccctatggctaaacgtactgctgagaaccgcattctggaggaagtgtgacgtgcatgatcagcttgaaaatacacatagggctgaggaaagcatcttctgcaccaactgcctcaagacaatatgcccacactgcaaacatgatcaaccgagccaccaactcctcaaggtccgccgctacatcttccgcagcgtcgtccatgtcaaggacatgcagaattttggtattgacatgtcttacatacaggtattacttagataaaattaatgcccatgctttgctatggataaaagaaaatatattataatatgcaatagatattttaaaattatcgaatatgttagtatcacttgtttacttgtttgaatatatggtatttacttgtttgaaccaaatatttggactattccataatatcaaaaaaaataaaaataaatcaggagcatatttgtaaaaaactgtaaaagcagtggtgaggggacttttaaaggagtatagatgtatagttggcactgtggttaatcaacttggaaagttagtttctctagctccaactagtttaattagcttgtttcgaattaatcatgataagttcgtttgtgtaaggtttgtgtgcaataaatctttgttatttaaaactcctaatttgatggaagcaacaacaaattataatctgatcactatttgcttcatttttcttgtttagtcctagcattagtaatgataatttattttgcgacaatgtgggtttgaaggcaaataggctggtctccatttagagcccttgcaaacccatcctaactggttcactgatcagctagctagaccacacaggtcagacacaatttgacacaactttgtttggaaacaatttgacacaattagagtcgatcaaacgcactgaatttataatgaaatgaacaataatttttatatataagtgattgcacagtagcgtagtaaaggatgtgtcttgcggcctaatactactaggataaatggcaattaatagtgtcccggaggtgaatgccatgatcatctgaactcaacttttttttatttaaattactaccattctgaactcaactttaggctagaaataaaagatttaattttgttcaaacacatggattgattagaaaactgttttagctcatctgaaatgcataatttggtgcatatatatttattgattcaaaatatgtatctaattaatatcatgtagttatgcaagcacatctatgtaatcaaaatatttacaaagatatgtgtactcatataatgcatccatcacatgaagtgatcaaatcttcttatgaccatattacattgtataattcagtaataacttagtgaaatcttgaaaacatgaaagcacacattttttttttgcctttttagctttcatgtcactaagttattattacgatcatatcagttttgataattcagtaataacttagcaacatgatttcccatgaaatctcgaaaacatgaaatcaaatattttctagggttaagttctggacatatatacgcagaaataaactgcgatagttgcatacacagaaatagttataaattaataacataaatatttcacatcgaaacctaatagtgttactgaagaaaatcgatcggtaattactacacattttctcacatgtacatataatagttaatactacaataacaaacttgatcagccacttactcccccatatatatatgtgtgtgtgtgttatcccgcaatgctagctagcattagatcgatccaaaacctccaactgtatcggttcttcaaaaatcttttttttttgcatttgatcaatttgtactaactttttccaaaactgattgcattttctcatacagaaacatactccctgcgtcccaaaaaaatttcaattctagggatgaatctagactcttttttttttttggggggggggggggacggaggaagtacatacaaatacatcttgggaaatcatgcatgtttggtttgcatagtttatgaatatattggtat

SEQ ID NO: 80460 - DNA, 7012 bp, Oryza sativa
gcaatgggcacaaagtagtgcacctaaggcccatgaagaggtccaaacatcacagacctaaggctgggacacctcgctgcacgacttgccagtgctggctccacaatgcacccagcctcacctgttcacttagctgcaaggttattttcatcatatatgcacaagtactgttatttatcatgatcatgttgactcaattgattttgtttagtgggcaagctatgtgctatatattgatggataaggttgtttgttgtgctttactagatttcaccctacgtagctagactactagctattgttaactttttttttctaatatctctcttctccaattctgatagaaaaaggcaggtatatcaccaaatgacttctcagggtctgaagcttcaactcgagtttctcgttcacggaaccaagcatcagatgccaatcagaaacgtccaattgccaatacaaagctgcgtaaaaggccttgcaagcaagcgaaccctgaaagggctccattcttttgatgtgaatgtgtcccaaaactgctgaataatttagctgcaagaccgcagctttcgtgcgtattatttatttgtcatgtttaagttgtactgtgcaacatgtttgtcacattccgactgatacctggcattagttgctttctcatttgctggtcctttgctccttatcaaaataataatccagtttaaactggtgaacattaattattttgtgattgactattgttctatcccttcttttgtttcttattctgaacacaggtgttgcattttctttctgagatttgtgtttgttgatttggtgatttggtctgactttgaaacgataattacctttccctttcaaattattattcgaatattcaatatgtgagttgacatgagtttgctaacttttgttggagtcaattttgtcgtgaattttcattgttatcttgttcagaagtccaaactaacatataaatagtatatggcatccgcattgcaattttttgctttcttattctattgtaacttaaatcgagcaaaactaccaaccgtgatgcaaaatctctatctcagttcacagtctacctaatgagatgactaggagacaaacacaaagaacaagattacacaaacacatgaagttcctcgggtctaggtaattccttcccgccctctgaacacaagttcaagaataaaaacaaacaagaactaagcacacccaacaaccagaagagggggaggaaaactctaggcactcacactacacatggtacaaaaggtgcacaacacaaattgatttatcctcagcctctgtagcgattgaaaaacaccttttcccaattgctagtgcattgatcccgtccccggaaaagccagggtacacttcaacaatcatgatacaaaagacacatatttattgtatcgataatatttacattattacaaaggctcttcaggcctaacaaacaaaaaataaatagcagcagaccagcgggcctacgacaacatcttcataggcgctcaactggggtataagccaagactccacctcggactcttttctaaagtttcttttactgaaggttggaaagattgagcaagaatgagtacaaccacagtactcagcaagtcaaaccgggagaggcatgattaatgcaaggggtacaaggagtaataacatgggggttaggttaaaaattagtttgactccaaattgaaaaccatgcttctcaacaaatgaaacttttctatggttgacatgtacactctttatttttgctaacacttacttgtgaacatatatctattgtaggaacccttgctaatctaagtaattgatatttgtgatatggagatgacaaaagaaattcctttctaactgtcatgatatttgggattttatctttgcaaaaaaataaatttttgagcaatactccttagtgactatatgattacctaccaaaggccaaatatgattcatcttgcaaaccatatattttggttgcttgacattacattgagccttgtgtgtgacctatgtgagatgcttttcatgctttatgatcaagatcacacacactccacatagattaacatcctgaacttctacactagaagctagtgtccatttcatccatcatccacaaaataaatactcctcgttatttatgtatttttctccaaagttcattcaaaggaaaagggaggcatggctatgcaaaagaaagaaagaaagaaataataaagtcttgctcatacaaatatgaagcatgagaacaaaaagatagccatgccatctctcaagtctcaaaagaaggagaaagatgtgtagaaggagttatcattttccttttccacccacaatcatacacatgcacattcttgatcagaaagtgtgacttgctatctccttggggccccttttttggcctggcaaaatatgtgatgcaggtacaccccgattgatccctaccgagctccacatatatagccttctagaatagggacaattcggcaatacatgccttggtgaggatccaacaatcaaaatgagtgattcaagagagtcatatgaggagtatagctatattttgaaaatatatgaaaaactcaagtgattgacaggaggaacaggaacgacttgagtcacgaccattcgatttatcaattacccaagatggtaagatagacactgcaaagttcataggtataggtgtggcttagaataaattgtatactagtaccataccttgggatgttttattccacaatagtccttaacctttagtcgagatgagtaaagagctaagtgtgggggtttgttgtaatgccccgattttcattcaggattaaaaatcaattaataatgcattttctagaaattaaataaaagtaaagcaatttaatcaagtgaaattattgagggaatttaaaatttcctttaaaaatcatggccgggaatattttgtaatattctttgcgccctaaaatattctctaaaattttcccgtgaattttcagagctcaagaagtaattataataatacaaagttcattaaaccaattaaataaaaacgaaaacgaattaaaatcctccttctttgatttgggccgtttccggcccaagtttcctcctcctcaggccggcctccctcctctctccttccttctcggcgcccaaggcccgtccccttgcaaagttcacttctccttccccaaccgtctcctcctccctccctcgccgacaggtgggcctggtgaccccacttgtaagctcctccttctaccttcggcctccagagccgaagccgccatgcggcgcctttgccgtcccacgtcgcccatgattccggcctctcccgctcgtgccctcgcgcccaaaccgcatgaaatcggtttccctccacctcctctacactctccccatgtttcccccaaaaatcgtgccgggatcgaactccacttggcccatgatgttgcccatgtcgccggccattgccgcccgattctgccttctcgaccacaattttcctcccccgcacccatataatgcatcgcccagctctcctctaccgtttcccctcctcccccgagcttcccatagcctccctcgctctccccatgccatcccccacttctgccgctttccggcgagctacagccacgtgctaccgccgccatagccgccgtcgcaccatgccaccgccaccactggctccgcagcgccgagccaaagcccggccaccacttcccctccccaaaccgccgcggaaaccccgtcgccaccaccaatccgagccaccgccgcctccaggtgcctcccgccatcgagcgtcgcctcgctcagccatgccgccgccacccacagcgccccgtccaccgctcctcttccccaatgcattgccaaaacgccgccgccacgttcaccatctctctccgccaccattgccgcctccagccgtgccgcgtcgcctctctggtccacctcgcgctgcgcagtcgccttccccagcaccgcagccatcgtgcgcagctcggcatccactccatctccctcctccacccccgaagcactactcctaccgcgaacccaagccgccactgccattttgtcacatcctgatttttgtttcaggatttataaattatttaataaattattaatagaatttatattaaatgttctttaatttacaagtgaagttaaatgtgggaaataaaatttcctaaagcatggatggatttaatttttattaaattctccatgattaagtcaactctctgaaaatttctcggatttttcagagctcaattcctaaatgatacaaagaacagttcagtaattatttgatcaataatgatctaattataattgttaagagcttttcttgtttaaaaatccttaaattataaattgttggttaaaaggaattattaaaaatgatcttaaaagcctaaaagagaagatctaattttaatttgctaaatctcaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctctccctcggcccaagtcggcccagtccgcagtcgcagccgcccgcgcgagcgccctcggtcgctaacaggtgggtcccacctgtcaggttcgtcgtcttcctcgcgtcggtcgccgctcgaaaccctagcgccgcgccgccgtcgtctccttccaaatctggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcgtaagtatttatcgttttagttaatttgatgaatctgtatattaaattgtcagtttgtgtacctcggctgattcctggacgaggattttatgcacagataagttcggaaattactagtgaatttccgggcgtgacaagttggtatcagagccatctcgactgtaggataagccaaatggtcaaaccttaaggactaattttccgaaaatatgatttgtgaaaatttctcctttcttccttatctagaattctttgcaaattgtttcgttgtctactcccctctctctttcaacttgagtagttctgagacattgaaacttgaagacgccaatgatgtcaacttatggaggtcagtcaagtggatcgtggaaggaccgaagtgccaagtggtcaagatggaatgaagtttggatcctatcttagaacctatgccaccaaactatcctcgaagaatagttagtagggtagaacgtttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttatctttagtgtaacccctctccttctatcttctctaatatgcaacagatggtgaacactcgcgccagtggaagtggaaacaataacaatgaagggaacccaactcttgctcaagttctggctcaacagactcagttaatgaacatgatgatacagcagatgcagaaccagctcaaccaagggaacaacaatgctccaccgacgcagaacaagttagctgattttcttcgtgtgaggccgcccaccttttctagcactaccaacccagtggaagcgggtgattggctgcacgctgttgagaagaagttggaactgctccagtgcacggatcaggagaaagttgttttcgcttcacatcagttgcaaggacctgcatcagaatggtgggatcatttccggatgaacagagcagaaggtcaaccaatcaattgggaagagtttaccgaaggattcaagaagacacacatacctgtaggagttgttactttgaagaaacgtgagttcagggcattgaagcaaaaggatcgtaccgtggcagagtatcttcatgagttcaaccgtctggcacgttatgctccagaagatgtgcgtactgacgaggaaaggcaggagaagttcttggaaggcttaaaggatgaactgccagttacgttaatctcccatgactatgttgattttcagcagctggttgacaaagtaattcgacttgaagacaagaagaacaggatggataaccgtaaaaggaaaatgactgtattctaggaggcacaaggtagtagccagagacagcgtatcaagccactccaaattagtgaacctttttccgctggtcaaggacagtcgcaacagttgaacatcggtggtgagatcaaatcagagactaatgaaagcaatgaagttaacatcgagcaagctaatcagccggtgccagttcagcaggaccagtctcaggagaataacagtagtggaagggagcagcaggtatgtttcaattgttacaaggcaggccactttgcaagagagtgtccgaagccgaagcatcagcagccgcaaggtcaggtctacaacattgtcgtcacaggagccaatgcggtgccagttgtgtcttcaagtgttacaactcagccaccagtttcaaagcggcagtagttttctttaaagccttagaataattatcggagttatggaataagatagactgcagtttacctattcccttttctttctagccgttccgaatctcgggacgagattctttgtaaggggggtagatttgtcacatcctgatttttgttttaggatttataaattatttaataaattattaatagaatttatattaaatgttctttaatttacaagtgaagttaaatgtgggaaataaaatttcctaaat

SEQ ID NO: 80461 - DNA, 13690 bp, Oryza sativa
cctagcgccgcgccgccgtcgtctccttccaaatccggccgctcctttcccgatccggtgaaatcgattgaggggaaacaatcttcgggatctcctctaccttttctcttttggaatcaccggctaaaatcgtttggaaattcgtggattcgaggtcgaatcggatcggtctctttcctccaaaccccgatctttccttcgtgtcaccggtcgccgtgggccttcgtcaccgcctccttgcccctttaaaaggacccccggtgtctcctctacccgtcgccacccttgccttcgtctctagccatcggaagcgccctagtgccgtgtgacctcgagccgccgtcgtcgccgccgctccagccgtgcttcgccgtcgctccagtcgtcgccgtcgctcggggaggtcgccatcatggtcgccaagtcgtcgccgtccccgtccaccgcttcaccgccgccgaagaccgccggagcaccgtcgtcaccgtcgacccgaagaccgtcgccgcttcttcctcgtcgccggcgccgtccgttgcttttccgccgttgttttggtcaccggtgagttcgccgcgtcgccctctacccgttggtgccctccgtttgcgtcgtcgtgccgtcgttcgccggcgagcatgcgttgccgagccgccgccggtgctgacgtcatcgctgacgtagtcgctgacgtcatcgtcgccgttccccgtggctcggtcgtggaccgtttgatctcggccgtccgttttggataggatcgacctcggccgtctgttcccgtgaaccgttgccgtgcacccggtccaccgcaaaccctagccgctgacgcaataattcccttttccttttcaaaaataattcaatattgcgtcataattcaattaaaatccatataagtgttttaacccgatttaatctttaaaaattcataactaattcattgtaactcagtttaatgtggttcaagttgcaaaagttgtgtaaaataaagatctacatattaaaattatccataaattgaattaaatttatttaattctttttaaatgggctttaattatatttaatctagtaaaattcataataaattcatttgaagtcagaatgaggcccttcaagtctcataattcatctaaaattatgatctacatgtttgtttactttttatgtattgtttatttagtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactatgcatttattttcgaatgtcactgggtggtgtgaatctattcctttgttatggcctgtttgcattgactactttattccttgataccttgggttattataacttgactagttgggctttatatatattggttcagctagatattagttatgattgcttagccatgcttagaaacattagcacactattgggataacttatgactcactattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagctagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtaccttccagtatcgcgacgcatggtagacatgatgttgaggctgtgtcttgtgggtacagtggtacacctctggccagagtaaaactattcgaatagccgtgcccgcagttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaattcctaattaattactccactgttttacttctcttaaatgttttgctaaaagctgcttttgcaaatgagcctatattatgccatcctttggtatccttgtgcacttgcatatttgctgtgtggcttgctgagtatgtcatatgctcactttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttattgttttagttaatttgatgaatctgtatattaaattgtcagtttgtgtacctcggctgattcctggacgaggattttatgcacagataagttcggaaattactagtgaatttccgggcgtgacacatttgccacctccagctgccgctcgtcgccacttccgaccaccccaagtcatgccacgaccaccattagctccaccaccgctccactggctccaatcaccgctccagccttcttctccctgttgacgtcgtcccggtcgctgtccgtcacctcacgcccgcagtacaccgtcagaccgccgccatcgtcctcaccctgaggagctcaccgccacctccctccgtcggccatctccctccgttgccgtgtcgctcggtaagcatccccctctcctcctcccatcccttccatcgcttcccgcgccaccgctcgccgtcgattgctggtggctgtgcgccgccgcctcttagctgtccggccgtgagccaccgccgtcccctttggccgtgcaccgccaccatggactcggtccatggtggagcaactcctttgacccgctgacgagtgggccccccgctttgtggacgtggtccgcgctcctcctcttgctgacgtcagcgagcacctattttcctttgagaaaataattattaattgcgtcataaattggtaataattatagaaatttattaaaatggctcaaaacttctaaaattcatatctaattcatacgaactctaaattgggccattcaagttgcaaaattcatctaaaattgagctctacatgtttgtttactttttatgtactgtttccttggtttttattagggtttttcctcgttttgcatgccaacgtgtagtttccgcagtttcggaagtccgcggtcgcgaggaaaagagttcggaagatcaaagtgaagaagcaaggcaagtcacacattacccttgagcatattgatgctactttataaatgttttgtcgtttgcaaataaatatacatgttttgctaattacatgggatccgggtattacctatgctcgcttgtgccatgtttacttgttacccgacctttgtcaacctcgggtgataatttatctagctcgtgatacttatgttgtcctagctagaattatatatgcttagccatgcttaattaccactagctcacaaaatgggataattacattattagacatctagtattctgacgagctgtgtgctcgatgtcacgcccggaaattcactagtaatttctgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggctagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctgaaaaaccagaggcatggactccccagcgacccccgtggacttctcgccacttctcagtctggcgcactataatgaatcacgctatacaaaaaataaagtcgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagtaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgatccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggaaaaaaagagcaacggggaggcaagatttggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacgaaaatcaggatgtgacactcgagacatctggccatgtttcatggtcgtaattatccaactaaaatatgactgaatggtgggctatgggtgcatggttttgtgagtcgcacccatggcaattaaggaccagttcacgggaaaccctagaagacatacagtgcttgccacaagcgggagtgggtaactgcttgatctgaagtatagctcaaccctttcctaggcatcggtggcaagggtgggcgtgatggagttaggtcggccggggtgtccggttgtctagctgccggattcaccgcagcgcacaaggggactgcccacctccggggtagggggtgggggtgaaaccttagagtggtgtggatggttaggggagggttatatgaagggtcttgtcacaatcactcgacatggtgatgtgtcaggcctggcgcggtgacatgacgatggattgtgtcttgtgggaacaattgtgcacctctggccagagtaaaactattcgaatagccgtccccgcggttatgggcgatcgaccagattcaccgtgattagtcccaccttaataaattgactcaatgcactgtagttcaggtgggttggttggacctgttcaacgtggtgtagcgttgatcagtggagatttaatgttactttaattactcaacagttttaccgttttgctcaataaaatgttttacaaccgcctttatgcaaattgccacaaaccgtccttgtatccccttgcacgtttgcatcgttagtgtggcttgctgagtacggtggttgtactcagccttgctattgttcccccttttcagaagtgtagtgcttctgagctgaagatgaagttagaggatcaaggctcataccccagttgagttttgcctgtggagtggagctaaagcccagctaggatcgcctttttccgctgctactgcttttgtttcggtgtgaggactaagtgctcttctgtaagtattttacgctttatttacgtttggaactatatattacttgtcgttttgtgtaccctaactggtcctagatagggatttaatacacaaaatagtttgaaaatttgggttaaatttctgggcgtgacatttgttgacgactattaaataccaaatttacgtcgtcaatacctgcataaatatgaaaatatagaacatccaacatagtggtagggtttatttctaacaaattccacgagtgttggtatatatttggatgcatgtgataaattacaaaagttgagatgaaatgtacataaaggagggaaagaattacattcgtatcgaagcccatagactcttgggcccataaacccaacgaaatacctgcaactaggccaaactaccatgccaatgaaataaggacccacatgccatggcctaagaggaaggagtgggccagggggagccagccaggggtcagtcgaccacgcgccgatctccaatggccgcgtgccgtgcggctccgaaacagccacgcagctgctcgtaagtcgtagccatccctcctttgttttccctcctcgtccagtccttatctccttcaaagtgattgagccgaagttcgctattcctctgtagacatcaagagctaatctcgttttcatcccaaaacttctcctgccagatccaagtccggctgtgcagccgtttcgccggcgtcaatcttctgccactgcaccacggcaccgcaggaacacctctcatcggtgagaacatccccaacctttctccccttctttccttgcttgggtcgagctcccatcgtgctcctgtccaccaccatggctaccaccgtggtcagtttttccggcgcctcatctatatcaactaaccacaaaaatggaaccttctcatcccggaacgcattttgacacgctcactcgccccgttcgccaccggagctgccacttccatgcccggtgtggcggtgtcaccatagctccagatctggaactcgcgttccggctagcttcgttgtcttccagcccagcgtccacgtcctgtgggggtgtcagcctgtggaacacgtcatgctatcgtatccgtcgccgttccctcactggagctctagagcttttctctcacctctgttactcacgtgaaaagccaccggaagaagatgaatggcagcactgtttcctattggtaccatcaaaaccacctaaatagtgcctaaccacagtaaaaccagtccaaacaattctattatgatgtttttctcatgttcgagctctaaaacaccaaatcaatttcagttttcacccttgtcatctatagcattaattgcaaattgcaatcgctactacatataccatgaatcataaccctagaataaatcttttgtcatccaaatcaagttaactcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggtgaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgctaccaatccgggactaaagatcgctatcattagtcccgggtgaaataaccgggactaaagatcgatctttagtcccggttggtaacaccaacgggactaaagatggctcagccacgtggccggatgagccatatttactcccggttggtggagctgaccatttttttttttcatggccctgttgctgcatggtttatatatattttatatatatatataaaccatgcatatatatgtttcaatacatatatatgcatatataatatatgcatatatatatatattatattatatttatatatgtttcaatacatatgtacatgcataatatatatgtatttataaatatatatgttatgcaaatgcatatgtatatatatatatatatatatatatatatatatatatatatatatatatatatatatatatatatatatatatatatatatatatatatagaccaaaatatatttacattatagaaaatgtgtacacatgcatatagaaacatatgtagtcatgtattaatatatatgtatttatacatatatatgttatgcaaatgcatatgtatatatatatatatatatatatatatatatatatatgaccaaaatatatttacattatagaaaatgtgtacacatgcatatagaaatatatgtagtcataaattccttgtgtgtggtctggttatccctcatgcgaataaaatatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcagtacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagtttaaagctttgattcgtagtagcaattaacataacaagatgttcttaattaacaaaggaacttatgacagtacctatctataagttcgaaaaccttgtcaaacgtagactcttttttatccattgagtcatatacgttgacggtgcaggccgccaggtcgaagagtaaaagcacccagtggaatctgcaatgtgcgtgggatgcattacatatgaaacacttagcaagttcgtacgggaatgaaatttggtataggaagacagtaaaattaaacttaactctgtgttgtacggcaacagtatgaacgtcttgtaatgctgcgccttcaggagatggacgagattgtcctctgtggcttgcggatattagtcgagcattgcgacgtttactttccgagggtcgatgaatccagtatcgaaacccccctgccgtcgggccctttgaatctccattctacaacgataaagggagtatatattatatatagtctacttatttacaaggacctaattaattaaaggagacgtagtaagaaatctaactgaacgatatacttacaaaatccagcaactcataatagagccgtcgagggcgtccagctggtatggttcgtagattccgttgaaattgatccagagaatgtcatctccttgcaagaagtttgtgtccctgatcctcgctccgatcatctctctaccggtggcactcatctccatgtacagctgatggaacttgtacatttgtgtgggtagggattgcagcagctcaggcttgacaagcagtttaccgagttcgtacatgtatttcacttccgccttttcgattggtgcgactcctagcaattgatccgtagttagactggtatcattaataaattcttctattccaatatcttcaccggtcaccaacgactcaatctcttggtttggttgctctccaagctgagggactggtttggactttccagaagatgctttctttagcgtttgctcatagttcgatagctttatggtctccttggcaggtgtagacatacccctgaagaagttcctgacactcgggtctataggaatcttcttttctggacttcgaggcttgaattgtctcttgacttctgatgtcacgtaagcgtcaagctcctcttgcttacaatcataccccgggtccttgttcttggcggcttcaactttcgcctttttcgttgcccttgtgtgggcaggtggtggagcttggggggctcttgactttgaaggtgccggaagaggagcttgcgaaggagtcggtgcaagagcctgaggaggagtcggtgcaagatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaactttgaccttggagtatcttgctagaatcggcctgcagtggtaagtacctgaagggtccgttgggatgaccatgcccgacgccaccttcatgtggtgagaggttatttattattaatcaacatatataagcagcaactagcggaatggtcaaatctaaaatatataaactacgagcttacctttattgataagttcttgaaaggaatatgcagctcacatggtgtccgctgagtgatgtcatcaacggggcaggtggattcgtcctgggtttgcatggcatccatgctctgtgatcctacctgccccgttgaggcgcagctgctacggtttcctgacgggctcaccattgcaggaggaatggtcgactggggatcatgggaccgatgtgcggccatgcgttcatcaaccttccttgccacctcctcttgcatgctgagctcgtagctcgataccctgaactctagatctgcaatcttcgcctcggtatctttcttgctcctcatccgactctgtacgtgtggatgtcctccttgaac

SEQ ID NO: 80462 - DNA, 18879 bp, Oryza sativa
gtacgcaagaccacagttaaacgagacattggaccgggatgatacaataaatcaagtttagagacctcaatgtgcactttgtaaatttgtggacttaagtgaaacctcatgacaaattagtaccgctggtcaattttactctattaaaaaacagaatactatacaaatcgacattgttattttatttagagtattaaccttgatgctaacctaacaagggtgggcgaactagcataacaaccgtatcatgtgctttaatccgcatcaaatcatcctcgagctagagagattagccaagaagataaaacccgtctaaaaaccccccgaatcctcaaaaccctaggaggagagcacggtagatcccccatttccctcctcatctccgacgcgcatttcccccaaaagaggggagcaaatggcgtcggcggcgtgctcctcgtcggcttccgccctcgtccgcctcaccggcccgatccatctgtgcagcgccccgccccgtgggtccgcgcggcggcgccacgcttccgtgcggtgctcgttcgcgccggtggagacggcgaggataaaggtcgtgggcgtcggcggcggcgggaacaacgctgtcaaccgcatgatcggcagcggcctccaggtagggcgggcctaaccttcttgacggaactgggcttcctcggttggcatctagatccatttggtagttatatttgagcataggactgatgaacaagttgatctacgactttatttccgtccttccgtgcaatcccatgctgccattcgcgtaatacccctatctagttaagcgtacgagcacctttgttgggttattattcgctattaatgctggtgtccgtggtatacttatcatacttttgaattatatcagcatctacgaaatgcgaacccagtgcattgtttagcctgaaattccagcatgaccgttgtttgttttctcaaatagtaacatctggactgtacaatttcagggcatcgaattttatgccataaacacagattcccaggcgcttttgaattcgcaagcgcaatacccgctacaaattggagagcagttaactcgtggactaggtaatatttgttgttctctgctgaactgacacaattatgaaacgttctgtatgtaaatgttacatctttcatgctgattagtctgcctacaagaacatattgatatctgatggttgtctacgatgtatcgataacatgattcacatgtctcgatgcactaataaactgtgggaaatgtatgagtatgacatattttaagggcagcaaatttcgattcaaaatagcaaaatgttgactgcagtcgctaatttattccatgcatacaggtactggtggaaatcctaatttgggagagcaagctgctgaggaatcaaaagaagccatagccaatgccctgaaggattctgaccttgtcttcataacggctggaatgggagggggtactggatctggtgctgctccagttgttgctcagatatcaaaggaagccggttatctcaccgttggagttgttacctatccattcagttttgaaggacgcaagcgctctcttcaggcaagtgtttgagtcttctccacccgtatacaattaatgtggcgttacatttgataaatagttttggttaagcatggaacaaacatttccttaggggagctgtgagttatttaagatgatgattaaacacgttttaatcattggactggtagttataatgtgccaacgtatggtacctgtgttttgttgttttttcagttcaaggtctggtgccctgtcctctgctagctcttttcaatttttgtagcagaggatctttagaataatatttagcattttttaacgaagtaatatttgtttgagttgctgttgctatacacagtttgtagttatttgccctatgtgaacccatttggttctgttggactttagtttctatacactagctgtttgtatttttcttaaaataattgtctgttaaaagctgttttgcttttgtctagctaatttatctggtctttctccatttcaggcgttggaagcattagagaagctggaaaggagtgtagacacacttattgttattccaaatgatcgattattagatgttgttgatgaaaacacgcccttgcaagatgcgtttcttcttgcagatgatgttcttcgtcaaggtgtccaaggaatatcagatattattacagtaagtattcttcttatctatgctgctgtaacttgtgatcacacaatactcatctgaaaactttgcagatacctggacttgtcaatgttgattttgctgatgtgaaagctgttatgaaaaactctggaactgcaatgcttggtgttggtgtttcttccagcaaaaatcgggcccaagaagctgcagagcaggcaacacttgctcctttaatcgggtcgtctattgaggcggctactggtgttgtgtacaatatcactggtggaaaggacataaccttgcaagaagtaaacaaagtctctcaggtgcgtgtaatatttcttgccattgtcttgaactgtctttgaagaagtatgatatagcactgtaatatgttaagtcgaaaaacttaagatgctattatcacgatcatactccacaatttagggctactggaattatgtggcctaggtgattgaagtgctttgttttgaccaatgcttatgcacgttttgcagattgtgacaagcttggccgatccttctgcaaatataattttcggggctgttgttgatgaccggtacactggtgagattcatgtgacgatcattgccacagggtttccacaatcctttcagaagtcccttttggccgatcccaagggtgcaagaataatggaggccaaagaaaaggcagcgaacctcacctataaagcagtggcagcggcgacggtacaaccagcgcccgccgccacttggtctcggaggctcttttcctgaacacggttcaataggaaaactagtagtttgtgtaccttagattctcatggaattactgagttggcgctccaatcaggcttctatgtgttattctttttggatatgtaaacacttaacagttacacatagtgattagcttcacttttattgtatgtatcatctagatgaggttgaggtcttcaggagttcagcagccgtcacgaatttttattgtatgttcaagacgacacttggtagttgttcgttgtaggcgcgacttgctggccaaatctattgagttgtagatgtggatgaatttgcacttgattgatcttgcatttttactcatacggagacgccacgtgactacatgatcgctctggtgtcttgagaaatccatttattcattcttgttggatacccagaggccagatgaagggcctgtttggtacatctcagagtttcagcttcatctaaaataggagcgaagctaggtagagctctctcacaaaataagcggagctggcagttggagctctaccaaacaggcgtaggcgtgaactattccacccagtgacttccacaggtgtgcttacccggcccagcacgtctgggctgcgtcaggccatgccgttttcttcactggcccatacataagccatagccacagaaaccagcgattagtaccataccgctgattcggatgcagaacgctctcccggaacagtataaaacaagtgccaaggcagctgttgaaaggcaggcagctgcgcagtgggcacaaagcgaactattctttcgccttttactaaagaataccgtgtgctcgctgcaaatagcagcatactctaattttttgaggggatttccagcatttggagaaccccaacaattctgaaattgaaattagaccttctaatttatatgattttcaccgtgatttgacctctctggcctagcacccctgaaccgaaagcagctcctttgtcccaggagagctcctttatatgattttagtttggatgacaacaggagagttcctttgtcccaggaacagggctcttctgcactctactctacagtgcagctgcagttcatatctcaatgaggtagattggtcctgacatctgatctcgacataggtaagcgatgcatataacgagttgttcatccaaatttgtgaaggtgaattgatctctagacgatttatagattagatagtgttggcaagagaaggtggtgatgaccaaaggggagacgattgaccttcaagctcaacgctgccgagtttattgttgcgtgcggcggcgccgtgagcccatgacagacgggaggcttggatgagtaatgagcgggaagcaagtgacggccagggtgcgcgcggcgcgccggcgaggcacgccatgatgcgctggcggcgtccttgctgtgaatgggggggggggggggggcttatcaagaaaaaccacgtttcgatcagtctttgtgcggtgcagatgatattttggggcgggaagttgtattgtattccatgtatcttctttgttactctgtacaagacaccattctaatgttctgttgaatttatgtgtggacgaacttgtattcgcttgattttactcgatgcagaaatgctagagaaatgatccttctgttatgtttgaacgcagatgagctttgcctgaacatccgtcatccggcccagcaccagtgggctacctggcagtgaatgtcttcacccatattggcccatcgccgctgatggcaaaggtagcagagcagccaccgattagtaccataccgctgctttgggtgcagaatacttccctcaaacagtataaaagaagtgccgaggcagccgttgagaagcaggcagctgcgcagtgggcacaaagcgaactattctttcgccttttactaaagaataccgtgtgcacgctgcaaatagcagcatactctaattttttgaggggatttcctatctaaggacaaaccccaacaattttgaaatagaaatttgatattttttttcaaggggtttcctgtctaaggagaaacctcaacaattatgtatgaaatagagaattgacgtcttacactctttctccatcttatatacagttgtttacttcgtcaaaatccacaagttgctgatagaatcctttgtgacgttacgctaaaaacacttcagcaaactgatctgttctttgagtactctggacggctgtcggccctactcgttttgggagataaacttttggattaaaatgacatgtttttcaaacggttaaagggtgtgtttcgtgcgaaaaatttctatatgaaagttgttctaaaatatcagattaatccatttttcaagtttgtaataattaaaactcaattaataacatgttattaacaccttattttacgtgaaatacttaatctttatcttcatttttagaacattcaaacaccaccaagatttgcatgctttagctgagatgacagcaagaggtatcctttgccccagcccccaggaacagggctcttctgcaccaacactaggcttcagttcacatctcaacgaggtagcttggacctggcttctcggttgttgagtatataactagttgttcatccagttttgtgaaggtgaatgaatctctagacgagttctagattggacaatgagctaacaaattcgcttcttccccatcgttgtcaggagaaggtgatggtcaatcacctaaggctgccaggattgttggatacttggatgcgtgtgacatccgggagtcttggaggaagaaggagcgggaagcaagtgacagccaggatgcggcggcgctccggcgaggcacgccgtgaggaggtggcggcgttcttgagacgagtgtgggagtcggagttttaaactccgagcccccttggatctctaacgaccgttcgatcaggcttctgcgccccagattaaccgaaaattattcaggggcttcatcgccaactaaacggaggcccattatcttgaggcggagtgggggcaaggcccacttcagtcggccgaaacgaggcccaaaattgtgtggcggaatatgaggaagagctctcgtggcaggtagaagcgattagtaccataccgctgctttgggcgcagaacacttcccagaacagtataaaacaagtgccaaggccaccgttgagaggcaggcagctgcgcagtgggcacaaagcgaactattctttcgccttttactaaagaataccgtgtgctcgctgcaattagcagcatactcaaattttttgaggggatttccaggatttggagaaccccaacaattctgaaacaagatttgattacctcctgttcatctgttcgtaggcatggtgatagatacgcttctaattttgcaggtcttaagatttcatcttattccctctctagtagagatacaactgtccattattcacaatccgatgtgctgctggcgatctgttccatagaaccgcaatgagagacgttgcaaaactaaaatcagaatcagaatctgctgtgacttcacacgtattcgctatactggttcatacaggtctagagcaaaccgatttgattggttgtaggttttagtactctgaaatttgcagctcaatgcttcagttaagatagcaacacaggtttctcctgtgtccaagtagcagggctcttctgcaacctacagctgcagttcacttctctctctctctggaaagatgattgcagttcacatttcaatgaggtagcttggtccatcttggcatgtgtaagtcaatgcgtacaactaatttttcatccagttttcgccgtgtttagttacaaagtttttttttcaaactttcaactttttcatcagatcaaaactttcctacacacaaacttccaacttttccgtcacactgttccaatttcaaccaaacttctaattttgatgtgaacaaaacacagcctttgtggatgtgaattgacaacttctagattagataatgtgaatccatttttaaagtttaaaataattaatattatatcaatatacgctaatggcccatctcgttttacgtatcttctcaatcttccaatattctcgctatgattcttggggaattagagagttggcgttccaatcgggcttctctgtgttatttcttttggacgtgtaaacgctgaacagttgcacataatggttagcttcatttttcttgtatgtagttatgtaccatctagacagggttcaggccttcgatcttcaggggttcaggttcagcacgttgtgctcaagatggcaccaggtggtagtagttgtattgttcgttgtaggatgggaattgctggctacctttcgtcgcatgagacataacactgttctatcgaattcatacgtgtcatccctgtattcgattaattttactcgatgtagaaacgctgcgtggagaaatgatcgttctgtttttctcgagacttctatatgtgttggatacgcgacaaagcccactagcgagcgagggaaaatattggcattttgcacttctctcttgggaataagttcacttagcgactctcaaaagtaatcaaaatctaatccgtgaccctaaactataaaaccggatatcccaacccccaaactcttaaaaccggtgtaatttgactcccttggcagtttcgaagggcgattttgctgacgtggcgcctacgtgacggtattgaccgggtctcctctacacgtggcattgacgtggcgtttagatgtcatttagaattaaaaaaatatatgcaggacccatttgtcattgacacccaaaagaaattgtgggacccacgtgtcctttctctctctcccctccctccagttccttctcctcgctgctccctctctctctctcccgcggcgggcggcgagcggcggaggcatggacgtggcgcggcggcctgcgagcagcaggaggacggcggtcggcgacagcgggaggcacacgcggtgcggttgacacgacgtcatccaccgtcaccgtcgccgcccaccgtcacgcgacctccttctccacctcctcgcttcatcgccatccgtattaacatcaaatagttactgctaactcgcacatttactggaaaaaaaactaatcttagcatagttgcatcacccctcatccaaaaccaaaatctactcctcacctttccatggacaaatcattcgcatgcataaaaaagagaaaaggaaagagaacaaaggaaagagatccccaaatgcaatgcatccaccaaaacctcccatttgcagcaagcaagattcagtgtatttgtgggacagaaagatttggcaagacgacagctactggcctaccgctgcgtgtagatgaccgccggatccaacgaagtagcagagcaagcttggaattgagaagaaaacatccttgtggtccagcaagggcgacgccgctgggcttgctcactgcctcttgctcgccgcggatcctgcttggtgcggcttggtcgggtcagtggcgaatctaggatgaaaatagaggtgatgctttatatttaaagtcataatacaaaataatcatatactccctcctttcatattataagactttctagcattgtctatattcatatagatgttaatgaaactagacatatcatctatatgaatgtggataatgatagaaagtcttataatatgaaatgaagagagtatctttgaactatatcaacaatattttaaaatcctgcgagggtagaaaatggaataaagaataaagaaaatggaataaagaataaagggagcaagttgattggaagatatatatataggtcatgggctgcagactgcaacagctactggaacacaagagtaaaaataatccacaatataattaatgattacaaatgatctattaaattttcgtgcacatcgtttctttcaccctgaacttctctagccaaagagccatcactgcttggccctttgctttttgctgtcaattttgctggcagtgtaaactcactaagcatagatatctagggtcgattcttggcagccagagcaggggctggagcccctaccagccccaacagtggattcgccagtgggtcgggtcacggatgacggctgttgcttgccaccgcctggctggcgtactgatgccgcagccgtcgccgctctagtgcttgccgccgccactcccgcgcctccgccgctcgcaggcggccgcgccatgcccgcaccttcgctactcaccgccgccgccgccgtcgccgcttgagagagagagggagcggcgaggagaaggaactggagggaggggagagagagaagggacacgtgggtcccacaatttcttttgtgtttcaatgacaaataggtcccacacatatttttaattctaaatgccacctaaacgccatgtcaacgccacgtgtaaaggagactcggtcaataccgccccataggtgccacgtcagcaaaaccgtcctctaaaaccgccaagggagtcaaattacaccggttttaagagtttgagggtcgagatatccggttttgtagtttagggttacggattagatttcgatcacttttgagggtcactaagtgaacttattcctctctcttgcccagcggcgtcaccagcccagcatcgttgggctgcctgggccatgcacgctgcgccgttttgtatcttgcctggcccgaatccacggatagcacacagcaccacgggaaagagtcgcgcaaccagtgattagtcccataccgctgccttggatgcggaacgatactgggaacagtataaaacaagagccaaggccgccgtttaaaaacaggcagctgcgcagtgggcacagagcgaactattctttcgccttttactaaagaataccgtgtgctcgctgcaaatagcagcatactctaattttttgaggggattttctatataaggagaaccccaacaattatcaaaatgaaattaaacttatttttatttttcctttttttttatgtctggtcacctaaattgaagcctacgaagggcctatgcagttgctcacgcatgttacgcagtactgtattgctgttttgctctcacgctgtcacgtgatatcagaattgttttactctcacgatatgtcgatcagaattgtatccaaattcacaactcgctgatggcatcccgatttgctggtgcagaggcgaatggaggttttgcttcgggtggtgatcagtcctcaaaacaagaccatctgtctgatggagtcagaatgaggcttgcaaaactgaaagtagacaaaaccgtctgtctgatggaatcagaatgaggcctgcaaaactgaagttagagtcaaaatccgctgtgactacactaatgttggctaatactgatccacagtccagagcaaactgatctgtttgtgggtagacagcgtagttttttagtagtaagtacaaagacatatgcagctcaatgcatgctttaagtcgagatgacaccaggagatcagtctccttgtcactgcaggaagtgggctcttctgcactcaaaaggtgcagttcatatctcaacgaggtaacttggtcctgacatagtgacatcttggttcacatcacgatgcatctaattaattattcatccacttttttttttttatctccagagtccagacaagggctacattagatcatctccaacaacctctacaaatagaactctctaaatacccatatagccaactctccatctaatttggctggctagtcaaactagctattcacttcaacaatctctccatctatcctctctactttgactctatgacaccgggacccatatgtcagcctctcccttctttctccccttccttcccctcttcctcttttctcacgttggcaggatacaggcggcggcggcgaagcggcgaggggacagcggtggtgggcgcggtgggggccgacggctgcggcgaggggaggcggcgggccgcgccgcgcgggggccggcggccgcggcgagcggaggcggcgggccggcgaccgcgacgagtggatgcggcgagcagtcgcgcgggggccggcggccgcggcgagcggaggcggcgagcgtcgcgcggaggccggcggccgtggcgagcggaggcggcgggccgcgccgcgcgagggcccgcggccacggcgaccggaggcggcgggccgacgaccgcgacgagcggatgcggcgagcagtcgcgcgggggccggcggccgcggcgagcggaggcggcgagcgtcgcgcggaggccggcggccgtggcgagcggaggcggctgccgtgctcttccctgtgctcgagctcctcccaatgcggccatgcctcctcgtgctcggttgccgtgtgggatggaggatgggctgtgtggggcccactattggtcagccaaatagactagccaaatttggctagtgaagggagagttttggccagagccatccggttagagaaacagttggagttagtttttttagttagaatggctaaattttgacttaaagagtggaatggagaggctgttggagatgctcttagataatgtgtcgatgaaattgcctcttccaccattgttgttacttgtcagaaggtgatggccaaagggaagaagattcatctggaatctgccgttggtgcgtgcagtggcgtcgtggctaaagaggaggaaggagcggggagctggggacggcgagcacgcggcggcgctccggcgaggctagccatgacgcggtggcggcgtttttgctacgaacgtggcgttcggagttaaaaaccccgaccccgtcggacctgttacgaccgttcgacatgtcttgcgcggtccagattagcttgaggcgagatggggctcggcgtgtcaaacagaaacggcccaagaaggcccaattttaggatctctcccatcgatctgatccgcccaactccgatcggacggtttaagatcgacctgaatcggatccctaccatttggtgcacgtttgggcataagtcacagtgctagggtctcttttgcaaaattctcgtggcacttcttttccggaccgatctgacccgtctaactgcgatcgtacggtcagctctgagcgtagaacgccgccgccggaggcggcatgtggcggccgcgctcctgccggagacggtgccgctgccgcgttctcgccacgccggccacgctatgcacggcggaggagcactcccagggtatccgcttcgtgcgtgccgttaacctcgacctccgactctccgactcatcggtaagtcattcctcccctacctctccccgctcaccagctgctcgacgaaatgctcccctacaaacactggagtcccgaacgcgcatgcgcataccatgacatagtacagtaatctgatctcaactcttccttccacctagcagtatgcatgatgatctggtctattcatctgcgggaacaattcctcaaaacaaatgcacataactagttaaaaactgtatacgattgctgctacagatttccgaatttgatcctagcagcctatagatagattggatggctatccattatatagcgccgtgtgctaggtccaataatgatccttatttcttaagtgatcagttactaaggtgcatgtgcaaggcagcgttctcttggtcaagaccaatctgttgtgacttgaagcccttatcatgatatataattggataacaacaaaaaacccaattaattaagctgccatggtgagactgtaagagtgaaaagaacgagaactagacaaatgggccaggctacgaatcgaagctatgattcatcaaatagatgctagtcaaggcagaaagatacaggtacatagagaattagatgtcagtcacccatgctgataaagaatgtctccatgttccctatatataggtgtgcaggagcaccaaccgaccgaatgcttattgtccatagaaatcctgatgcgttcaggcaaaaacatatcttgcctcgtaatgtgattggtgtcattggttcaatcaaacagattttgagccttgtttgattccctaacttgctggtcaatctggcgacacatattattggatgccatattcaggtctcagggcttgatcgtagtacaagtaatcacatgcaagctgcacgcagtttcatgtagcatgggcttcaaacttgtagaactacacaacatggcaccggggtccgggaacgacttgacctagctatgttaggcttgtgcatacactactaggctcgttttcatgtcgtcgctagcttgctagctaggccggctattagaccgtgaatcaaggtttaatatgatctattcattatgaaaatttgttattatagtcgtatcaaagattaatttaattacactcttttgacgagcacaacttatatgtgattagaagctacattttcttttctcccatgtgcaaaagattatcagacttctacaggaaattagggttgggatgggatgaaaccatccttgattttagggttgggatgattccactcgtgtgtttggtttgtagaatagtacgatcccagtttttttcttatttggttgaagggacgagagagggatgggatggacaccgtttgtaaccaccgatgacggccggccgggcgaaggagcgcgactatagcctggcaacaagaaggcggaggagaggcgtgagcaggcaaagcaaccatggccgccgtcgccgcctctgccctgacctccctctccaccaccgcagccgccgccagtggcaagcgcctcctcctctcctcccttggctccctctccctctccttcgcctcctgtggccgcgtcgccgttaggccccgtaggcgggcgtaggagcgcgacgacggacgggcgggcggatccgctgccaccgagtcccccgcctccagatctgccgccgcacccgtccccatcgccgaatccgccgccgccatccccaccacgggatccaccatcgccgaggcccccgctgccaccattgccgagcccgccgccatcgcccgagccgtttgcttcgctcgagcccgccgtctcctaagggcgagtcacgccgttcgctcatcccaggtgggacgagttcatccgccacatttggctggatcggttggtcccggatctgagagaaatattcttctccaggggactaacccatcccactcacctctaaactaaacacctctaaaagtgggttcgttccaacccatcccacccttgcaaccaaacactaaggagctaagcatgcatcatgcatcaatgagacaaacagtatagcttagccacctaacaaaatcagtatctcctgccttttcactggacaaaatgacaatcggccgttacttttggggtcacatggactctgattaataattaatcgaaaattgtgcaagggcataaagtaatgcgtgttagtcacttgtcgcattcgaatatcgttaaaaggtcgcattactgatagcaccatttttatatgcaatatgcttatcatcatcccatacttgatcagactaagcaaactaactgttaaacttcctgtataaatatgcatggagaccaccatgcttcacactccactccacactggcacactgcccatatccatctattctgaatagagcctctgcattgagttaagaactaatccgtttgactaattctgtttttgcacacaagtcgccataatcaccatgacaatggccatggcgtcaatgaagggagagaacgtcactgtatctgcagcagcagctcctcggatgaagaagctggcgagcatgctttgcatgaagggagggaacggcgatggcagctatctcaacaactcccaagctcaggtacgtacgacgtttccaaacacgagctttacagaaagcaggggcaaatcctgtgaaatgaatcactgggatcttaactagggaaactattctaatcgctcgaggggatgttccctcgtttgctcaaaaaccatctaaacggttatgaaaaattctaaaaaaatttgacaacattcatacaacacatatatacaacttcacaaaagtccaaactcaactcacacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactttacattatcaattttttttttagaatttttcacaactattagcatcgaatttggaagaaaaatgtatacgagaggatatcccctcgaggtattagaatccactcctcttaactatacatttagcaaagaaaaagttaggatctgaactgaacccttgtgctctatgaaatgatcatgtggatgtttcaatcgtctaacacttgtgtttaatatattgaatatggctttcagttactgcaacaattttttttacaagtacaaaaactcaaaaattttctgaagatgtgtgcaaaacgacgagtgtttttgtcctgcacaagatatcagatgtagctagccatccaatatttagtcctactttactgtacaagtaaatgcatggtagttactataatacaggttaagaattgatagcgtcagtttttaactgtaaactggctataaataggctctgcacgcccggcgcatgcttcactttctggaggagacactggacgcgatgatggaacgttcgtccagcgacaagctcttcacggcggccgacctgggttgctcctgcggcagcaacagcctcttcatcgtcgacgtcatcgtccgccgcgtctccgaggcgtacgagtcccgcggccgcgacgcccccgagttccaggtcttcttctccgacctccccagcaacgacttcaacacgctgttccagctgctcccgccgctcctcgcgccggtggccggcagcctcgaggagtgcctcgccgcgggcgaaggcgcggcgacggcgacgcggccgtaccacgcggccggcgtccccgggacgttctacgggcgcctcttccccggcgagtccatcgacgtgttcacctccaccttctctttgcactggctctcgcaggtgccggaggaggtcggtgacagcgcgtcgccggcgtacaatggcgggcgggtgttcgtccaccgcgccacggaggccgtcgccgccgcgtacaagcgccagttccaggccgacctcgcccgcttcctgcgttcgcgggcgcgcgagatgaagcgcggcggcgccatgttcctcgcctgcctcggccggagctccggcgacccggccgaccaaggcggcgccggcctcctcttcggcacgcacttccaggacgcgtgggacgatctcgtccaggagggcgtggtcgagggggagaagagggacagcttcaacatcccggtgtacgcgccgagcctgcaggagttccgcgacgtcgtgcgcgcggacggcgcgttcgcgatcgacaggctcgagctggtgaggggagggagtccgctggtggtggaccggccggacgacgcggcggaggtcggccgcgccatggcgaacagctgcaaggccgtggccggggtgctcgtggacgcgcacatcggcgagcgccgcggcgcgcagctgttcgagcggctggagcggcgcgcggcgaggcacgcgagggagctcgtggagaagatgcacttcttccacgtggtttgctcgctctctctcgcgccataacagcatcgcaaacggatgcgtatagcagcatccgcatagtagtaggttcggtgaacccgttttgagtggttgcacacgaatttgctgcagctttctttcatttccttggcttccaatgaaacgagttctacgtgtacgtttgtaccgcacgtccacgtgcacagtgatttgtagttgtattccctctgttttatattatagctcgtttaattattttttagttaaatttgtttaagtttgatcaagtttttagagaaaaaaatatagtaacactttcaatataaaacaaacatattatctaaatatattcaatgttaaatttaataaaacttatttgatattatagatattgctattttttctataaacttcatcaaacctaaaagaaaacttagatcaagaaaaaaaatcgaacaacttataatatgaaacggagtactagtgagcatgcgtatttgaaacagatcgcttgattccatggttaaacgcaactacgcaaatatgattcacatagggaaattctggaagtgaaaaataaattcagcaaaaatattctacggaagaagcaattgctgtaccctctcgcagtcttgcttggcactgtacatgtattgtatggtgtgttggggagttctgtgactatacagcaaaatatgtgggtcaaagatccaggattatgcaatcgttctggaaataccatttatttgggaaatttggtcacgaccaaacagtaaattatcgtctcaaaccttacatttcacactgaacccggagaggcagagaattctctactgtttctaacttcacaagctaaaggaacatcaggaaataaaagtcatccgttcacgtgcttcagactaacatcttatcgcacatcggtcctctgtactgctcaaccaaataatgaccgacccttgtttcgttcaagccgagcctccctctgttaataataaaatacaaaggaaatgaagcatactcaactggaggaaatagtatgagaagtaaaatgttgtgatcattgatcaagcatatatagaactccttggtcattcttgtttatgatataaagaaagatttcgataggcattagtccagataaataaaaacattcttgcaaataaagctcatcccagcatctgaatatatttatgatatatagtcaagttaactttgctcgcaacttgcacgtaaagatcatataccagtttttacttgaatagatttgtcatgggcactgggaccagaggccgaggcccaagattatgtatcaaatatttaaacctgtacgccattatcgcttctctacataggtatttttcagactcaaatattactactgaatcagctaatgtgtttgagagagatgtaacaggagttcaattatcaactaacaattctgatgtagcagattgttgttcatgtgttctggcaaatattccatcacaaacaagaacacatcacagagaaattctaggtgaaagtgatgttttttatacaagcactaaaattgcacattgagggcgctttggaatcagaaaaaaaaaggtttaactcaggaagacggggaagatggagagactgaaggttcagatagacaggcataagatgacaaaatattcaggccacctagaggcaataattttatggtgagttcgtaatgggttcaataactgactactgtaaatatctacttctacggtgcaaacaattggttatacctgaggagaaaggaagtgtagatcaagtcaatagtgcttactagtctatggaaatcttatataatggcctcggatttttatcagcacatggaaggaggaaaattaacagacaagagcattggtaagataggataagaacaaaagcaatcacagtgataaaagagggccataaaattaaactctaaacagaaacagtttccaagcgtttttctggtgaaacaataactactaatgtttgtttgaaggattaacaatggtacacccatggagtcagggacgctcaacaatgtacttgttggtgaactgaatgaaggtgtggcacaccatgtcgcgctgccctttgggtaagcacatcctaattcttgctgtataccgagccattctacatctacacaatttcctgaatagttttgtttttttcaatatcatgtacagtggcggagtcagcgtgggggctggggg

SEQ ID NO: 80463 - DNA, 29945 bp, Oryza sativa
cccctaccccctaatgaatcattagtgtccccattaagaccccctaaaatttaaatccatatatctattgcaagggggctaaaatagaccttgtctgagattgttagaaggtccaaaaggctgagtagcccccactataattttattctggctccgccactgatcatgtaggaacatgaagagcatatatagtcactaatattagcaccacatgacatgatgacagtagaggggaattatcatacacgaacaggacaatatggtgaatatgccaatgccactggtaaggtaatcagggtcatctttggccaaactgtgccaaaagttataatttaggatccaccaaaagtgcttaaggcatgtggccagacaaaaaaccgtcaacaagaacagaaaacaaaacatattgtcttgcacgatcgattggggtcgtaaatcatacagtaccatcactatttactttagacagattaggggaaaataggataatagcaatacctctctctttttgcactccttatagtcgtcgaactgctgctggcacttgctcttgtcttggttggcctccaaacctgaagaaccaacacgaacagaatcagagatcaaccacacacgcgtgaaaatccgagctctccacatagtatgatgactgcgaagggggtcaaggaggcggcgaggagatgggggtagttagatcaagattaggacggatgcatcatacacttgagggaggcggtgtactgggggaagcagtcggagtcggcgatcctggcggcgctggggtacggcggggacgccgccgccggcgacgacgcgcggtgggtggggggcgccgtggctgccttcgccgtcgccatgatgccttcttcctcttcctcttcctctctctgctcagcgttgcggggctttggatttttttttcttttttctttggcctgaatagagtccacatcggcagtaatgggcagaaatatctatagacgttgggccgtgcagcaactcgttttgggccggaatccagcccaacacttgcaagatgattttttatttcagggagttgctaaccgtatatatggggaaaacttgggttcatttgttactcctaaagtcctaaagaagtcatttggaagagtggaatcggccaaagttaaacaattcttggcatgatatcatggttggttggcatgatatttagcttcagaacaaaaccttgtacaatgagctaaatatcatgcaaaaatgtagtacacgatcaaatttaggcatacgcagttttcagaacaaaagaagaaaaaaatcaatgactgtatagtgtatacacttccaatagacatcttgtgcctacagatagaggccattagactgtgtacaagagctgagtcactgcgtcatagataactatttctttgttgattactgcagttgaaatttcgtcgaagtatacgagatgttgagttcctccgaagcaaactactcccgagttgctcagaatatcatctgattagctgccatctaatcgataaggtgtaagcacgaaatagaaaagacggagtgctatcatattgacaaagcaaagtcttctacaaaagtattaaactgacctggacggcaataattttgcagtctcgtgcaacttggtcaataaaaaaattgttttatgcaacttttggttcctatatataaacgtcattcgtccatagcaattcaaacttcaaagtctcgtcctgttcatcttctccaatgtgccctgtgaacggaaagctgcagctgcacgatggcagaactgcctaccacttccagcctgccaagttctggcagaatggtaatgtacaccttgcccttattgttctatcattgtctgcttgaatcatggcgaagttcataacttgtttgtcaaatcgtgtttggatctctgaatttggatggacactgccgctggcgaaactgaacagatccaaatggtacgatgccccttcttcctcctccatcattttcttttcttccattatattcagtcattcagaatgagtccatgcacgaactcttcactcttgtgagcttaaaaacctgtaatcgaaaggtattagtccacataattaagcatattttaccatacacaataaagtttggatgatcattgccaatcatcaggttgtcttggtcatgatcagcataattgcccagtaatggcagtaattttccattgaaatggcagggcctctgtaccacaacggtttgtaccatttcttctaccagtacaacccgcacggcccgctctgggacaccggcaagctctcctggggccactccgtctccggcgacctcgtgaactgggccttcctcggcacggcgatcgaccccaccgacccgttcgatgtcaacggatgctggtcgggctccgccaccgtcctcctcggcggccgccccgccttcctctacaccggcagggacgccggcggcgtgcaggtgcagaacgtgtccttcgccaagaacccgctcgacccgctcctccgcgagtgggagaagcccagctgcaacccgatcatcgccttccccgccgacgtcatcaacaacaacttccgcgacccgacgacagcgtggctcggccgggatggcctgtggaggatggtcgtcgccgccgaggtcgccggcgccggctccgccctggtgtaccggagcgccgacttcctccgctgggagcggaacgccgcgccgatgcactcgtcggcggccgtccccgtcctggagtgcccggacttcttcccggtggcggagcacggcatcgacggcctcgacacgtcggcgaacggcggcggcaccggcgtgaagcacgtgctcaagctcagcgagttcgacacgcaccaggacttctacatggtggggcggtacgacgacgagggggacaccttctcgccggaggagcctgaccgcggcgacaactgccggagatggcgctgcctcgactacggccaggcgtacgccgccaagtcgttcttcgacgcgcgcaggaatcggcgtgtgcagtggctgtgggtcaacgagtacgacagcaaggccgacgacgtcgccaagggctgggccggcgtccaggtcacctcccgctcgccaccatgcacgccggcgacgtcgccatcgatctgattcggcgacgaactgaatatcttgagctgccgtgcaggcgttcccgaggaaggtgtggctggacggcgacgggaagcagctgctgcagtggcccgtcgacgagatcgagacgctaaggacgaagcgtgtcgggctgcagggcacggaggtgaaggccggcggcctgcacgagatcgtcggcgtcgcgagctcccaggccgacgtcgaggtggtgttcgagatcccgaacctggaggacgaggccgagagcttcgatcccgactggctggatccccacaagctgtgcaaggacaagggcgccgcctccgcgcacggcggcgtcggcccgttcgggctcatcgtcatggcctccggcgacctgcaggagcaaaccgccgtcttcttcagagtgttcaaacaccatggaaagtacaaggtcttcatgtgcactgacctcacaaggtaattgaaagttgaaactcctccaagccaattaaaacttaaaatttgtgacccaaacgattaccaatttttgcacaattttcgctgaaattgcatacttgtaggtcatcgacaaaagcagatgtgtacaaggacgcttacggaggattcgttgatgtggacatacagaaggacaagagcatatcactcagaacactggtaaaattctgtcactaaaatcttagttcttcagtacgtaaaccatgcgcatgaactgaaatcgaacgaaaattcagattgaccactcgatgattgagagcttcggaggcggtggccgagcgtgcatcacaacccgggtataccctgagcacgcagcaacaagcagcagtcacctgtacgtgttcaacaatgggtcaggcacggtgaatgtgtccaagctcgaggcgtgggagatggccacggcgaccgtgaactctgcagatgcattggacgcaataacgcgtagctgaaacgtcttagtatgcatggcttggctaattcgatcaatggttactgtgctgtggccgatcgattttatcatttatcattcatcagtcacacgaccttcaaggccatagcctgcctgtctggaggtttattgccttattcccaggataaaataaaggttgtatgttacaaatgtttgatcggttctcaagttcacacagtgatggatgttgctattgcagattatattactcttaagtttttaaacgaaccgacactaacaccaatttcattgaatatagtaggagagaggatacttacccgtaaaaacaggaaaaagatgttatatacagagttttttccgtaggcttaccactctatttataaggataagccaagcgaagaattgttaatctttcatttggctctgaaaattctaatcacctgcaaaagaagccgcttgatcgatcgagtgcagcagaggcaaatggatctcttgtgaattgtgacagccaaggtttagtcaaaagacaatggtggtaggttgatgcaccgaagtaaacaaatattgaattactcagcagagctgatctgattagcaccgatcacaggttggtccgcatgcttacgtacaaatatcgtcgcattttatatgacctaatggtcatcagcgattaagaaaacattagtgcgcacatggtggcaggtgcttaattaacatgtattaaactcggagacttgtaagtcttctcaaatttgcaaactctactgttttgtttgatagttttgctagctgctgcttcactctactgttcggccatggcgttggctggattgcccctctccgtctttgccatcgctgtccatttttgccttgttttctcctcctcctcttctcctccggtttgccctgcaaacggccaccgtgaccgaacggcgtaccacttccaacccgccaagaactggcagaacggtgcgtatgcaattacctctctgagtttctgtgaattcttgcccaaaaatactatcaattcccgttctctgatagtgtatactgtattttcatttggatatatctggatgaactgaaccatgtgggaacggatgaaaccaattagatccgaatggtacgtgttttttttactgatactctgctcatatttctgtcttcttcaatccatggtaatttgtaccttaattagggcgtagtgaccattaggttgttcttaatatgatcagggcctgtgtactacaatggcatgtaccacctcttctaccagtacaacccgcacggcgcgctctgggacgtcggcaacctctcctgggggcactccgtctccggcgacctcgtgaactgggccgccctcgacaacgcgctcgatcccacagcgccattcgacgccaatggttgcgcgtcggggtcagtcaccatcctccccgacggcgtgcccgtcgtcatgtactccggcatcgacgcccgccgccggcaggtccagaacgtcgcgttccccaagaaccctcgcgacccgctcctccgcgagtggaccaagcccgggtacaacccggtcatccctgtccccgccgacgtctcgccggacaatttccgggaccccaccaccgcctggctcggcagcgacggcctgtggcggttcgccatctccgccgtggccgacggcgtgggcgcgacgctcgtgtaccggagcgccgacttcctgcggtgggagcgcaacgcggcgccgctgcacgcctcgcgggacgcggtcatggccgagtgccccgacctgttccccgtcgccgagcacggcgaggacgggctcgacctcgacgcgtcggcgatcggcggcgccggcgccggcgtgaggcacgtcctcaaggtcagcatgccggacaccctcgaggactactacatggtcggacggtacgacgacgcggacgacacgttcaccgtgccgccggaggacctggaagcccacggcgatgactaccggcggtggcggcggatcgaccacggccacctgtacgcgtccaagacgttctacgacgcgggcaagaaacggcgcgtgctgtgggcgtgggtgaacgagtccgacagcgaggccgacgacgtcaccaagggctggtccggccttcaggtcagcgcgcccgtcacgatcaacatatacaatggcaacgcaatcgcaaccctgtgtgctcagtgctcactggctcgatcgtgcgatctgttttatgcagtcgtttccgcgggcggtgtggctggacgagggcgggaggcagctggtgcagtggccggtggaggagatcgagacgctgaggcggaaacgcggcgttctgctcggcggaaacgaggtggaggcgggcgggctgcgcgagatcggcggcatcgcgggctcgcaggcggacgtggaggtagcgttcgagatcgcgagcctcgcgggcgccgaccgcctcgagcccgaccatttgcgtgaccccgacgcgctgtgcggggagaatggcgcggcggtgcacggcggaatcggcccgttcgggctgctcgtcatggcatccggcgacctgcgcgagcgcaccgccgttttcttcagggtgttcaggctctcgcacgggtacacggtcctcatgtgcacggacctgacacggtaagtgtaaaaaaactgacatcttactcgggctgggctaggagaaatccccgtattttgggccaggccgcctgaaggctgaaacgtttagtcgagatctcatgtctgttcttgggccaattttctatttgtacaggtcaacttcaagagcaggggtgtacaagccatcccacggaggattcgtggacatagacatagagaaggacagggctatatcgcttcgaaccctggtgagttcacttcacattttgagcgctcacctgacaaacatttggcactgataacatgctcgacctaacgaattgggcagatcgatcattcgatcgtggagagttttggcggtggggggcggacgtgcatgacggctcgagtgtaccctgaacatgtagcaacggggagcagccacctgtacgtgttcaacaatgcgtcagatgcggtgaaggtgtccaagctggaggcatgggagctcgcgacggctagtgtcaatgctggagacgacgggctgatttcgtatggtggtcctgtatgtgctgctcaagtgcagtaatagctgctggcatatgctctatagtactccctctatttcgaaatgtttgacactattgactttttagcacatgtttgaccgttcgtcttattcaaaaacttttatgagatatataaaattatatgcctacataaaaatatatttaacaatgaatcaaatgataggaaaagaattaataattacttaaattttttgaataagacgaacgatcaaacatgtgataaaaagttaacagcgtcaaatattttgaaacggagggagtactctgtttactccagcatgcacgatggccattcattctgaacttctgataggaaatagccatcgattggacgcagtgtgtttctaccgggcgcggatgaggtggacgcgcgcgagcggcctgctgtgagtagtgacttcaattgggaacaggataacaaataggtgttgggttgccggctgcgtttgatcgataggcggaatcgcaaggatgtgttgtgtacttgtgttggagatggcgagcattgatcgtgcctcggcgacctgtcaatcctcaccgggacggcgagaccgggtgcaatgtatgggctcatcgatctaaatcgggtagtaaaggaacaagttcatctaaggtcctttaacttgacaacgaatccgattttcattctttaaccaaaaacgtttttgatacaacggtccttgaaataccaaaaccaatacaatataggtcctaactcctaaggtagtatagtcggtggttttgtacgacgtggcaatttgacttgggtcagcgccgctgagtcagtgtagggcccacgtatcaattaagttcaccgtcttccctctcttctcatttctctccaggcctccaccttggtagccaacgggagaggtggccggcgacgagcaaccatttcggtgggagaggctcgcggcggtcgtcgagagaggacggtggagaggtgcacggcgggtgcaggctcgacggctgagggcggcagccagcggggagaacggtggggctgacgaaggaggctcacggcggttggcgggtagaggctcacggcaaccccttcctctttccctcatcgccacggccgtgcgctgctgtcggacgtctttatctgtgtgtagatctggaggtgaggaggacaataacgacgcagcaacttcccatcctgatttggtgtagatcttggacccagtcatcgccgcccctcgtcccgtcctgaccttgggcagcggcggaccttgggatgggagttgctgcgtgtgggtaaggcactgtcgccagtgtcccgctggatccctgttggtggattccgccagccgaccgtcctcctcaccacccgccgtcggccgccagcctcctcaccgcccatcgcgggccttctcctcaccactgtaacgccccgattttcgttcgggattaaaaagcaattaataatgcatttcaagaaattatattaaaagttaaatcaatttaatcaagtgaaattatagaggaaattaaaatttcctttaaaaatcattggccgagaatattttgtaatattctttgtgccctaaaatactctctggatttttttcgcaaattttcggagctcaagaaataattttaaagtaacaaagatcatttaaccaattaaataaaaagaaaacaaatttaattctccttccttcccttttgggcttgacccaagccttcccctcctctcccgcaggccgcgcgcctcctctctctctcggccggcccgcgccttgcgaaagtctactttacgtcccccggtttccttcctctctctccatccggccgacaggtgggaccggcggtcccacctgtcagctcctcctcctacctctcgccggccaaccccaaccgccattgccgcccacgtcgccgcaaaatgcggcgccctcccgcacccgagctcgcatccaaccacgtggacacaaccccctccacgtcctccaccttttcccccactcaccccgcaagaaacggcgccggtttgacctccccacgagctccacttcacctccccacgtcaccggccgatcccgcctctcccggccacgatctccatccccgagccctatataaagcaccctcgtgctcccctcctctgttttcccctctctcccaagctcccccatgcccggaaccccctcctccccgtgagcccaagcgccgccgctcaccggcggactccagccggccgctgccgccgctaccgccgtccccgtgccgcgccgcttgcatcgccggcctcgccgcgctttgccgcatcccgtccaccgctccgcttccgcaataaaccacccgggcaccgattccaccgtgaacccgagctccaccgccactttgccgactccggcagcgcgccaccgccgccctagccaccaccaagccacgccactgccaccgtcggcttcgccgcatcacgtagcaccccggcctctgcttcgttttcccgttccaccgcagcaacaccatctccaccgcgaagccgaggacgtcgccgcgtttgccgtcttcggccgcctcttaccgctgttccttgccacctcgcgccacaccaccgcctctactgcgttcgccgcgctcccccgtaccccggccgctccttcaccttcgttggagaccgccgaatcgccgccgtcgtcttcgccccgtggagcgccgccgcctccctccgcggccgctccctccgtcgccgcgcctctcggtgagccgcctccctcctccttttcctcttcgccggccgcctcccgtgccagcgccgcgttgcgccaccgccgccgccggttgtctggccgtctgcgcgccgcccggccatccccagccgtccgatctgccttggccgatctgggccgtccaacccgtggaccggcggtggaccgtccttgtggtcccggtccacggtggaccgccacctcgtctcgctgacatgtgggccccgcctgtcggcgccggccccctctcttgctgacgttagcggcagtccttttcctttgtgaaaatatttaataattgcgcaataaatcattaataattatagaaattcatttagtggctcaaaacttctaaaattcatatctaattcattcgaactccaaattgggccatttaaattgcaaaattcatctaaaattgagttctacatgtttgtttactttttaggtactgtgtccttcgtttttattaggtttttcctcgttttgcgtgctagcgtgtagaatccgtcgttttggaagatcgcggtcgcgaggaaaagagttcagaaaatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctggtcgcacccatggcagttaaggactggttcgcgggatgccctggaagaacttatcgtacttaccacaagccagcgtgggcaacggctgggcttgtagtgtagctttcctctagtcaatgcatccaggcaagggtgggcgtgatggagcggggcgggccctgcgacggcctctgtcgcttccggattcacctaggcacgagaggggactgcccgttgcccgctggggacgggggtgtaacctaaggtgtggtgtgcttggctagagggggttatgcgaagggtcctgtcacggcctctttccggtatgtcgtggtggcatgtcggcgcacggaaacgtgtcgtggggatgtgtcttgtgggtacagttgtacacctctgatcagagtaaagctattcgaatagccgtgcccgcggttatgggcggtcgaccagattcaccgtgattagtcccatcttaataaatcgacccaatacactgtagttcaggtgggttggttggacctgttcaacgtggtgtagcgttgataagtggagatttaatgttactttaattactcaacagttttactgttttgctcaataaaatgttttacaactgcctttatgcaaatagccacaaaccatccttgtatccccttgcacatctgcattgttggtgtggcttgctgagtacggtggttgtactcagtcttgctattattcccccttttcaaaagtgtagtgcttctgagctgaagatggagttagaggaccaaggctcagaccccagttgagttttgcctgtggagtggagctgaagcctcactaggatcgcctttttccgctgctgtcgttctgtttcggtgtgaggactaagtgcctgttctgtaagtattttacgctttatttacgtttggaactgtatattacttgtcattttgtgtaccctggctggtcctggacagggatttaatacgcaaaatagtctggaaatttgggttaaatttctgggcgtgacaaccactctcccccttttctgcatcttccccatcgaagtaacggcggtggcttagggatggcgtggcgagcaccttctcgagctctacactaaccagcctcgtcgagctcccatgccgaagaagcattctcatatggagagctggttgctggagaggctctccaaggccgagtgcgaaatctcactgatggactagactgagaaggaagccaagaagatccaacaagaatacttcacagatgctatctctttcatgctccaaccacgatatgatcacctccgcctatcatgaaccccccaccgccagatgtcccaaccaccattggcgccgcagtcagcctcctccggctcctccaacaacgggactgtggtggccgttgagatgggaacaagggggaggaagggagataggtgacgaggccttgatatgtgggacccacactaactcaacactgttgatctgtgtcaaactgtcacgtcaaacaaaactaccaactatactgctttggggacaaaactaccatctatactgccttggatggtcaaagattaaaatatttgactcaagacaaacttagaacgatgagtaatttgaaacagaaaaggtagttctactctgtaaaaaaaaacaatcctagagcatctccaagagatgtcttgtattgggagtatcccaaaagatatcgggctaaaaaatcaccctcatctccaagagtatcccaatacgtgagtccaaaaaaaactttaaaatcttccatgtcatcactggtgggtcctcctaaattgatttttctttaattgggagtgcgtagagtacccaaaactagctcctatttggttggattttggatgtgcctaaatattggaacctcctttgggaacccgttgaagggttggttttacccttaattcccaaaatttaacttttaggaaacggattaggcctcccttatagatgttggtttttttattgggcggaagggtaccttgctatccagacttgcctacatcacatatgtatatgttgacaaaatattgataatgcttctataacttaattagattttggtgttaagaacattttgacaaactaacacaaacattttcttcaaccgtcacggcctatgggcttcaccaaccaacagcttgagacatgcaacctatccttggcctacatcaaatgatattttccaaataaaaacaggaggatctacccgaggcgctgcagattgacaggtgtttgcagatttttcgtgttgtagtttctctataaacgtccaggaagaattatggcgatcagcggcggagcttgaaacaaattcaagaaggggccaacttccatggaattctatggaatgaaacactaatactccctccgtttcaaaatgtttgacaccgttgactttttagtacgtgtttaaccattcgttttattcaaaaaatttaagtaattatttattcttttcatatcatttcattcattgttaaatatactttcatgtatacatatggttttacatatttcacaattttttttaataagacgaacggtcaaacacgtgctaaaaagtcaacggtgtcaaacattttgaaacggagggagtattaattaattgaactacaagttctaaataaaggggaaaatataaaacaaaagtttttattataagagctataggaaattttgagaacagaagtgaaaaaaagtataaaacaaaggaatattttcaaaaggaggaaaaaatgggctctgtgtgatccgaacccaaacctgtagagtgaaaggttcacatgatgctaaccaactcaccaaagaaattcataatttcaaaggtgttttgctaacttatatatatgtctatgtgtgttgcattgtcagccaaccctgaaggggccaacaaccaggttggcctcccctaagctccgccactaaatccaataatttgattgatatgcctggtacagtgtcgttattacaacttgtacagtgtcgtgtattcgagtttttatgtttttgctacaaatatggataacgttagcactaaattttaaggatttgtggagtaaggtcaacatgtggctccatcagtactggttggtatagacgtttattttcttgtgttcattataggttgttttcaaaaggcgaaaaaggggcacccaaatctcagtattaaatattttctaacaattgtcaaaactggtggattcatactgctgaatatagagattttagctcctgttagtcttaaacattttcttcccacaaggataaatatcaacatttttgaaatttataatattaaattgacacataacatgtgtttattcacattggaaaaatataatatgataattttgtatattctttattatattagaatataaaagttagtggtaatattaaagttatatttcgagtagccaagtggtgtcgaaaacgacacctagagataggtcgaatgtctcttatccgcacaattgttcatactattaatacattaatacagtatacaccacctatatataatatattttatccatcagcttactggtggtctaacatgtaacgtgtagcactgtttttcctctgttgatgcagttcaccaacttccaagttccaaatcactggcgaatcgaggaagaggataaaaagggagtaaattgcattggtgatacatacacttgttagccgcgtgcaatttaatacatagacttgtaaaatgctcgttttagtacacaaacttttctagtttgggcgaacgagaaccaaaataacttggcaatgttaattttatgaagctgatgttgattaggatataacgtgcatacgtgcagtgagtatgtataagatatgcaatatttataaatttgatatctactttatctttcatcatggaaatgatgaatttcatatatttgtagcacttatatcattgctcagttttttctttatctttttctactatcactatatttgattcttttttttattgaagaggtgtatgtctcatagcaaccttttcagatatatatttacatagtatcctaattagcccctaatcaatcagactagccatgtagtatccttttcaccttcctccgcacgcaccagataagtcgttcatgtactaaaatgaacattttacaagtttgtgcactagattacacccacctgacaagttcgcgtaccggtgatacaatttactcgtaaaaagggctccaacttgcattgctagctgacttcttgttgtgcatactccatgtctagaaatattgctgcaatctactagctgcaattattattcctataaaaaatcaaagtgggtccacaccaatttgagccgatagatcgatttgatctcgatggttcgtgttcatcctcacatggtatttggtatactggactactctgtcttaaacaaatgaaacagaatttagttacgaacctggatacttatatgtctagcttcatagattggattaagaacttttttttagaacgaagggataggcatttgcaattctaaaatgtcacattacccttccaaagttcaaaagctgactttctaccagacgatgttgaacgaaatgacaccaattaccgtacgtgttcaaactgttttttttatatatatttcgattgaattcttgagtgttgcagtgacatgcgtgacgacaactcacctacctccgtacgtatattcatcgagctctctatatatgcctaatgcctctattatcagaagaaggggtgagccgcaaattataatcagcttgttgctaggtaatgccgtgccttacaagcatgcaagctgccaccattgtcattatttatctgggtagttctttcttcctccaaaaatataaggtgctcttagtttaaaaaaaattaacgttcatagcttttaactactattttagataatgtaagattttaactactactccttcatcccaaagtatcgaggattctatatgtagcactaagtcaaactatcctaaacaatactaatatttacaatcaaatgaacatcattagatctatcatgaaatatattttcataattacttctttaatgtggtatatattaatagggaaaattgtatatagtttgactttggacacctttatattttgggatgtcataggctggggatagatcatgcaggtttttttttttttaagaaaaggccagctgcccagcttttacagaaagccagataatgcagtagttaatcaacgacatggatcccatgtgatttatgggtattcacttgaattaattgcccaagaattttggtagaagaaatcatatatatactacctccatcccaggtgaaaaatggttgtgattggttgacataaaaaaatatacgatgaaaccaaatgagagatagttgaaatgaaaaaaagcaagtaattaattaaaaagtagttatattacgagaaaaatttaaatgttagaagtagctataatatgagacgggtagttctatgtctagtgtgcatgcatgtaataatataggtttacttaaaagccgagtgatcgcttgaagattaggagcgccacatcagcgatttttgcaaaaaaataccctgtgtttttgttaattacataccggttccctccaacatcgtccgttcgatctcacggtagagtccatctaaccgtccacgtgtctaacttggcggccctttttcagccgtgggatcgtcgaatcgcgaatgaacggcatagatttcgttcagccggaccaaatcctagttaggatgaaagatcaacgtatgcaacccaaagagataaaagaagccctttgtaaagtcacataagatcaaagctaatatagtaacgataaccagtggctccacgtcagcatgtttgccgcttattggctgcatgtgtacgtatttctgcgtgctatctactgacatcgtttaattttctattctcgattttttgattctatgattgattggtcgataggaagacatataacagcgttcacaactgggagaagctatctcctaatatcttctctttttttttcccattcccagttttggaccatctacgattggttggtaggagttcacacctaggagaaccggagaaggaaggctcagtgctgtctgccttgagagttgagagtatacaaatatctgatgtaataattactatagctcactgacgtaggtttattgtacctattctaattaaggcagctttcacctcattaagaccggtatctgttgagacttgagagtctagagtgagggtaatgctccacaattaataaattcccgtattatttaattcattcaaagtacacgtacgagaaaaccctagtccttgtactacaaaatgcgtgaacttttcttgtgatttacatagcggcaaaatcctgcagccgccatcaacagcacattagttggatcgatttttctctcttagaagacgaaaattctaacgctgcgattacagtatggagttatggacgttgacagtacaattgtacaaattgtggttgtggggatcagatctttcgtgtacccacatgcctagctatctcgtatgcacatccgtcccggccctctctcctctatataaagcattcgctacgactagctcattgtgccacaccacccaacacacatctgctaccatttttatcggaattactacgtacgcacgcacccgcctcagtagttcaagaacacatatacacacttcaaaaatcttgctagcttaaattactttgcattttaaccatacggatagattgatctaccgatcggctatgaagatcacggtgcattcatccaaggccgtgaagccggtgtacggcgacgccgtggccgctccgagcaccgccgacgttgtgccgctcagtgtgttcgacagggcgaactttgacacgtacgtctccgtcatatacgccttccgcccgccggctccggccaactccgtcctcgaggcgggcctcgccaaggcgctggccgagtaccgcgagtgggcgggccgcctcggcgtggatggcgacggcgaccgcgccatcctgctcaacgacgcgggcgcgcggttcgtcgaggcgacggccgacgtgacgctggacagcgtcgtgccgctggagccgacgcctcgggtgacgagcctccacccgagcgccgacgacgacggcgccgaggcggaggtgatgatggtccaggtcacgcggttcgcgtgcgggtccctcgccgtgggcttcaccgcgcaccacatggtgtccgacggccgcgccaccagcaacttcttcctcgcgtggagccaggccacccgcggcgtcgccatccaccccgtcccggtgcacgaccgcgcctccttcttcacgccgcgcgacccgccacgggtggactacgagcaccgcggcgtggagtttaagacttgcgaaaagctcgacagaaacgagaacaacgacgacggccatggacacggccacgacggcgaggtggtggtgacacacaaggtgcacttcagtagggagttcatctccaagctcaaggcgctcgcgtcggccggtggcggccagcgttcgtacagcaccctgcagtgcgtggtggcgcacctgtggcgctgcataacgatggctcgcgggctcgaggggagcgtggccacgagcgtgtccatcgccgtggacgggcgcgcgcggatgagcccgccggtgctggatggctacacgggcaacgtcgtgctctgggcacggccgaccgccaccgcgcgggagctcgtgaccatgccgctgcagcacgcgatgggtctcatcaaccgggcggtggcacggatcaacgacggctacttcaagtcgttcgtcgacttcgccaactccggcgcggtggaggaggagcggctggtggcgtcggccgacgcggcggagatggtgctgagcccgaacatcgaggtggacagctggctgcggatcccgttctacgagcttgacttcggcagcggccagccattcctgttcacgcctagctacctgccggtggagggtcttctcatcctcctgccatctttctccggcgacggcagcgtcgacgcctacgtgccactcttcagccacgacatggacaccttcaagaactgctgctatgtactccctgaactcagctaattctgctggcggtcttggtcgttgactgcacgaagtgtcccatcttttttattgtgtctttcaaaacgtctattcatttctctaggggatgtcatcttgtttttccatgtcgcttaaaaaatcataaaagtttttaaaaaataagtaagaactaaaaaaattataagccgtaaaatccagcgtgggtttagaaagttttgatccctttgttatatggaaatagcttttcttcatatttgcggtgggtacattaggtatattagcgagtccatttcatcttagtgtctatccacctaaacgtccatgagattgttcgcttctgttggctgttgcagcggtagcggctgtggccattgaaaatggctgccagcggcagtagcttttggagctcccgcaactgcagtgggtgcgacaacaatcactaccgatcagcctctatataaaggattatgtatgggcaatattaaaactgtactttcaagtagtacattgttgtatttttcacagctttcgcagttaccggaactatatgtatgagtcaacaactactacaattgaattgtttgggcctactgccgtactcgttatcagtgggaaatcaatatgtggtatatcgttgtagaaacatgcaatgtttaaatttaacttatgcaagtagaaacaaatatactccatccgtcccaaaatataagcatttttagactctggcccagtcttcaagatgctacatagactaacaatatctataaaagtaggatgtttcaaataataaaagtcgtatattatgatagtttgtttattgataaatatagtaagatcagttttacatcattgacctttttttattttattgctatgaatagtcaaagttaaaaatctttgacttgacattattctaaaaatgtttatattttgggacgcagggagtaacaaattttgactttatataaaacttgtaattcgcagttaaatttattatttctgtttctgaagtataaatcgaatttaaacttctatgtttatgaaatgctatatcacatattgatctatattctttatttttttttcaaattcaaatttttcgatggttttttaaacgacatgtagttttgttcggtagatcccaaggggaagggattggaggggaacagagaggaatgaatagttcccctccaagtctccctcaatttgtttgtgggagggattaaccaaataagttctcaagagaaaaaaaaaccatctgatagtatcacagtagtgttcgatctaggtggctatctactcgtttgtaccaatccctgtcgtgataagtctattaagaggattgagtttgttattggccagaagggccttgagagtcattaaaatggagaagtttggataaaagaatgagttcacaatagagaattgtttggccgcggcacgttcacctcggcttatcaggaaacgagtacgccaaagtagcatgagcacacgtactggcgtacagcatatccaagagcagacatctcagccccagcccccaagtcccagcccaacaagcaagactgcaagataaaggtcaaaggctaacattatacacagctttagacccgaaaaactgttttaaacccgaaaaacgtacacccgttttttgcatgtcatctaaatagttatgaatttttttttaaaaaattaacatgataggttaatttttaatatatcacttcacaagcatgcaagttcaaattcgacttctataaattgtaacaaaaataacaaatttgactgtaaatatctgtatactagttagagtttaatttgttgtttttgttacaacttgtataagtcgaatttgaatttgcatgtttgtgaaataatatattacatattaacctatcttgtaattttttttataattatttaggtggtatgtaagaaacgggtgcacgtccacccgagatattagaatccatcctcctttagacccacaaggccacaacggcgcaattttttactttggttttcctttccttcagataaaatgaaccgcttgaaagctaccgatcgatcgtagtagtactacaatatttcaagtttttttttacagataactttatttattcaattcaactttcatcggcagaacatctcgcgtaattaattcaattcataataattgaatcaacaacatcaaacaaatactaattagctaactagtctcaatcaagtgatctagcattaactgcatgtcttgtttttcaataatatagttcatgcaaggctagtagtttggtctttgtcgaatgagtagcagcagttcttgaagacgtccatgtcgcggctgaagagtggcacgtacgcgtcaacgctcccgtcgccgaagaaagacggcagcaggatgagcaaaccttccaccggcaggtagctgggcatgaagaagaatggccgcccgccgccgaagtcgaggtcgtagaacgggatccgcagccagctgtccacctcgatgttcgggctcagcaccatctccgccgcgtcggccgacgccaccagccgctcctcctccaccgcaccggagttggcgaagtcgatgaacgacttgaagtagccgtcgttgatccggatcacctcccggttgatgagctccacggcgtgcttcagcggcctggtcaccagctcaccggccgtcgcggttggccgcgcccagagcacgacattgcccgtgtagccgtccggcaccggcgggctcatccgcgcgcgcccgtcgacggcgatgcacacgctggtggactcgcgcccgtcgagcccgcgtgccttcgtcatgcatcgccacaggtgcgccaccacgcactgcagcgtgctgtacggccggtgcgcgccagccgacgcctgcgacttgagcttcgagatgaattcccggctcaagtgcaccttgtttatcaccacctcgtcgtcgtcgccgccgccgccggacgcatggacatcctcgtcgtcgtcgtacggcttgaactccacgccacggtgctcgaactcgaccttgggagtgtcgcgcggcgcgaagaaggagacgcggtcgtgcacggggacagggtggaaggcggcgccgcgggtggcctggctccacgcgaggaagaagttgttggtggcgcggccgtctgccacgatgtgctgcgtggtgaagcccacgacgagggagccgcacgcgaaccgcgtgacctggatgagcatcagctccaccgcgtcgtcgccgctcgggtgcaggctcagcacctccgccgtcggcttcagcggcatcacgctgtccagcgtcacgtcggccgtcgcctcgacgaaccgcgcgcccccgtcgttgagcaggatggcgcggttgccgtcgccgtccacgccgaggcgccctgcccactcgcggtactcgatcagcgccttggcgagccccgcctcgagggcggcgttggccggagccggtgggcggtaggcgtatatcaccgagatgtacgtgtcaaagttcgccttgtcgaacactttgagcgggacgacgtcgccggtggtggtggggaactcgccggggccgtatgccggcttgacggccttggatgagtgcacggtgatcttcatgtgcagaatcaaatgtgctggtgaagtggtgagtatatacgttcttggactgcttaattaggccgacgtggtacgtgtccggcgaagtgtacaatcgtgtgtgcatttcctggatggtgttcagcctcatatatatatagcggtgttcaggaaattagggcactgttgctggagcctggaagcttaatgcacgtgtaaatcttcgcaagaggtcggtgaactttgcgaggctgaagctgaacagcaatacagcataattagtggcctagttaaaaaaagtactccgtactagttttggatatgcatgtgatttttctttgttgaccgttggagccttcttacaattttttaagcgatcgcaaaagaaaaatgtgttaattatatgcgcatgtgttcttacttggttggtgttctcggttcatcaaacctatacctacgtgatcttgctaataaagaagtattgataaatgataacaaggaataatttcttgtttaaaatgggttatatactatcacaaataccgtgacttcgttagaaggtagaagaatgtcactgactgagaaactactacaataaaataaaagacggagaaataaaaggagactaaggccttgtttggattttagtccctgtcatatcagacgtttggacactaattagaagtattaaatatagactaatgataaaaactcatttcataaccctagactaatttacgagacgaatctattgagcctaattaattcataattagcctatatgttgctacagtaaacatgtgctaattatagattaattaggcttttaaaaatttgtctcgcgaattagatctcatttatgcaattagttttattattaatttgtgtttaatacttctaattagtgtctaaacatctgatgtgacgtaaactaaaatttagtccctaatctaaacaccacttaaagataaaagatggagggaagaaatgaaataaatatcagacgttaaggcaatagtaaaggttcaccatatttcctttatagacataaaaagttattcaatccgtccctaatataagggattttggagaaatgtgacatttcatagtattagaaaatatcacatccctttaaaatcttttatattttgggacaaagggagtaagatgttagtcggaatatcatgcgtatacttttgaccaagttgagccagagctcaagattatactttcaatattgtttttttgacaataaattgtggaagtatattttctattatgcatatgagaaaattgtgtaatgacgttagtcgtgtaatctgcatgggtcactacactacttatatatacaacaaaatattagtgaagttattggaattagcatttttccgtgcaaaatcacagagctaaaaggtaaaattagatatgatatacaactgttagcttctaattttcataaatctagttgtactcactctgtatctaaaagattatagtgttcaaaattagatacagtcctaattagatatgaaaaatccactagttatacaattgctaagagcctatttgagggagcttctgacaactccatcatatcttagaatcaaaaactccctcaaatagtgtagttttttttatttagattataagaagttatagttagagaatctataaaataaactaaaaattcagattcaccagattctcagaagctgactaacagccaaatatttctcatgatcttaagtttcttcagaagggccatatatagtctccatggaataggtggtgattttaaaacagtgacggcgaatttgaagtaaactttcaaatatcattatccataggcctttaacaaagacagctaagcgagacgtggaaaattgaccggccggtctaagcatgggcgagcatatgagacagtaaatgtctaaattattgtgctaatagtgaattttcgctacgtctccaagtagatttgataagaacttctagcttttgtttttacagatacagttttatattgcatatgattgattccggaagtactgatatagtttggacccactacgatctaatggtgcaattttcttttatgtatcttaaattaatgtggtggtttttagtccgcacaagagtgaagatgaggacatctctcaataataatataactagtggatttttatgtgtagtttcgcatggggctacgctttcaatggttaactggattgatatacaactcttatacaatcattgatatacaaatcttatcgactttcaatggtgtgacatgctacgtcagtgatacgtagaatcctaaaggtgtcatgacaattttggacgggaatgacactataacaagtttggggatttaaaaatgttttttaagagtttagaaaccttattaataataactagctgggtggcccgcgcaattgcacggctagcacccatataaaattatatatttttaatatgattttacttaaaatttattaaatagttatttcgatgtcttaagattttgaaaaaccaaaccttatcatcctcgtatttctaattttatagtttttaaaagtcacaccagttactatcccttacttctatcatattattctttattagcttgcttgatctaccactgtttctatttattctccttggaacctttaaaaattggatctaaactatagagtttatcgtcctgttaggcttcatttttataatttctataagtcccatcaaacgttaccattatactcctctacaaccgtccactacataccttataattcttgtgtttctaatgctatagtttttaaaagtcacaccagttgctaccccttacttctgtcatattattctttattagcttactcgatctaccaatgtttctatttattctccttggagcttttaaaaattggatctaaaaactataaagtttattgtcatgttaggcttcttttttataatttctacaagtcccgtcaaaagctgccattatactcctctacaaccgtccactgcatcttctttttattgtcgttactatttttaaaatcgaacataattatcgtttaggttcatttttttactttctagaagttccgtcaaaacgtcagcgactttgtcactgtactcctatacggctcacccgctgccactcttatttaatgtcattgagatttaaaaatcaaacatgattattattgaggttttttatttttacattttgaagcccgaacctttaaaaatttaaccttatagtttttagagtttattgtctcgttgggtttcatgttttttttataatttttagaaatcccgtcaaacgctaccaccatactcctctacaacccgtccgccgcatactctttattgtaattgggattgtaaaaatctaacattactatcgttggaattcattttttttactttctaaaagacccaccaaccatcggcgggtctgccattgtactcctatacgaccctctcgccgcctctcatttttattgtaattaagattttaaaaatcaaatatgattatcattggggtttatttttttttactttcttgaagtcatcgccaaccgccttgaaccgattgcttcacgacctgcccgtcgtctttccttttaatcatcattacgattctatttggtgttttattaatagttttagatgtctcatcaaccgccaccactctgctcctctagaggcctgttacttaaataatcttgtcatttgttttagatggtcttttcttttaatagtttttttatcactaattttagttatttataaattgtattcctagttgaaatcttatttttatttttctaattttagaatttattttattttttgaattgtgttcttttgatatttttattttttattttcaatttcagttgtttcaaaactatattcctactttaactctatttttaatttgcctaattttggattttatattattttttattccgaattttaattaatctactattgggttcttatatgtagtcatgaaataatgcttatatttaaattccgaatttaagttgatgttaaattatattcctacttgaactcttattttcttttcttttttttaatttcaattttttattccgaattttaattaatcttgtattggattcttgtacggactcttctttcaatattccttatttttaattccgaatttcaattatttttaaattgtatttctactcgaactcttattttttactctttctattttcaaaatttattttatttttattccgaatttcaattaatcatgtattaggttcctatctggactgctctttcaatattgcatatttttaattccgaatttcagttatttttatattgtatttctacttggactcttcttttctttttctccgtattaattaaggaggcagtattgttctaatttttacatagacatgaattcgtttttaaggaacgcaagctgtggatcaatacattaattttaatatgagaaaaagttcaaatacttcatatagacaaaacgaatttaaatatcccggttagaaataaacttttccttttcagattggttagtttcacatatatgtacaggccgtttatttagtcgtattgatctcgaactctttttttactctgattcctaagtacgtttctcctttttactccgatttttactccgattcctatttctagtatgtttctttaagcttccgtggaaagatttccattagctgtacaactctgatatatttatctattagatctgaggcgctaaaatctagatatactatgatctaacggttaatatttttctacttttctccgattaatgtgggaatttttagcctccacagcgaacgtggtgccttcttttaaggctgttttaataatataatagatatgaccgcccatatactttatattttttagactaccatcttataggcagaatttacgtattcaacatatctaaaaagtacaattgtatgttatatataatactagcttctatttctaattatcagtatacaattatactttgtatatatacaactattatcaatcaatctccactgtcacaatctgacccatcatgatctaaccatgtaaatctttctctctttttctctggttaatatgaaatttctacacctcagtaccatgttttcaagcttaataatagataatagacaaggaatggatcgataaaaaaaatattgcaggaatttttgacgcaattatccattttatgcatgtccatgttcttagttactactcaattcgtttcatattatgatttgctttgattttttgagtcaaattttaagaagtttgatcaaatttataaaaaaacattttcaataaaattattggaatatatttaatgttagatttagtgaaactaatttagtgctataaatattactatatgtttctataaacttggtcaaactaaaaaaatcaaagtttcttatcatgtggattggagggagtttgagttttgtttttaaaccaaattcttagttactattttttttttcgaggacatatatgtttggacaaggtagtgaagtgtgtacttttcttatagtcaaatcgctctacaccaaccattccttagtcaaacttcttgcttccttgtaagaagtcaaatttctagcttggttttgccattcatacattgttgggttccatgtagtcgggcagttcagaattgctcacaagaattacgttcagaagtaagggcaaatcaacctacgtaaacggaaacagattaccgtggtaggtgcattgatccattgtccatagcaatatatagcatagtcaaagcataacagatcatcagcagaaggaggaaactgagttttcagtttctttctctaggcttcagtttgcatgattggtcaattgagacattcagtagtgctaagccgtggtagttgagtcttccaaaataattacaggtgagagcgactaacaggtgatgaagattgcgcgcggcgcgtagaatgtgttgcctgcacggtttcgtgctgcgcctgcgcgtgatgatttggtgaagtcttcaacaaagtttggtgagtcgcaactgccacggatattccagatcagcggggttgttggcctgagtaagcagacaaggcgacgtgacgaactcacgctacagttaacatgctgacgagcgaaaaatcgccggttgaatgtttggacttgtgatttcggttaacatgtccggatttggacgtttgaacttaaacagttgaacagatagacatgctcgtcgatatgatccgtgatttatattctgtaggtctccctgatagtaacatgtgagagaaaacgatgaggctgctagtgggatttgactaagacaataatacttgaacaagagatactatactgtactacgtacacaagtaacacaagtgctccatcgaatttcgaagggtgactgtgcaatatgcctgcaaggcccacatggcccaacttggatcaagccgccaaacaggcccaacaattgaggcccagtaaatcactaatctattatttgttcctcaatgccttttgccatgcgcagtcacagtgtcactcttccgttataaaactactagtaaagccatgtgagttcaaacaatgagttcataataataattgtttcttgatgtctagattatgcattatattttataataggagtaatagtataacgctattctaacttggaccaagttcgaatcagctattcagttgagctactttcttgtttccagtagagatattttcaaaaagataaatggtgtgtttttgtgcggaccttgtgtataagactttcctaaaatgttcagataaattaatttttaagtttgtaatacgttactagttaatagtattattagatcaattctcgtcctgtaaaaaacaacccaatactagatgtgaagacacattctagtacaaatgtgttatacacagtagtagtgcggctagtgccacaaggtgaaagtggcgatcatagtgggaagtcagattctcgtgtgaagtcaggaatttcaaataagagcaggtacaatagcagtctatagacagctgcagcacggactctaaggcgtaacgtgtgtatgacatgtgggaccaggtattattagcgcagtatatttttatagataattattgtataaattgactattatattgattataaatgatttggagctagcaggtgactatactattaaacttgctctaagctttcagatactgagcctgttcgaaaacagaggtagtatacggtaca

SEQ ID NO: 80464 - DNA, 2636 bp, Oryza sativa
atcaccccttttccctcgtgtttgtcctgaatgctctggagtctgcagggcgagtgacagctcgtccctctctctgtccggtcggaacgtgccctgagaagaggcttccactgcgtctgttagtcgacgcgcagcctcgtgtatctgatcgccgaagaccagggagccatcagctgggttgagcgttccaccgtgagcatagtactagaacttcgatcgttccggccaattagcggtggccagttcgatacccctctcaagcaagctagcctccatctcctcccacttcagcatcgcgacgctatagccgcctgaccccaagtggtgatggtacttcttcttggcgacattttctttgtttctttccatcatcgcctgcccttgttcacctgtcttatatgcaacgaactcgtcccagtgatcccttagctttgggaatgtgtcgaagttcggtgtctgccccttcaggatatatttcttgtacagatctcccttgaagctctgaaactgttctgccattttcttcagagtccaccttttcactttgtcctctgtacccgcgggaagggtgaatgtctcgagcattgtggtccacagcatctctttctccgaatctgggataaagctctcatgatctccgtgtgcccttgttctgcgcccgtacaccgtactgacaggcacgttatcccgcacaaccgaaccgctgtgacgtacatagttcttggcggcttctgccgaggcactaggtcgtccgtcttcatccacttccgttatgatgtgccgaccctcaagcttcttcgcggcacctcgttgcccgcgtgccctcttctgtccaacgaagggctgacttccactagccttctcctcctggttcccctccacatccctttccacgtgcccctcctggttcccctccgcatccctctccacgttcccttcctcgtttaaatactggtttggattctcgttcccctcttcttcgttccagtactggctgcttccctccgcgattgtatcgtacaatatctattcctcatcgcgatcagccatctgttcatacaggaaacatctgctaagtcatgagacatttatgttttaacaatcttatatgctaacaatcatatgctaagtctaggtgacgtatattataggaccctagctagtcaataattatatactaagtctaattacaaatataataatcttatattaaaactcaaataatcttatactaaaactaaaatagttatgtatgctaagtgtaactatcgtatattagaaccctacacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatactaaaactaaaatagtcatgtatgctaagtgtaactgtcgtatattagaaccctacacaatcttatatgctaagtctaattacaaatctaataatcttatactaaaactcaaatagtgatatatgctaagtctaagtgtcgtatattaaatctaatagtcttattagcattacaaatataacaatcatatatataattatgtcacttgtctgcgcgaattccttcgagggctagctaccacttcggcttgagggacgactccgacaacgtcttttctgcaagatacaaaaagatgtattaggataaacgcgaagtaacatatattgcatttgacgttcacgtttcgttcacgatatcgttcacgttcgcgttctcgttaaggtcacgtttcattcacctacgtttgttcgttcacgttcattcacctgcctatattgcatttcacgttcacgttcgttcactattgttcacgatcgtgcacgttcacgttcgttagtttacgttcgttcacgttaacgttcgttgacgttcgttcacgctcgttagttcacgttcgtttgttctttcacgttcaattctcgttcacgttcgttcgctcgttcacgttcgttcgctcgttctcgttcacgttcgttcgctcgttctcgttctcgttcacgtttctttcgctcgttcacgttctcgttcatgttcgttcacggcggtggggcggcagcgggacggcggtgtggcggcagcggagcagcggcggggcggcccggcggcggcgaagcgcgcggcacgacgccggcgttgcgcggcggtggcgtggcggcgcggcgccggtgccgtgccgcggcggcgtcgtggcgtctcgtcgtgtcgtgccgccgtggcgtcgttgtggcgcgacgtcgtgtcgtgacgaggtcggcgtcggcgtctgcaacgaggcggccggcggcaaccgagagggagagagatagctgatgagagggaggcggcggcggcggagatggcggcgatgacgacgagcgcgagacgacagcgagatacggcggcggtgtcagcacggggatgccctaggcagtggcggcgaaggagaagccaagagagatcgatcgggcaaaaacttctaagtgttggtggagaagatgagggcgcgcatcgggaatatatatacccctagatcttt

SEQ ID NO: 80465 - DNA, 9523 bp, Oryza sativa
catcaaccgggactaaagatatttttccgctatttccaaattctttttaaacctggttagggttaagaactgggactactgataagcgcactgaatattattttccattacatatgtgtttctaaaatagaagataatgcattaaaattatttaaagtacaaagattaatgacaattacttcgaaaaattattgttgtgtgtaattaagtggataaaatgtaataagcaaatatatgatttaaaattaataaaaattctaataatcatatatacttagcatatgaatgatattaaattggtaaaaactctaattaacatatgtatatacagacggcatgatttaaaattaagaaaaattgtaatcatcatatatacttagcataggaattatatcaaattaattgttaaaaactctagttaacatatgtaaatgctacatgcatgatttaaaaattttaaaaattcgaatagtcatatataattagcatatgaatgatagtaaattaaattgtgaaaaactctaattaacatatgtaaatgccacatgcatgatttaaaacttttaaaaatttgaatagttatatataatttgcatatgaatgatagtaaattaaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcgcatataactagcatatacatgatttaaacttgttaaaacctctaataattgtgcgtaattaacatatgccatacatcaattgatttatatggataatcaatacatccaaaatagtttacatcggagtctttctcagagtcccaattgctagggttgtcattttgggtgccatcattgatactatcgttgacatcttggtgaatgatgttgacattgcacgcttgattcgagtggtcactattggggcaagaagcatggttgttggtggtaacatcatcatcattagtattgctaatgttgttgtctgcattgtgtccatcttcttggggcggaaactcttgatgcgcaacagaagatccggtgatctgaagtggctcagtgcgctgtccttggttaccacatggaaatactgggatgttgaccatccttctcttgcagttcgtcatccgattatgctcactttcaagttgcatggctttgtccacaagtttctcaaaatcttcataatcctctaggagtagttgcactgcaagctcatcttttaacccctggagaaacttctcttgtttgtcttcatccgcttccacatcttctggtgcatagtgagccaaacgatagaactcgtgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggcaatggcaaaggttggaggctcagttttgagaaattctgataacttgcactgttgctggactgtgggtacttgaacgttggttgcccctgctgggttgttccaattctgtaatagttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtagaggttgagaggggaagcatacaaggaaagaatcgaccagaactagggacaagaccttaaaggaactaactctttttgttgatgtgttgtttgttttgcttattctgcaggttgattaagcaaacaacctagcatggttacatcacaacccaccgatgcaaaccacgcgctacacacacaagcaaggaacacacgactaacaacactaccctatagggtggcttaggttctgcgatgggttcccaagatcttcactccttcacagctggcttcactgcttccttcacttcactagcggatcctgcagccttctggagcttcggcagacaattgacgacatcttcttcttcactgacctgaccatctagtactagttgaaatttgaagaaggaagaaaagggtaaaccttgtgcaaatagcattagggaaaggagaaaaagagaaactttcgcaaatagttttatttataaaatatgtccttaggttttatccacttggcttatcctacagtcgaaatggctctgataccagcttgtcgcgaccgagaaaattgtattttcccgaacgctagtgtattaatccccgtcccaggaaaagccggggtacaccatacaaacatgatataaaagacacatctttattatatcgataatatttactttattacaaaggcacttaaggcctgacaatcaaaaataaacagcagcggactagcgggcctacggctccatcttcacaggcgctcaactggggtataagccaagactccacctaagacttcttctccaaagcttctcttactgaagaggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctaaagctacacagtattattaatcaaggtcgtgaacccgcacgaacctgccttaacccaaggcctacgatgattcagaccgaactggcaacccgaccctgggtcccaactcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccataaacaagagtaccgacccaaccccacctacggccggaacccccgggacaggcaggcaggattgagccccctagcagcaggacaccaaccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgattagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtgcccactagttggggttttgtttattctagggtgaacaaggcaataataacaatagcaataataataaggtcataacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttacgaatttcttcatttaaattttaatttaaaaacggatttattgcgtcagccgaggggagggacgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgatggccgggtcccacatggcagccgcggggcgcgcccgaaggcggcctcgccggcacagccgacgggaggcgacgcgcccgcgccccgatggtcgccggcggcgacctccggcgcgacggagcggcgcccgagagaggggagggaagggggaaacgaaagggcggtccatggctcaccccgggtcgacggcgacgacgggaacggcgaccgaagcggagagaggcggcgctgcggctcgggtcgacgaggacggcggcgttccggcggtcggcgggcgaaacgaaagagtggacgagatcggcgaggacgcggcgaagccgaaggtggcgatgccgaagcgggaggaggtccgaggcaacgactgcggcggaccggagctcggcggtgacggcggagagaggggacgacggcgcgagctcgattccgacggggagagagagcggcgagaggcggaaacggaggagggaggcacggggaacgtttatatagcgttgggagggagagagggcggccggagtggaaggaaaccggcgcggcgatctcgggctccatcaaagacgccggcgaggtttgcgggaggattccaaacgaatccgagggagagagagagggaaaagtggggggaaagagggagggaatcacggggagtgatttccccctctttattgcgcgcggggacggcgggaggcggcgggattcgcggcggcggcggcgctagggcacgggcgaggcggcgggagcggcgggaggatagggatgataggtgggccccacccgtcagcgagggtggcgggcgggcccgcccgtcagcggcgcgcgcgcggggagaggccgagtgggccgcggggaggaggagagagagggaaagagatgggccgagccggcccaagagggggagggggggaaaagacttttagggatttttctttttataaaacctttttaactttgtttatttcttaataattattatttgtgctctgaaaattccactaaaatttgagggttccttttagaccaaggagaatttaacaaaaattctccggggcacatttgaatttttattgtacgtattttagtgtttgccaatttcttttcgaattttaattaattctattattccttttagagaatgatttttatttcgggatgaatttatcaggacgtgacattgttccatcgtgtcccatggcatcgacacgaacaacgctgttttggttcgtgctcgtcatgtcttgggctctcgtgtagaatgtgtacccattgatctcatatccctggaatgtcgcgatcgacccagacggtcccctcgccaggaaggcaagttgttggttgatggactcgttacccatgagatgttgtcgtagccacgcggggaaagtatcaatgtgatgccgtgtaatccatgcatcggacttaccgatgttcctggcacgaactagagccaagtgctcctcgatgtaaggagctaccaatgaagattgttgcagaaccgtgaaatgggctttacttatgttcgaagtgcttgcctttcttccgtaccgggtggtttgctgcaaggaatcgatgatgacccatgtatacaaccttcctacagtgcttaagatacgtaatttctgtttcatccatacagtgagtgcaagccttgtaccccttgttggactgtccggataggttgctcagtgcaggccaatcgttgatggttacgaacagcagcgctcgtaggttaaactcctcctgtttgtcctcgtcccacacggggacaccttccttctttcacaacagtttaagatcttcgaccagtggtcttaggtacacatcgatgtcgttaccgggttgcttggggtcttgaataataatcggcatcattatgtacttcctcttcatgcatagccaggggaggaggttgtagatacgtatcgtaacgggccaagtgctatggccgctgctcatctctccaaaaggattcatgccatccatactcaaaccaaaccgtatgtttcgtgcgtcctttccaaattctttaaattttctgtcgatgtttcgccactgcgaaccatcggcggggtgtctcagcatcccgtcctgttgacgctcttcagcatgccatcgcatcattctagcattccccttgttcctgaacaaacggcttagccgtggtattatagggaaataccacatcaccttagctggaattctcttcttttttagctgcccgtcaacttctcctggatcgtctcgtctaatcttgtatcgtagtgctttgcaaacagggcatgcttctaggttctcatactcctcaccacgatataggatacaatcattcggacatgcgtgaatcttctgaacttctagtcctagcgggcagactatcttcttagcctcgtacgttgtctcgggcaatttgtttccctctggaagaatgttcttgacgagtttcaataaatcgccaaatgccttgtcactaaccccattttttgccttccattgcaagaactccagagtggtatccaactttttgtgccactgctcgcaacctaggtataacgaagttctgtggtcctctaacatcttgtccaatttatgggcccccttttcactttcgcagtcctccttggcgtcctgcaacatctgaccaagatcatccgcaacgtcgttaccatcagcatccctttcctcctcgcctgtttgatttccttcaaatccaatgtactgagcaaagtccagaatattgtcgtcttccacttcatcttcttccatttcaacaccttgctctccgtgggatgtccaacaattatagcttggcatgaactccgactcaaacaagtggaaatgaatagtcctggatgcagaatactccttctaattcttacacttattgcatcgacaacaaataaaacccctttgcctgttagcttcggccactctcaaaaaatagtgcacgccgtcagtaaactctttggaccgccggtcagcgtacatccattgccgatccatctacatgagtcgaaaaaaaatcgtacacaaataattattcttacaataatgacagtcatacaataattataacataattacaaactctttcaacagtcatacaataatgacatatctttattcatacaaaaatcataaaatattacaccaaataattcttatttactatttctaaagttttaaactaattttaacgtgttttacttcttttaattttcattttagtatgttttctattatttaagattaactttcactatattttccttctcaactattttatgaaacgtactttagcaaatcaactaaatttctatatattctttctttctcacacaaattttctctctcatcaacttacaaataaattttggagacaaaaaagtgtgcaaaacatagctgcaaatgtaatatgacaaaaaaaacattggaggatgaagttggaaaccttttaggcacctccgatttgtatgtaatccccaaaataaatttactagaaattttggcatgacctcccctcttttttgaagaaatttagaagcttgctcgggcagctggaggaggaagaagacctatatataggggtgggattttagtcccggttggtgttaccaaccggtgctaaagatcctcgagatctttagtcccggttggtattaccaaccgggactaaagttatgatctttaatcccggttggtgttaccaaccgggactaaagatcccgggggggcctgataggccctggcagcatttgaaccgggactaaagatgatctttagtcccggttggtgttacgaaccgggactaaagatcaaatatacccgttaccctttttaaccgggactaaagatcatctttagccctagtttttattgcatccgggactattgtgaaattcggccgaccgacgaaagatggtttctcgaccagtgcatactcaacccgggtatccccagacatgtcctctggcgtcgggtcgtctccacccctgtccagcacctccttgaggttcatctcggggtgtgtgagttttaggcacatgagaacgtgacatgcaccggtccgaacaccagagcatgtttcatcggcaactcgctcggcgagcttggcgggaactccttcgagtttcccgattaaaaagccaagcaaggactccacggtggtctcatcggggaacgtggggcccgcttattggattctcaggttgcgtgccaccacgtcgagccatggctaatcgaatccaggtggccctgcatctccatcatcagcttctccatcccctggcgctgccccacgtggctggcaacgaggtccttgaatttctacaagtcctcctgagcctccgtgggcatgttctccagctgtgcaacactcccatccgaggacgaaacgattttctcagttcgtttgatctcggcgagcatgtcgcatgtgctggcttcgagcaggcgacgcgcctcccctactatattagcgccggggcgggacgtggcggtgagtggggtgaggcagaggagcgagcattgttggtgcagtggcgataacagtcgggtaggagctggtctccacgcgcccaacgctttgagcggaagcagtggaagaaacgctgccaaagacgaagtcggaaatgctaatgggtgggtgatcgctcccccaccagcctagcgatcacccgcctgccccctctctatactagatacactcctccctcctcccctactacagtacacaacacaaaaattttttaaaaaacaaaaagttagaaaaatttatgtatagaaatactatatataaaaaatttaaattcaaattcaaaattgaatcgggtatgtaaacattttgacttataaactttgggtctataaattttaggtgtataaactttagatgtatagaaatactatatatagaaaaaatttgaattcaaattcaaatttgaatcgggtatgtaatctttcgacttataaactttgggtctataaactttaggggtattaacttta

SEQ ID NO: 80466 - DNA, 4362 bp, Oryza sativa
  unsure (1)..(4362): unsure at all n locations
tatatagaaaatatttgaattcaaattcaaatttgaatcggatataattcaaaattcaaattgaaacaggttgaatcggatataattcaaatataaatttgaaacatgtatctaaactttagatgtgtaaacttgaggtgtataaactttaggtctataaactaactttaggtgtataaagtttagatgtatagaaatactatatataaaaaaatatttgaattcaaattcaaatttgaatcggatatatgaacttttgacttataaactttgggtctctaaactttagatgtgtaaacttgaggtgtataaatttactaaaataggaaagtaacacggtgccaaaaaagaaaaccaggtggagggaaggaggggggaggggggtanngaatntgatngctacccccattggcgggcgatcgatcacccattagggctgcccagacgaagtcagcgagtacgctagatgatgtgatttgatatatgagaatcaggggttagtttttgacttactcaggcttcagccgctttaaaagtctgtccctctttcgtgtagagggagcagccactactacgaaaatgcaatccgcccgtttgcaaaaacggtttttgtagtagtgagcaccgagggtggcctgcaagatgtataagtgagaatcctatacttatctcaagaataccaagcaaggatcggagattgagatttacctcggagcttctcgtttgtacgagcgtcccaacactaggcgaaggtttagatatccctacccatttccgtttggagattttcgtgccactgctgctccaagcggcagcgacatcagcctgcttggacaccgccttttccttaagagatgaggtggcttggtgatcgatgagaggaccgatggcatccgtcaacggtagatactatacaacttcagattactacgtctttggatattgttacaaaagcaaagaggggtagtttgaagtcaattacgttgatggcggcgtccttgttcgaggacaggaggtcacacaagtgggtcgggaacttgtcgtagcctgatggagaattgatcaccaggtgacctactcgtgtggccatagtgttgttatcgagctccgcaaatggaatagtaacattagcatttgagatcaaggcattacacaactcgaggtcaggagggttgtgagaacgactaccccgaaccgagatccatgtcttattttcagttcctaagtaatcgtacgcggggtgagcgcgagcttgtagtggctcgatctggcgacgtatgaagtccctagcaagttcataccccgacaactctcattctcggaggtcgtggattttttctatggaaacttggagtgagggttcaatgaaggtttggatgtccaagagggaggccgttcgggtttctcttctaggatggcaaggttggaggggcggtcctctacatggaggtagaaccatttagacctccataagctccttgaggaagggcagtcgaaggggatgtgctctgccttcatcccgtccaggagatggaaaaccacaacattcggagattctgtgggactctatccatctgagctcataaaaatgcctaaaacagatctaggaaggtgattgagttggggtttaggtggagcagatgtaggccatagaagttgaggatcaagagaaaaaattcggaaggagggggtagaaaaccgcatcgaacaaaatactcaagaactatgatttgacctaaagagggattaggttcaatacctccttccgtacgctccaagttctgtcaccctgttgacgaccaaatttggtaagatatgaaccaggttcgacattggaatcgaggcggattcggtaaagagatagattcgaagaacagagtttgcatcggctgtgaaggcatcggctggagtctgcatcggctgagatggatcggatagaggacagccgatacagccgatagaggtgatgcagccgattccgatgacgatggtttcaaggatgtttctagaatcgatcaaattgcttcacgaggattgccacgatggagataaagttctcggataggcaaatgtatctattaattaggatatttcatgtaattttcttagagatatgtttgggcaaaagtctgccgtaaaggcttatggtatcttagagtttattagagataagtgtcgtgtccggcaaggacatattttgtaatctcgggtataaatataacccgaacccatgtaatcaatcatcacacgatcaatacactttcggcgcatcgccaccctttttactttcgttctatttcggcgagttcttgctttcgggttgagctgcatcgatttgatcttcaactagaggtaaacttgtcatggcggcttgcgttatcgggattagtgcttccatatttatgacactctaatcctgtttatgtaattcgtcgagttatcatatacacgtcgcaatctttgttagtcgcattatataacttgttatcgactggttcttattgctagaaaacaatcgatagggttatgttctgttattaatctagattgtatcgtgtatctaccatctcttagagtttttcatcatcttgcctagatcttatacttgtctttatgcttaatgctgcatcggttgagatcgatctattaagtaatatctgtaattatgatatctggcatgttttatgattatcaagagagatagtatcggggttttagctgatcttacctgattgtgcttgattgatatgctaagtctgccctttatattaagatcctattgcaataaagtatattaagctacttgtttgatatattctacttgttctaatatcttaatatagagtggtatcggagtactagccgatacatgctagatctatctgatcggctatgctataagcgtttataatctttgtgttaatgtatacttcgatctaagtgatttatactgtctcagtatggcgaccgatctatcccaatcacttggtttaaatatacatcaacagaaggattacataacgttaatatctacagccgatcgagtagatttagtcttactttgcgtacttataattgccgatcgattcacatatgacatcggcttgaaaatacatgatatgtcatcggcgactggtcgatcggctatcgtttatggatttaaccgcggtttttcttgtttttctttcttgttgattgcaggatcaaatcaactggcacgctcacgaacctaaaagcaagattttggatctgcactgaagttaagcagatcttccaggcagtgtgcgtttttcgcatcaacacgcttttggcatgcctggtgggaccgacaagtaataacaatgtcagcagaaaagcaatcaccgccattaacaggcaagccgccagtgcctcctcaaaccaagctgccgaaacctccagggactaatctaccttcaattggggttgagtccaaggtcaatgagacaaacatcgtcccagtcactgtagacaagttatcaccagaacaaaagaaggagtatgaactgatgatgaagagcgctcaggagcagttcatgaaatcgtttgcagcaacccgacaaggaaaagttatccaaaagtacaaggtgaaggtggttgctgccgatgaagttggaacaagttcatcccaaggtggtaaaggtactgcagatggctcaggcgataaaggtgatgggcttcaagatggtgtggttgaagatcttggtgaagatggtactgaagtgcgggaggaacctcctaggtgcacaaatttccaagaccaagttgattatgccgtacaacgtgccttgatcaaccaatctggagtgcttgtcaatacactaacaaataagatcaaatttgtcattgatggcacgatagctgagtatgagaacatggggccagtctacctaccaggtggtgtcttcccaaactacaggaatttggtgataggaaatcagcagcatgcttccaatgcaccatcagtccagccgacggcaacagtttatgctccagcaccggttgcaccttcgtcagctcaaaggcaggtggttaatcctcgtctcttgtctagagaccagccgcaacatgttgggcagaacatcaatcggctgactcaggagcagactgctacaatgttcccaacaactcagccgattgtcgagccagtacagtcagcaccaattcagtagatgtcaccaagagaacagatggcttagccgattcagtagcagacggtgcagtagatatcacctggcctgagaacacctgataatcggcagaggcaacaaaatgtggcccaagttattcctgagcacctggtacatagtgtacaaccaaatcaatcggttgtagcccaagtta

SEQ ID NO: 80467 - DNA, 4559 bp, Oryza sativa
ggcacccttatcctgagtggtttgagagagttccactgccgaaccgatacaaagtgctagatttttcaaagttctcagggcaaaacaacatttcgacgtacgagcatgtcagccgattcttggctcaatgtggagaagcatcggctgtcgatgctttaagagttcggttgtttcctttgtctttgtccagatcagcattcacatggttttcttcattgccctgcaattctgttcaaggttgggtcgacttggagaaacaattccatagttacttctacagcgggacccatcagatgaagctctctaatttcacggcggttaggcagaggcatgatgaaactatgcaagattacatacagaggttcagagatatgaggaacaagtgttacagcttgtctttgacagattcccagttaaccgatctcgcattccagggtttgatagctccgatcaaggagaaattttcatcgcaggagtttgaaagtttgaccatgcatgagcaaaggtttgtggaggctaagaaaagtttcaagaagatcaatcacgtgtatccttatatgtgtgattttattttgtttgagattctgtaatgttttttcttttgtttgatctgtaaatcaaaaagaaactattgaactagaatgcaaaaatattctcaagaagaagccaaaagaaagagaggtgaaacagagtagagagaatcgggtgcttccagtgattagttgtcagaaagcattgttttccatatcagattctgcgcctatgggccactataactatccaagaagacactcgaaaaaggaaggataaacaaacctacccggtggactgccgagttctagaaaggaagagaggtatgacattgatattactaaagctgataaaatttttgacttgctacttcaggagaagcagatacaacttcttgctagccacataataccatcggctgaagagctagggaaaaggaagtattgcaagtggcataattctgattcctactccaccaatgattgtaaagtctttaggcagcagatccaaacggctattgaaggaggaaagatcaagtttgatgattctaaaaagccgatgaaggtggagagacttccttttctcgtcaacatggtgcacacagctggcagagcagctgatggaggaaagactcgaagttctcagttgaattcagccaagatcgtcaataaatatcagaaaaggcatgataagcaacaggagaagtactacgagcaagatgatggtggttttggtcctcattagggttgtgagttcttcaggttttgctagaatgaggggatgaggctgccatcaattgaagattgccctggctgcaatgacaacgcaggaagttcaagccgatcttatgatagaagcaatcggctgagtgataagagggttcctgttcattagaggttgggtccggtcaatcaagattgtcatcaagatgagaacgaggataggaagacgcaatggtgctcttctggtattttcacgaagaatcagaagaggagggttcaacggatgaggaacagggagcgtttccaggaggtagaacaagaaatcaatcattggctaaaaaagacaaaacccaggcatgagtggcgtgtcaagagtaaggttgcaacagccgatgaagttgaggccgacaaagcaaaaaggttggctagaggaaagaatgtcgcatctacatcggtgaacatggtgtttatgttacctgcagaatttgacgctagataagccaatgttgatgatgttgaagaggcctctgctagattggttttgtcgccagagcaagcaatttttgagaaaccagaggggacagagaatcggcatctcaagccattgtatgttaacgggtttgtcaatgggaagccgatgtctaagatgatggttgatggtggggctgctgtaaatttgatggcataggctacattcaggaagctgggcagaagttcagatgatcttatcaagacaaacatggttctcaaagattttggcggcaatccattggagaccaaatgtggagctgacagtcagtagcaagaccgttcctacaacattttttgtcatcgatgggaagggttcttatagcctattgcttggaagggattggattcacgctaattgatgtattcctttgaccatgcatcagtgcttgattcaatggcaaggtgacaagattgagatcgtgccagccgacaggtcaattaacgttgctagtgccgatttagctctttgggagatggacgggattgattgcctgtctggaaaagtttgggatggagatttttatcgacggtcgttatcgatcagtttcgactgtcaatattactaaaacaggagagaactagtgatgcttgcaatgcataaatatgttagaataataatattccactagtattaggtctactaaccttttgcagagaatgacaataaagtgaaggagaatcgacatcaactcagacgataaatcaatcggacgatgttgagaaccatacttatgtatgaatgggtgaagaacgcagacttgacacgatgaatcaggccaaaattcacaagtctacgaagtaaagcagcagaggaggccgccagccgaaatttggctgggttgggtcagccccaggttttggctggatggtggagatgaagccccaatgacggttggagggtattaccgaccattccaaccgtcacaaccgtcatagttcagctataaaaggatttcaccttctcacttcactcacacacctcaagcaagaggtctctcattcctctcaagtttagtttagtattatctagctggtggaatagaattagaataggaatcaggagtccggaagcctttggaagagttcgggtatggctatagtagctttcctttcctcttttgtaagctttgtacttttatccgaatactcttctaaatacatttctagtattgaaatactttccgagtatataagtaccaactttacattatgttcatgttatactgaatatacggctagctaatctgggagatgctttggtgcgggtatagtgtttgcttatgcaattactctatgtcatgacgatgatattagagtagtatttggtagtttaggcgtggtgtctagagtacgggatatcattatttggggttacatattgcggataagaggtgagccgctgatggtgacagctcactacgagtattcctccgcgcctatatataatcctaagttaatttcctggggagggtattcctccgtatttagccccggttggatggtcatgacgggctgtcgtaaggaactcggcagtcaggggtggtttctcgaagtaccaggagggcatcggatagagggtattagctagtatatcagttaactagaatgtatgtatactatgtgtattagaagtataggaatagattctctttctcttttctttccacctagcttagatgtcacaccgtaaaaatcccaaatttataaattgttgtttaaatggaattattagaaatgattttaaaagcctagaagaaaagatctaattttaagtaataaattcaaatataaaagtgggctagataaaattttatcaaatacttcacttgattagttcctagatttttctaggatttatttgagccaagaaagtaactataataaatggaattgcatttcatgaataatttaaaaggaaaaaggtttaaaaatccttcttttggttttgggccgagagttagcccaagtctctctttctctccggcctgctcgcgctcggcccaagccggcccatcaagccaatccgccctctctccctcttctctcccgctggcgggtggggcccacctgtcggggtcgtcttccatctcccgccgccagccgcgccctagccacgcacaagcctccgccggacgccatgggcctagctgccgccccctagcacctataaaaggatcctcaggacctcctctgttcgccgccaccttcaccctagcccgccgtcgcttgtagcgccgcctccacgtcagcccgtgcgccgtcgtcgccgccgcaagtccagccgtgcgccgccgccgctctggtcgtcgtcgtcgctcgggaaggtcgccgtcgggatcaccaagtcgtcgccgtcctcgtcccgtactccgtttccaccaaagatcgccggagcatcgccgttgtcgtcgacccgaacatcttcgctgcctcgccctcgccgccgtcgccgtcgtttgtcgtccgtcatcgtccgagccctcggtgagttcgccacttcaccctctacctataggtgttgttcgtttgcgccgccgcgccgtcgttcgccggcaagcaagtggtgccgagccgccgtcggcaatgacgtcatcgtcgacgtccgcgccacgtcagccgtagacccatggtaggtcggttagatctcggccgttcgttttgtttagattagatctcagccgttcgttccgtagaccgcttctgtccactcggtccaccatgaacccgagccccgctgacgcaataaatcctttttccgtttcaaaaataattctt

SEQ ID NO: 80468 - DNA, 10432 bp, Oryza sativa
  unsure (1)..(10432): unsure at all n locations
aatgattgtttgtgtactgttttggtgattttactcttttatgcttagattccgacgttctcggagagtccgattttgtaggagaagactttgaagaattccaaggccagcaaggcaagtcacacagatcccaaacaacccttggagcatgttaatcctgtttaaatctattgtttctattcaactattgcatttatttttgaatacatcgggtgggaatgaactatttcctttgttatagtcattttgttattgattaccaatactttgtcacctggttaataattgtgtcagggttatggttaccacatacctaatagtagttgactaaatctcagcaggacccactacataccatatcctatacggaagcaaccttcggatatatgaggagttccggataaggaaagacaaccagagttctacatgaaaacgagaaggactactcggattgtatccatattggtttccctagttctacttggacaaggggacaccaatgagtataaatacaagcccccttaggaggagaggggagaggagacgatcaacacgatcggcacccaccatggaggatcaacactcaacacaatcgacatagaagccacaacatggaagcctacatacgccaagacacgccgccggatatcgacttcagggataagcacgacttccgaatactgtcaagagagacgaaagcgctatctctgatcttgccaggcacggatgcgaggagaaaggctaccctattgtcgactatgagtcagaccgccatgtcgacaacagttagataggctaccctaaatattgtactggtgtgattatcatgaataagagcaataccggcttcggccaacaggatgtagggttattacctgacaatttaggggcccgaacctgtataaaaatccctgtctccatctcttttacctcagtctcgcatatatcctagcaccgacgatccccatactatgcaaataccagaattgcgacatcaaacgtcgacagtggcgcgctaggtagggggattttggtgcttcaggattttgacgagatgggttcaaaagatggattctccaacaacaagctactcgatgacttcggctgtggggagatccaacttgtccaagtacatcttccgactagatcaggaccatcatcgtcattgacaacttggtctatcgagatcatccaagcctcaagatacgcagcgtaccaaaagatgtcagatcatatgatgtcgaacgagtacacaataaggtaattggtagattggtttttcaaattgatctactaatttcgtagatacatccggcatgtatctacaaaggtacgcaatattttatctgcaatttatcgtacctattcagatcatacagcattgtcagatccatgatttattatgtttacctagagcatgttctttatacaataatatcggttgcgcgggtgtccccgatgttaaatcgactacgatctaacgctgggggcttgctctgtcttcttctgtataaatcatgcttgtttacggtttacataatgccctgacatttacatctgctcgttatatcctgataatactagaagatccatgcagttttttgagtacatactcgatattctctgctatatatcctgccttctagaaaatatttttcaggaacaattgagcactcgagtaagttgtggtcgagtacaccacattatcgagaacgatctcgacaaatgcagagtcgtcgcgcccaacctaccaacgaagaccgacnnnnnnnnnnnnnnnnnnnnnnnnnnctggactactcgagaaaaggttgttaacggataattcctcgcgaacgtcgtcggcttgatcacctgacatgattgtgaacggacatccgcatatgctacaagttgggtgcatgagtcatcctggtcacatgagacgcacataataaaccaactctagcacttccattggtgtgcgagagatcattctacacgttcgtggtcctcgaaccagtacatagtaatctctcgcaccgcaagcttgcatcggtgttcgagagataatcctacacgttcgctggtcctcgaaccagtacgtagcaatctctcgcaccgcaacctccattggtgttgagagatgattctgcgtgttcgctggtcctcgaaccagtacgtagcaatctctcgcaccgcaaccttagatggtcgaggtacgactacagcaatagcgcaacggtcctagcaccatgaattcaaatgatcgagagacacctactcactggttctcaaccagtcaatcgtagcgatctctcgtacatttacttacagtggttgagttacgactactgcttggttcttgaccagctgtgtagcgattctcccactatttccacttctagtggtcgagttacgactactgcctggtcctcgaccagcggtgtagcgattctcccactacttccactttaagtggtcgagttacgaccactgcctggtcctcgaccagcggtgtagcgattctcccattacctgtactccaacaaagttgatatcaggtacacaagatcgccaagtgttttacccagagatcccttaccacaaaagacacctagcgttgaaacctatcatattgtccctttacgccgtcatgacaaggcctccgaggaacctaagggaacttcggctggggacgcccagagccgataaggccttgtttgatccttcagagacgaaagaccacgtaagatctggtcgtgtaagagttctcgccgtgcgtattaaccaagccgtgtaattggaaattgagttttccaacttcatggctgggggctaggatcagtgcttgttcaaccgaggcaggtcaaaggtccaagagccttgtcatccgagaacgattctccgacgacaaggctgggggctagggagagtgtatgactctgcaaactgactgatcggagtcggtaagagagaagacgctcatatacaaaacactggtctgtacattcaattcactagtctgtcattttataacatgtcaccctttgagcattcgctcaggggttatttctatctaatattcttttctgagtattgatttcaggaaaattctattcttttctaagtattgttgaggaatacggaatgaagagatggtgtacccgccgagataaaatttcttgacttcaatccaaattctcgattacagcaagacgggagacttagttgtacgctctgtactttctcggtcgacatcagagattgacttagacaaaccctttcggtgcccgcacgaggctgatagaggaagtctaacgttatctctaaactcaccgagaacggtcacatgagctcgataacagttcctccaaagtctgcggttgagaatatgaactcgttcatttgcatcgaagtcgggggctactgtcagggttatggataccacatacttaatagtagttgactaaatctcggcaggacccactatataccatatcctatacggaagcaccttcggatataggaggagttccggataaggaatgacaaccagagttctacatggaaacgataaggactactcggattgtatccatattggtttcactagttctacttggacaaggggatacctatgggtataaatacaagcccccctaggaggagaggggagaggagacgatcaacacgatcggcacccaccatagaggatcaacactcaacacaatcgacatagaagccacaacatggaagcctacatacgccaagacacgccgccggatatcgacttcagggataagcacggctagtaccctacggtgtctccggatactgtcaggagagacgaaagcgctatctctgatcttgccgggcacggattcgaggagaaggctaccctgttgtcgactacgagtcagaccgccatgtcgacaacagttagataggctaccccaaacaggatgtagggttattacctgacaatacaggatgtagggttattacctgacaatacaggatgtagggttattacctcagtctcgcatgtatcctagcaccgacgatcgccatactatgcaaataccagaattgcgacatcaaacgtcgacaaatttgattagcaagaacattatatggttttagctaaagtaattaggatgcttagccatggttagagacactagctcatatgaatgggataactaatgattcactattacttaatgatcgattaatggtagctcatgatggtcaatcgtgataggatggtttattaagatgccaactaaaacatggtaatggtgggttgtgagcacatggttttgatggtcgtgctcatgacaattaaggaccggttcacgatttttggttgtgaaacattaaccgtgccaaccacaagccagcgtgggcaacggctttaccttttgtatagtgtggttcattgtgttgaaccagactgagaagtggcagagataagcccacgggggtcgctggggagtccatgccttgttttataagggggtgattatgatccaggaaaggtgcactgctttgaattgtgttttgcggagggtattgtcacaatctctattcacaatctctattcgagttcttgttaagtatcgcgacgcatggttgacatgatgttgaggttgtgtcttgtgggtacagtggtacacctctggccagagtaaaactattcgaatagccgtgcccgcggttatgggcgggtctaacaatgtcttttgtgattagtctcacacctctcaccataataaatgatgctgtaattggtaataacttgtttagctcctggtttggaatggtatattcctggtttggagatagaactgtgcagccgggaatggttgttcagaatggttgggcctatgcaacgggtatgttgtatagagttggattaatattgtttaattaaatgctttactgtttttctaaattctgaagtatttattgattgccatttatgcaaatgagactatattatgccatcctttgttatcccctgcacttgcatatttgctgcatggcttattgagtatgtcatatactcaccttgcaaccattcatcagaggagttctatagtgaggctgaaggtgtggaggattaggcgtagccctggtcaagctgcttgtgggatggagtcgcctacgctctttattttattttccgctgcttagatctttattgtttgagaggaactatctatctctgtaatgaatttatatccgtctattaattagagtaataattgcactctattatcaatttgttattgtatgcctcgactgattcctggacgagggttttcacacatgtaagtgtttggagttttggatagaaattctgggcgtgacaagttggtatcagagcctccttgaccctaggttatgccaaatggttacctatagaagccctctaaaaatattaaaaaagtagaactgttcttctctctttctcttttaattaaaccaagctaatggcacatgcagattatagtctctttaattgttctcattaaaaatttacttattattcctgtgttgttagtactgtacatctattactgtactaatgacccatttaccagcaaaggttttacaacattatttttatttaatcatgttgcaatataataaacttagcatgttgattttataactctcttttattttagctttttttaaacctgttattcaaaagtgcaaaaatttgtgatcctgttttcaacagttccaacttatcttagtttactttatttacctttcacttcgattttctaactttattcaatttaatccaaaaccttgtgctattaattggagaaatgtcttaactccctcctttcacttgtctttagatgccacgcttcaagcctgagtacttgttcggtattgagggatttgtccaggagctgcgtacgatgtcctttaccataggattcgagactgcccctttgtatgcccagattcctcatgatcgtgatgaagagaagtgccgtgtcatggtcaccttgaacagtgatcgtgaagacatcccatcgatgatgttcgaggctagagggggaagctatccttatgcttgtcaggaggcggcaaggatcgccataggagagctccgcgaccgttacaatgatctgttggccgacactgagtatcgttgccatcctcgtcagccccagggaagtgaccgtgccagctatgttgatcctgaaggaattgagaatgatgctaccataagacatttggtcgagatgctgtgggccatggatgagtcccgcgctgaagttgtgtcagctgctcaagctcgtgaagattggaaccgtggtaagatttgcaagctagaggacaaggttgatcgtctagagaaggaactggccgaattgaagggagaagcgccaccacagaaggccagggttcatcttactgcaaggaagagagctctttttgttccctgctaccagttggtgcccaaggttcgtgtggtggcaagagaagctgtcctagtcccagtggatcctccggtcgttaatttaagtgatgaggaggaagaagattcaaagcgcacccattcaaaggttgagtggggtgctactcaagatgatgagaacgagccgaacgagccttcaatcaactccgatgccaggaagaactacatgtcttgttaagtcgttgacttagttcgttgtgttagtttgcttgtttaagtttggctatgtgtgggtcttgcatgaggtttacatcattggtgggatgtaaatgcatgcgtttgtttggtttcgagtgttaggaagtttgagttaagtggtgtgagagtcttcagttttatgtaataatgaaactcagttaagatcaataaaagtcaagttagtagaaattaattctctgtcctaagtagctttcccccttgtttctcttcttgtgctcttgcctatgccagatggtgaacacccgcagcaatggaaatgggcccaacaacaacaacaacaacaatggagagaatcccacgcttgcccaagtcctagctcaacaggcgcaactcatgaacatgatgatgcaacaactccagaaccaacagaaccaggggaacaatcatgctcctccccagaacaagttagcagaatttcttcgtatgaggccgcccactttttccagtactaccaatccagttgagactggtgattggctacacgccatagaaaagaagttggacctgcttcagtgcactaactaagaaaaagtctcctttgcttcatatcagcttcatggccctgcctttgagtagtgggatcacttctgtctcaacaaggctactgctgaaccaatcacttggcttgagttcactgctgctttcaggaagactcgtgtaccatcgggagtggtgtctctcaagaagaaggagttcagggcgctcactcagggatcctgttctgtcaccgagtacatgcatgagttcaatcgtctggcccgttatgctccggaggatgtgcgcacagatgaagagcgtcaagagaatttcttagaaggactgaatgatgagctttcttacccgctaatgactggggattattctgatttccaaaagttggtggataaggccattcgtcaggaggataagtacaaccgaatggaacagaagaaactcaggattgctcagttcaaagctcagcaagggaatagtcagaggccgtgtctcactatgggacctcaggtagtgtcacagggaggatcttcatctgttgtttgtccacagcgtcagttctacaacaacaatgctggcaataacaaccgcaaccaagctccacgtcctgttgcaactccagtccagcacccgcctgtcaagagggagcaaggaaacaagccaggggtgtgtttcaactatggtgaaccaggtcattattctgacaagtatctgaagcctcgacgtgtgaagattgttcctgtgcagaataactccaatgcaccagcgtcaaaggctcgtgtcaatcatgttgctgctgtagaagccaaaggtgctccagatgtgattttgggtatgtttcctgttaactcagttcctgcaacagtgcttttccattctggtgctacacattcctttttatctatgagttttgtgggaaatcatgggatggagatagaagatcttagatgtcctttgatggttagtacccccagtaaccaagcactctcatcacaacgtagcccttctgtcagaatagagattcaaggtgttccatttctgaccaaccttattttgttagaatctaaagaccttgattcatcctagggatggactggttagccagatataaaggtgtgatagattgtgccaatagaaaagaaactctcaccagcaatgatggtcaagttgtaactgttcatgcattgccttctgaacctttaaggtcaagtttgaaccaaataactttggaagagattcccatagtacgggactacctagatgtgttcccggatgatttacctggtatgccgcctaagagagatatagaattcagaatagatctggtaccagggacaaccccaatccataagagaccttatagaatggcaaccaatgaattagcagaggtcaagagacaagtagatgatttgcttcagaaaggatacattagaccaagttcatctccatggggagctccagtcatttttgtggagaagaaagatcatacccagaggatgtgtgtggattattgtgcactgaatgatgtgaccatcacgaataagtacccgctgcctagaattgaagatttgtttgaccagcttaaaggtgccactgttttctccaagatcgatcttcgatcaaggtatcaccagtcgaggattaaaaaggaagatatacctaagacggcttttaccactcggtatgggttgtttgaatgtactgtcatgtctttcggacttaccaatgcccctgctttcatcatgaacttgatgaataaggtgtttatggaataactggacaagttcgttgtggtcttaattgatgacattcttatttactcccgaaccaaagaagagcatgaagaacaacttcgtcttgcattagagaagttacgagaatatcagctttatgccaagtttagcaaatgcgaattttggttgtctgaagtaaagtttcttgggcacgtcatctcagctggaggagttgtcgttgaccctagtaatgcggaatctgtaaccaattggaaacaaccgaagacagttttagagattcgtagtttcctaggtcttgcaggctattaccggaggttcatagagaatttttccaagattgctaagcccatgacacgcctgcttcagaaagacgtgaagtacaagttgtcagaagaatgtgagcagagttttcaagagttgaaaagtcacataatatcagcacccattatgattttgcctgatccaaagaagggtttccaagtgtattgcgatgcatctaagcttgggttaggttgtgttctgatgcaagatgggaaggtggttgcctatgcatcttgtcagttacgtcctcatgagatgaattaccctactcatgatcttgagttagctgcagtggttcatgccttgaagatttggcgtcactacctctttggtactcgtacggaggtgtacacggatcacaagagtttgaagtatatcttcacccagccagatctgaacatgaggcagcggagatggttggaattaattaaggattatgacatgggaattcattaccacctgggaaaggctaacgttgtagcagatgctctcagcaggaaaggctattgcaatgctacggaaggacgacagttgccgtgggagttatgcaaggaatttgaaagactgaatttgggaattgtcagtagagatttcgttgcagctttagaagcgaagcccactcttattgatcaggttagaaaggctcaaaccaatgatcctgatatccaagatctcaagaagtatatgagaagaggaaagactatcggttatttggaagatgagcaaggaactatatggttgggcgagagaatttgtgtcccagacaacaaggagttgaaggatacaatcctgaaggaagctcatgacactttatactccattcaccctggtagtaccaagatgtaccaagatctcaaggagaaattttggtgggcaattatgaagcgtgagatagcagagtatgtagctgtgtgtgatgtatgtcagcgagtcaaggcagaacattagaaacccgcaggtttgctgcagcctttaaagataccagaatggaagtgggaggaaattgggatggatttcatcactggtctgcccagaatgtcatctggccatgattctatttgggtggtagtcgacaggcttaccaaagttgctcatttcatccctgtgaggacaacatattccgaaaatagtttggcaaaattatatatggcaaggg

SEQ ID NO: 80469 - DNA, 20188 bp, Oryza sativa
attggtggttggtgccgtgtcgcgcgggagttgtttcaaccacatgcgggacggggacgcgcgcgcacgcacctttccgggacccgcgcgcgcccgcccgcctcgatccatccatccatccatcgactcgactcgattcgatccatccccctgccttgtcgtgccgttagccgtgtcgtacgtcctcccgcgacaacgaccgcaccatgcaaacacacacactagtatgcaagtgtgtactgcaaccgcacgcacatgtgtacacctccatccatcgatcgatcgatctctccgactcgacgaccgtacccatccctgcgtgctaccctcctccggctaattaaaccacaactatagctacatacataatcaaatcatcgttacactactagcgtagaacgtctcgccgattatagagccactcatgcacgacagtatacccgcgtgccgtgctgtgtacgcgcgatccccgcggtgagtcgtgattgatataggcatatcgtggcgccatacgggccgtagcccgtaggcgaaccaccgccccgcacggctcacctgctcacctggtttgtcatatgagcccatgaccaataatttcaccgcacgcacgcccgccccgcgcgtccgaggagaaaacggtggcggtcacgctggattgaaggtttttccttctagttttaaaccttttcttttctgctgcaacatcatatcaacggagcggcctctattccgcattactcttctactgttagcggcagttgaacaaattaaagaaccaatcatgaacgattgcacgagcgggtaatcttgatccactcgtcagatgtcgtactttcgtgctaactggttcctgctccagccagcagcaagcgactactcactccgtctcatgaaaaaccaacctataactaaatgtgacacatcctattttataaatataaacatacctctgtttcgtattcgttgtattataaagtgttatgtttcgttttagatttattttttttttggacggagggattacatactgacgatctggagatagtaccggccagaacgcaaacgcacacgtacgtacgcatcgatcgaccgatcaattcgatcacctcatcatgcatgcatgtcgatcaacatgccaagttagcgatcgagagctagccataatgataagcactgttgaccaaatgagaggacccggccggcagcaacccttgattctgtgcatcagcatagagctctagtggatgaaacagttgcactactgcacagcagcaacatgcagaagacatcaaaattcttaaacctccaagacaagagccggccggccggccgggtcgccttgttggctacagctccacgatgaccatgacactctcccctgcaaatgttgcagcaaattaagatctcggctcgacgacacaaacacgaaacgattgcatatatacatgtattggtccccctctgattagctagcaactaatggacgtctaaccatgccaattaatgggaaattaaggtgcagcattatgtaattaaaacagtacctgtgctgattgattcttagctggcttgggtaataagacgaaccaaatttaaggggaaattaacagatactcctcctagctgtgatatactcatagtggtgtccggccgtttgtatatacggatattagacatagcgcgcgcggcatgcatgcagaggcttgttcctttcatgaaaaagaggtggagtgtcttgtaaggcatgctacatggaagcatcacgatttaaatacatttggcaaagttcttgcatagatcatcaggtctaacctcccaaattgagcatgcccggccggccctgcaggctgcagattgcttaaactgcttggcttagcttgtagcctgcatatatattatctggaactacatgagtactactattcgattagcgtagctggcataacatcttaattaattagagtagtagaaatgtctgaaaaatgcaagcttgtttgcagtcagaattatattttttttcttgcattcggctatgtaacttaatcccttctattaatataacgctaaccaatctgtttggccgttaaaaaaaataacatcttaattgatggactcgaaaaattaatagtactgtaaaaatctagcatgaacaatctatataatataatataatgctgctgccacccccgttgctcagcatgacttttgcatgtttggcgccgatatggatgaatcgtcttgtttactacttgttgcatgcatgtgggctaaggcctctttaggggaccaaatcaataagatgtatacaaagtggccctattgtaatctccgaaagtaagtgggatcccccatctcctagtcctacttcttggaaccttctttaattataatctgctgctagcggatcataaaacaacggaatctatccatcatgtcctgcatagataagggaacatgcacgcatattatcacattcgtcaaagcactctatcatatcatatacacttgtaacttgttgcttcctcattggctatctctagagccatttaattatttatttatatgtgattaatctctcgtttttttaactagttgtgagtctcaaacatgtactgacatcgattaattacagaggtagtacagactctactttagttggagacatgggtgtgtggttttggaaggatgtgtcgtagtagcgttagttgaatgcagttggatgagctagctttactcttcggcttggcaaccgctacctttcgtaccatagtgcacgagctcaacatgaacaatgccattaaaagagcggcggctacttcaaaagatgaaagtgaaagcattatattgttaattaattaggtcatctgattttgagaaatgttaaattcttaatttctccaggatttcctatacttctcatcaagcgtccggcgatgtatactatcttaaactacatatcatactcatatagtttattctgcacttaagatcagaatgcatgatcaatctgcgatttgaaaatatttttcagcagctatatatacatagcatatataggtcatgcgatcctatagcttttttttttttgcggggctatagcttaattagttaggaccactgttgatgtagggaaaaaaagcatgcatgtatgcactggcagattctttcattcacacgtacatatctataaagttttattgcaactcaattgttaaagtgcatactgtattaattctcacgtatgaatttaatgtacagttatatataattcagtaatttgtttaggagctaggagaattaatattctgactgaacttgcatgtatgcagacaaactatacacattcacttcaattaattggactgtgatatttttggtgcatacgttttttatatacagtaattgtttaaatctgtatttatgctcttcggccacatatgacgaactggacatttaaacatgataatgacattagaaggtagggggtatgtttctgacaggaactttaattatgtatcttaacacgtatattttggacattctgagacgtttgtggagataaccaaacttggttttaatgatattttagaagtacttattgtaaacggtgaaatttagaaattttcgttagttaagatcgggtcaaagaaggaattcacgctgtgagtatagaagattcagttaggcaagctgatccagatttggtattaaccttctgcaataggaaatgtgtatcttagtttttttatatatataaatagagtcctgaatcgatgagttgtgttgggatcagacttagggtgtgtttagttcacgctaaaattggaagtttggttgaaattggaacgatgtaacggaaaagttgaaagtttatgtgtgtagaaaagttttgatgtgatgaaaaagttggaaattcgaagaaaaagtttggaactaaactcggccttaggtgagttttctcttttgatcagccgatcaaaagttgtgtcagagtcaaagttgtaatgataatttttttttagagatagagtcctatatcaatccgattgtagtagaatcggacttaaggcatgttcagattgtagctaaaataaaccttaccaagttttggcaatgccaaaattttggcaggatggtaatattgcaaaaattttggcaggatttcttatgtattgaccaaatttggcaataaactaaacgtagacatatttttggtaactttgtcaaaaaaaaatggtatggttgaaaatggcatcaaagtgaacaggcccttagtatagcctatgggcataaatatgtgcacccagggcctttgtaaacaccaacagttcaataatcactttttcgacgcatcgccaccctagtttagcttcaactggttcttgttcgagtttgtgctgcatcgatttcgatctccagcaagaaagtaagccccgtcaacttcacttgtattggttgggctgtactttctcaattaagtctgatatattaatttgatctttgcatgcgttgcctatctaatgtatcagatctatctttgattgttttgctctcatagttagggtattatatcaaatcactttgaattttaccaatcggctagtttaaatctatcaaacttaccattaatcttgaattatcttggttatgtccaatctactaaaattataatttgctagataaatttattcaagtcaataggtttaaacaattgtttcattggagtcttaaccgatgagttatgtgtttattataaattaatttgctacatcgtttgagttacaagatttagcataatcggttaactgctatttttgttatcttcaatcttatactgacggagcgtggggctcctcaccgggagaccgcgcaggcccccctttgccagttcagccgggggcgctaagtgaggttcttcgccctcgatctgaggaacgtcagcgagagaggaaatgcacaagacacgggcgatgtagacaggtccgggccgctgagaagcgtaacaccctactcctgtgttctggtggatctatgcgtgaaggaatacagagagccggagagcgagagagagttcaggctctagaacccattccccagagtcccagtccccttctcccctctcctcccttttttctcctaggcctgggcctcctttttatctggtcaggggtcaccacatgggcctctagctgcctaagaagggaaacatgctttttacaatgagggctagtctacagccggaagtgacctctgacaagcagagcacacgtctcctgccccgctcgcctgctttcccggtggacgcccatttcaaccttcatttaatggccagcgacttccttaccatacttgcgctgaagcctggaatggatttgaccgggactgacataccaactccaggagttagcacgccggctccggctagggacgagagctaggaagctctcatcattccgacgggacggggcgaggcgtgtgacaggccgcctattgccacctaaccagcgatctgaccggtctgtgaccggtcacacaccgcgaccggtcacggaccggataagcgtgcgctgcgccgcattaaatgcggcgtggtgcactcgtccaacctgctataaatgcggttaggtgagccccgctgtgctcacctaacccacacacgtggcgccaaaaccacagggggtcggggcgccccagccctcggggccgaaacgggagcgggccgacccctcggggagacagagggaggggtggccacgtcaccttcgggcccgacccccccgagggggtcaggccacgtgggtgaccgcggctacccaagcctctagtcacgatacccccggccccatgtcaccgacatatactgtctcgatttgatccgatctatcaagattgtggttaataatcataggttgttaatgattatactttaacttgttatagctgatgttgtttttttctttactttgcgaatgatgataagcttcaattaatattttagtgcattggcctacatctaggaatatatataattgttaagttgatatctttactactttcaatcttatattgtctcagtttgatttgatctatcaagattggttataataaagttagaagattttgcaaatatatattatgtagattttggtcgatgtcactttgatcctaaatatttatatccatcggttacagccaatcgatccaaaatttcatcggcatcggatgggcacacgatacaatatcggccctatgaccaattgactccacaatctaatcttttcgttgtctatcttgttaattctaagatcaaactaactggcatgccctgaacccgattgataggacttgcactagatctaaacaaatctcttatgcctttgtgtatgtgacgaattttacatcaacacttatcaattcaacttcctaatgaaatttaaaattttgacaattagtccaattttatgaattatataggagtatttaaatttgccatctactccctccgtcccaaaatgtaaacatttttagaatagtgtcaagtcaaactttttaaattttgactattaatagcgataaattaagaaatattaatcatgtaaacttgatgttactatatttatcattaaacgaactatcataatatgcaactctttttatttaaaatattttacttttgtagatattgtcttggagaccgtgtcgagatccaaaaatacttacattttgggacggagggagtactatataatactctctaaaggtttcttggatgtttatgctcgatttgtaagctagaacccatgccaccacctatatatatattcatgtcaatgtatagctagcctatttgaaaattaatgaaatgcataaagtccaaagaaataaaatctattagtgttactttgtaaggcaagaattttacaggatttcacataattaaatcggttcaattcctgcaaaacttctcaaagaaaatcatccattccaaacacatgggaatatgagaaaaaatgccacacctttttgaacggagttctctttatttaattaatttacaattaatggaatgtctttaatttctccaactaattagtagtatataaaaaaaaatgacacacgagttacctgtatgtggtcgatttgtcaattcgttataattaaaaacaattgctacatataaacccgacagctctaagaacatgatccatgcattggtggcccatggttaggaaatgccggagatcaggcgcagcatggatatatcattagaggttgggcagagtatttatctcgttgtttaagcatcattattgggctcgaaccaatctgatgaaaatttggtagctttctagtgacagcattatgagcataaccactacaaaattaattaagaacgccaaggacatgtacttataaaatttttacattagctgcaggcactaacaatattaataagccaacaattgatgattggtgtgaatatgctcatatgtttagcctggtaattaaatggggaagtatatatctcgactcttcaaatattgcatgtcaattcacatgatgtgattaattataggaacattacaagtccgttcttaattggcaacatatagacatagataccatgcacatgcgtgcatgatatggtatgatcgatgcatatgtatggaatatggatccatgactagcttagcctcttgcatatggtcgatcggtcggccggctttgctccaataattagagtttaatcgtcgccttgcacgcctaattaatcatcccgttgatggcaacaagtcagcggtcacggaggcaacacacgatcgatgatcgattatcaggttaatttcccctgtatatatatagcttaattattaatttgattctctctccttaattagctttctagctacctccctgttgatttgtgctcatatgtgattagcaagtcttaaccatcggcgacaactgataagtcgttgggtttagacgtgcgaccaaaccacgaccagattaattagcagctaattaattaggcccccttcgatctccctctaatttgattaagcctgaaaaatgcatacaataatgcactccgtatacatacacttttatacgctaatcaatacattaaaatcaatcgaactagtattataattaaaaatcgttttcagttgacccggcaggccgggggatcgatcgagagcgaattaaggatcagattttatgagcacgatcgatcacgattgagcaggtagctcgatctgctacataacgtactcagaaattaattaatttatatttttaagaaacacggtataaacacaaacgttctcgcgtgtgacactcacctatatgagcatttttagaagactgggcatattgacgtttcgttgtcgacgggtacgtcgtccactactgaacgaataattaaccgtaaatgtgaacacccatatcaaatttaagatttgaacctaaacctgctccgctcatttcgtgaaattaattaatttcgttaagaaggaaaaaaaggaaaaaggaagaagaaaagtacatacttgatgcgtacgtagctgcgtagtacgcttggatggatcggtgcaatatatgcaatgcaatcgagcggctttgtagtttctctctctagctagctaatatagcagctagtctctctctaccgaatccatcgtccgtccatccgtcggaggaggtaggtgggccagggcagccatgtgcgctcatgtggtggtttgcaacgcttggccccaccaccactttctctctctctctctctagactttctctctctttctcctcctctccaacccaccactcactaacctgtagtacccccaacaatgcgtacacggccgtcaccctcttcctcatttctcttttataatctctacaactttaaaaacatagtgtcctcggttcgttcttctcatatatgcataaccatagtatgatccagtaatttacctaggtcaaacctgttacaaagcagagggcatattatactatataagaaatttcacgatctttattatttaattataacttattataaactgtaattgtattggcgcccttgtgactcgaactaccccatgaaggagggagaagctgtaacacttgcgttcgcgaaaaacaactgtgtaacacttcaaaaatagtttataaataaaacttatatatatttgttgttagtaatttaaaacttaatgttgagaaataaactaaaaaaaacatcaaaaaaaatctaaaattaagatttaaaatttaaatttcagttacgactaacaaagctaaaaagcaaatgatgtagcttagctagggtttaaagtttatccataaattgatctctcctacaatttcttcgatctatccaacaccgctatatttattactcactgtggtaatattatatgctcctagaggcattggaatattttttttttctttttacctcaattttaaagcttgccaattaacctaaaatctcttaaaatttgaacggatcaggtagctacagaattagccactgccttgtttatctctctaggggattagctagctaggggcctgtactgtatctatctcaaaacgccctaacgggaacggaacgaatcggcatggaggcgcatgttacctttctgcaaagcgtgtggcatgtgttgcccaagattacgatcaattggtcgatatttgatcgagatcaagttgttgcctggctccagcaacatctttataatctctctgctggattaattattttaatttttctccagctgtgcaatatacacacacatttgcgcgtaatatgtgcttttgcacgccgattaggcgattgctactatagaaacttaattaacattgcatggcgatggtttgacgaacgtgtcaaaccccaaatcccaggccggtttactcgttttacgttgcttccacgcagacgaacaatttaacaacaaatcgagttaatgtttcagacgcggacggcaacgtgatgctgatgctgatttgcatgaaaaaaaaaagcattgccttaatttttcctcttttttttcatccaattgtaactaccactaccaccgtactcatatatctatccagcacatgcatggatatgcatggttaatagtagtttagcatgtgttgtttcctcatgttcgtcaatgcaatcaggttaattaaccaaatcagcagattgcgtaggagtagatgtatgtgaccgatcgagtaactgaatcaatatatcgatccgaccaaagtccgaccagattgcttttatatccattagcccacatgcaagcaagagctaaccaaagatgagtctcatgttcatcttggccaacaatttcttactttctttctctacagtactagcagactaatttttttaataaaaaagaataatttggattgtttttgtctctcgttgtcaactaggtattataagacaccggatcttgctcaggacatttgtgtcagagccgtgttcctcgctctcttccctttcctttttttctctctctaaaatcgcaacccacaaatccttctgatccgtttgtgtcagagccaaatcttcttcttcttctccatctctctcctctcctcttctcttctctcgttggaaggtgaggaggtgaggtgaggttgggggcgccgtttgatggacgcgaagaggacgccgccgccgccgacgccgccgaaccctaaccctagcgtaattggcagcggcgccgccgcggacggcggcggatttgggaggggggaagcggcggcggcgacgaagcacatgctggccttccacttcctgcgcgcgctgtcgcggatccaccgggcgacacccgtgacgcggcgcacgcggaccatccgccgggcggcctactcctccatggcgcgggcggcgagcccgcgccgcgcgtggagccgggcgctgctcggccaggtccgcgcgcggaggtccaggacgctgatgaggcgcgccgccgtgctggtgcggaggcgcgtcgtagccgctcctgcgccttctcccgcctccgccagaggcgtcaggattattgctgccggagagacgtcggcggcggctcgggctgttccgccgcctccgcggcagcagggcgagccgccgagggccgaagcgctccggcgcctggtccccggcggcgccggcatggagtactccagcctcctggaggagaccgccgactacctccgctcgcttcgcgcgcaggtgcagctgatgcaaggcctcgtcgacctcttctcctaccaatgatccatccatcgagtaattaacatatgcatcatatggttaattatttattcgttcgtcttgcacgcatcacatgctgctgttgctgcttctgttctacttctctacctacatcatatcgatctatctcttgttcatgtggatcgatcgatcgatgcatatgatggttggttaagataggggattattattggggtaattaaggggaggatctaggagattgggtggagtgttagtatacatgttttttgtttttgttggtaattaagattattggtaggtgatgaaaagattgttggatacatacatccatgtatagaagtataggccgaccggctgggagcacaatgaattgaatcatatataccaagaagaaggctttatagagagagagagagagaggggtaattaattgtaacatataaagagaaggatgaagttacatatactatatgatagtgaattagtgcagtgttaattgttgtcaattgtcagtaaatcgatctatatatctgcgtatatgtgtgtttgtgaattgtgaaaaattcatgcatcctactaacctacctttgtagctgtatctgcgatgttggtatatatatattttttcatcttctgtaggtacgtcttctatctgattggggaagaaacaggtaattacttaatcaaagaacttaacaatgaggtcatagatgaatggatgttgcatatatatcatgcatgataatctgcatgtgtgcagattcgttttgttctagtagaattaagtattaattggttgctagctagctgcacatgcatgatgcatatgtgtgtactacctctatatcatcgttcccatgcatccgctactcgtattagctagggattgacagctagatgatgctccattagctagttgttgcctagcttgtctaattagactattagagtactgctagcttgctaactaggagggtggttatgttgaattggttgtttggtagagtgttttttcttttctcctctctcaaatttgggaaagtgggagccacaatctatgagggatagggttgctaatctttgagcttgatgagaagacacacataacttgtggccaaaggaaccaaacaaaagacattctctccatgggcggttagcatcttttgattaaagggccttgtgtttttccctttggaaataagcatatatgtatttgtgtttttgctattatttttcttctctcttcttgttgcccttccatcatctctctctaccaacttatccctgttcctttttaggtgccaccggttctctattgagtattctttgtgtacttgatgctgctggcaagtttttctgcttggctcttttgtcgtgtttttttttctctcagttggctagctttgacacatgcgtttgttgcttcctttatggggtaagaatccgaaagggttgaagctagcctcttctgcttgtaagcttcctattaagtgttatgttacatcgggatcatatatatatgtacaacacaaacagtagttaatcaactggacgtagaaaaagactagctggtaccatgcaagtttgacatgcatggttgaaaccacattctttacttttacttaactgatataataatatagttaagtcttttgcatgtccctgaaaaaaaaaggtaaaaagatacagacgaagcagatgcaaagaatcttagtagaactatatgtatttacatatgtgtgttttcacactagctagctaacagattatgtcttgtgcaccgtggtatattgagagaagaagagcctgctgcctgctgcatccataaaataccctaaatttctgcttttgcttttttaatttttttatttgtacttgcatatattgtttttagttgtgatcacagagctagatataatttccacttaagacgatattgtagtgtgtggttttaatctgttttctatttggatattcgataggggggcgtttttggttcagatatcgaatttgctcattggccatagctagctgtcatatatgacaaaattagtacacctattgacaggacaaagctagctacatgcatgtgtgcattttgcttggaatcatgtaagatcaccatccaattcgcaattgggccacaaaatagctatattagggagccatttcacatcactaaaaacatttttggtacttgaatcaacagctaatcataattggcccactgattagctgtactcatttgatcagctggctataatcatctccttcaacagacatgcatgtatatatgctatatagtactataccttggaatgtacatattgaaataaaataaacatggatcggtgtgtagcgtatcatatatgcatcgagacacatatttgtgacagtacatcggaattttctaacatcatgcatgtttaattactgcatatatgactttctgtcacttctatttttcagaatactatctttgatcatctgctggttagccttgccattagttcatatatagacttatatataattttgttttcaatgttaatgcactaaaaattgtgctccattcgaacaaaatgcagagaaattaaaagatgattcagattggtccaaaatacatatatatagttagcatggtcaagtaatttaatgagtttgccgatttgatatatcagttttttatttcgtcaaatacacgatgatatatataggtgcatgaaataattctcagtattgctaattgatcgttatttcagcaggatgtgaaattagttaataattgccgctatatatacctgtcatatcttcgtattaggacttatccacatggacacatccattttatgtcactgaaagctcactatacttcttaatttttaatatgcttgcttataatttatctattagcgggagaagcatcaatgatatacgatggaataataaattaatgcatgatattttatccatcatgattaaaatacagtgcgatagcgcccatgaatattacgatacacgagtatatatgcttttaataagattttagtgaagctagtgagttacaatcgctactatagcttcatctctttgagcatatgttagggaacatatttagagatgagtaagtgtggtgtgccgcacgcgtaagagtactttgtgaaatcggaaaaattaatctttattaacagaccgtgcgtgggacatattttaggccgtgtgagtattgtggtaatcgaaaaaaatattgttaataaaccatgtgcacgagatagatggatgtactagttaatgggggtactagttattttaacaagtagtgctgttgcatatcaaatatgcacatttaatttctctcttatatatacagcatatatatgtatccgggataaatatgccgtgcaaattaaattgatttttgtgccatcagctatatattcttatgcacggaatgcagatatatagaaaattcagtacatggctttctttataccgtggctaacgtacgtatacgcatccatatgcatggatccgtatatatgcctccagggacttttgtatgtgtatcgcctcgtactctctgttgtttgaatgtttttgtagatctagcgatcaatgtgtttaattaattaaccgaacgctaccaacagtactacaccacttatacagcacctgctgactttaatttaaagtatatatactttttgagatttaaccaagttatagttgatgaatgttacgtgctacacagcgcttgtgctttaattagatcgaccaaacctagctggctagctagcgtattactctaattaatatactcgatcggtatatatataagagcttagcatgcgtggaacagtacggtacaaattaattttgtgtcattttgactcattgtgtgtgtgtaagtctgtatagaattgttcattgtgtataattaagcttgtatacaattaattaattgtgcaattatatatattgtgtgtaagattataacatgggaaagctgttcgtgtatgcaccatgtatgcgtgtaagctaacgaggatatattgcggccgatggatacatggcacctatccctaaaattcatttttttaattagtcccttttactgtcctttcctgctgcttaattgagcccatatatattaatctactctggcatcaatatagaagaaacgagaagaagtctaaggcccattccattatttgtactgagagctgcagaatttgtaagaactttggtatacgaaatattcccactaatttgaatgttggttttcctacaaaattctcgatacactagagtgaagtgctcaagacaacaaacatgaattggagtgcgtgtagtggttagctagctaattataattaatctttgattaatgatatagatatagtaaagggaaacatatatcctatgcacacaaactttccgtgcataccaactaataaatatcatgaaaaattatagaaaaaattggatatttattcataatagtcgagatgatgcagtacatatatatcctatctgtttctaattaacattaacacgagatttatggcgaggggcagcagaaaattactcagaattaaataacaaccttttctgtcttagcaagtagtagcaacgtcagactgacgtcgttgcataaatatatgtacagttgtctccaactacaaggacgtacagactgacgctacggagatatgtcgaatacgtcataagttaggaccatgtccaaagcatgcatgacattgttgttgttttcctgaaatatttggaaattatatattcagaagacttagctatatatatacacgcatatatataataattaattaaatagctactagctagtaggtgcgagtaccacgcgcgtacgtacgtacacctctctagctagctgtattcctgtacgtatttagtgtatggtacagggacatgatcagtacagattatatattattcatggtaacgtgtaaccttgtatgccatatggacgtattatgcatataatgtgactgattcaattggtgcaaatgcatggctactaagcaagcttcccctgctctagaattattgattagttaacaaattttgtcggttcaattccaacctggtcatatcataagtacaggttctgttagttcttcccttgcatcttgacgaacactctcaatttaatttcttgaatcttgacgagtagtccgtcaaaatcttaaatcatagctatagagactaccgtcctggtaagaattcattaattacatcgatgaatgtctggcagtacttaatttaccagaaaactggtgaattaatcagccatcgatgatcgttgcctgttgccacaatctgttgattgattttttttcccctacttccatcgtcaaaacgatcaattattagtcttgcgcaacaccaagttgaactccgtacatcatcagacgatgctatgttgtttaatttgcatatcgtcggagctctgaactcatgaacttaagtacgtggatacactatcatcattctacctacaccgccttctgtagaaaattatacgggagtttttctaatttatatggaatttaactgtttaccgcagctgtaaattaaattcctaattcctgtacaacagtacaagaagactgatcatatatccaatatccatgattttttagtagatatagtcggtccttccatagttatgtggtttaatttgtttactatgatctaactagtttagatatcctcaagttgttttccactttatccacactttcaatcaaaaccatgcgcgcttaatgcctttataaacattataaacacggcgagaagagattgaaatgtcctgacgtcgcatagatcgaaagctagttaattaattaagctaattaattagacgtccagctgaaagcctgaaagctaaagctcgaaatcatacacgaaaaaaagaaaagaaaaggcaaaaaaaaaagttattacacatgatgagatgaggacgcggcggcgctagctcgcgttaggagatcggaccggagtcaggcgacggcggccgggagcgcgagcgtgccgacgaaggggaagctgagctgcggcagcgcgaccagctgccgccgccccgccgccgccgccatctccatcagcgccttcctgatcggccgcagcagctccgccaccagccgccaccgcaccagccgcgacacggccagcctgcaccggcccgccggcctgcgccgccgccccagccacaccgtcccgccgcagtactgccgccgccgcagcctctgccgcgccctccgctccctccacccgccgccgccgttccaccccaccaacgacgccaacctcgccatgcttaacactgtgcacacacgcactgatgtggtgatctgactctcccggctgagctgagcagtgtttggctttcgcagctgtatcactcactgatgacttagtgaggaagcttaatttatagtacgagaaagagcaacgcgattagctagctaagtaggtgaggtgttaatggtaattagctagttaactatagatagcctgcagctgcatgcgctcactctgatgatggtgatgatgatggcgtgatgataacattctatcaaagcttcatttttttaacgtgtaaaagaattacacgttaatatactagaaaaaggaaagttcaattatgcatcgcaaccagtcagaggacaattgtcggggggcaaggagaaaagaaaactgaaaaaaagagagaaaaaaatggagctaaaactggacactactcctatacgagagagggggagccggagccctactatacactcccaatatatccccaaaagacgcgacgccagtaaatgaccatgggaaaccttcatgtagaatggacttcagaaccaccgaaaccgacgagagagagtaatcgaacactctggagttccgctcctttcatagctgcgaggagaggaggactaaagagtcgaagcacttatgacaatgcttaggcaggcaggccctagaagtaggccactagacctgaagagaggagccacggagcagagtgaggtcagaccagtcaggtagagacagaatccggtgtcagacttggcgagcgaactcacagttgaggaggatgtgattcgccgttttgagttattggacgcaaaatggataggccgagtggctgtcaataccacgcttttaaatgctcttaatgtagttgtatcaccttaatttaactccttttgtcttaaaaaatcaaagctatcttaggtaagaagcgctaagctcactacacttaggaattgagaaggccgtcgccctctacatgcataatactaatcatttgcacggcagcttattaattaagtgtacatgtcccacaagaaaaggatatgatctgtgatcatactatcataagctagctacacataaagattaaatgtatatgtattttactaaataaagtgtaccatgtacaatactacaaaatggccaagagggtggctagctaaagcatgcgagaaattaattaaagttaatctatcagcttgatctctagctacctaatgatatcttaaacttgcttgtgctctcgaaaagcaaaatggatatataagagcgtgaaggccagctgatcttggcgagatgagaactgatgagaaaaagctttaattggcgattttattaattaagcaagtctgggcctgaagcagaatggatttttctcttttttactgcctagttggtcctttcaggtacgtacgattaacgatacaactgatttgttaactaaatcaatcaattaagatgttggtggtgcaatggattggatggcctagcaagtgtcaagttggataaattacagttgatgtgatgattggagccattgatgtatagctagctgctagcctttgctcatcagctgcttaattgttagctagctgcaacctgatgtgtcaggaaagcaaagcctaaattgcttttgatttgcttgtattaaattaaggaggaagctaggagggcaatttggacgttggtgtgtgaggtgtaagtgtgccaaaatggatagactaattaaggtctccggcgatggctgccggtttgttgctttcgaaacaggacggggctcgcgaatacaaaattaacgcaaaattccggccgatttccgcgtgccgatctcaaaatccgggcaaaccacggcagtatctgatatctccgtggccacgcgagatcgaattcgcaggaagcaatcattaatttaactactgaattcgaattctaaactgtgttaaggtttcggtctttcagaggaccacaaggagcagaaagctaggataaattgaactagagaggttaattaattaaatgattaatcaagcacgcaatgagtgaggtcaggagattggctaatcactagggtttgacattggtaatcacccggttggagtaagcatttttcacagtctggtgttagtccactcgtaggtggcctgtggcatcgccgccccaatttggtctgcttaaaataacccaagataacaatatcatcttgggttacttcagctatagtgtgctctgctttgctttacccaggtagctaatgctttctgattagctagatttgactctagcagccggcaattcgttccatttctaaagcctaggtagcattttgatttaaatatttcaaaatcaaagaattgccacacaagtttctcttgcatgctttgtcacttcatagagcatgacgaagaaaagaaagtaacggcagaatattgttggactccttaccaatttggatcagctttaggctctgtttttttctagatggaatattgtttgaaaccggcaaagttgtaatgagaggactcagcagctaactaattgacacgttaacagttacaagcctatcgtatccataatcta

SEQ ID NO: 80470 - DNA, 58012 bp, Oryza sativa
  unsure (1)..(58012): unsure at all n locations
cccacccccaccgccacccccaccacgaccgccgccactgctgctgctcgcctcctccaccgccatgagctcaaaccctaaaacagcgcgcggcgcagcgagattttgtggggagggattgcagcggcggataagggagggagatttaattcgttttaggaaggctgcgggtttgcggggaaggaataaattgggggtttcctccgagaagagagagaggaagagcaggagacggtggaggtggacgaggaggagatctaccgcgcagcggcggccgcggcgggggaggagtgtgatggatgttaccgcgaggcgaggcgaggcgaggcgggggatattttggttcaccgcgacagtggctggctggctggctggggggagtgcggtgtcgggtcgggccaggcttcctcctcggggaggaaggagacagacagcggatgcagacgcggacatggccgctggctggcgcgacgccggccgtattatttctccgtctcttttttttttctttttttttcctttttcattttgttctctttctgtgattttgtggggagggacttttctttttgggtgttatagatgtactagctggttactactctctccgtatttcaatgtataacgtcgttgactttttaaccaatgtttgactattcgttttatttttgtgtaaaatgaaaatatttatatcatgcttaaagaatatttgatgatgaattaagtcacactaaaatgaataataattatatacattttttgaataagacgaatgatcaaacgttagataaaaaatcaacagcgtctaggcagtattaatcatgagttcgtgtttatctcttcctgtcgctgtccatatgctcctgattaccggtgatagcgagagcatgatttgcatcttttcaattatttatattcaacaagttttgtcgtgtttcaagcgtgatagcggtttataaagaacagatatatttaattgttttaccaatatagacatataatgtttggcgtaaataaatgttctcagttcatggatatatgggacttatctagttatcttatatgtataaaaaatggaattcatgcagtaaaatggaggtaaatctatgtctaccagtatattagttatctaaaaaggctatttttgaccataatactctacatcatggatttaaatattacaaaaacaaatactccttccgtctcataatacaaagaattttagaggggagtgacactttctaggactacgaatcttgacaggctctttatccagattcgtagtcctaagaagtgtcacatcccttcaaaattctttatattatgggatgaagtgagtaattcatgagctagaattataacatggttagttacctagaaggatcatcccatcaccctattatttgtttagctatattagcaccaccctgtaagcttttaagtagggatgaaactggttcggatagttttcgtccgtccggaccatttttcggattaggatagtttcagtcggaattatccggaaattctcggattcggaaacgaattcggatattttttcttggaaacgaaaacgaatacagtaagggtaatatccgtcggaatcagaaaacggtcggaaactatccagaatttttttcagatatccgcagacattaagcaaattatataaaaaacacgtatatatacataactttttcatacggaatcagatgaagacaaactttatatcaacattgtagagctcgatgagatctacaactttattattgactattttattatttgaggtcatttatgggtctaaatattcattataatataccatattaatttttacaaaatctcagatctacaattcaacgacatctgaggagatgtgttccatatcaaaattgtagagctcaatgggatctaccactttgcagtttataacatttgtatttgaaagcatttaaagtacaatacaaacattacaagtttcgaagatgtgaagtaaaataaacaaaatctccaatttatacaatggtaagtaagttatacatctagtgaaaggtctcgggaatagaaaatgataatcatatttgcatatggatctcttagaggaacagccatgaaaatcgatttccacatacagttgtgggaccgtctataaaattgacgatataaatgttggagatgttgaactaaaataataagcgatatctcttccttgatcaagaaactcaatttgaggggttttttatataccgataaatattcgctaccgtattcgttccgtctcgtattcgctccgtatttgtattcgataatattcgatttcatttccgtatccaagttttcgattccgattccgatttcgaaaaaaaatattaaaacgaatatgataaagctagtttccgtccgttttcatccctacttttaagtaatagtagtacaagattatttagggactgtcattagatacaacagctgagactataaatctctaaccattgactaattttttattactattctctcttttttttcacccttatgtaaccatgttttcaatatagaggtcaaaagtcattgttgagccactgttaactacagtaacgtcatcttctttttttctttttcgtattagcaaaatattcccaattggtaggactaaaaacctcctatgtctaatgattattgcacatgtccttagagcatcataacaatactgaaaacatggaggcatgaaggagttactagtaaatatacatgatacgatgaatataaaacataagagagaattcattatatgccactgacttgtcatacgtccacgatttaccactgactttgttatgttctacaatatgccatcggttgttgtttaacttctacgatttaccatcgccgtccggttagcctccgttagcacggtacaatttcatccaaatgaccaaaatacccctaggacaaaaacttccaaaatttggataaacttatcaaaatatcctattatgaacataagattgtaaacatccaaaatttggcaaaaacttaaaatctgacattttaaaatttgcaaatcttgttttaaatatgtcaaaaaagtccaaataaacaaaactttgatatttcaaggtcaaatgagcaagggtaagaatggcaatttatcccttagttaacaatgttatattgtcttcacgataaacaaaaagccttgatctgttttcaagagggtcaaataaacaaacctgaaaaaacaagatcagattgatagtttgacttcaaaagaggataaaatgagcaattgtcccttcatcatttgataaattaggtgaaaccccgcgcattgctgcgggaatttagtatgataacaataaaaaaaataacgtgtaagatagctagataacatcagattaattaaattaatgtggtttatgatagtttaaatttaaatagtatgtagaacggtgattcaaacgtaaaaagtaaggtgatatgactttatggaagaagaaaaatagggagataatttggaccgtagattaatcatctaaaggctaaaaaacaattgatgtgatatgacttaattagaggaaaaaagaagaaagataatttggaccatagattaatcatttaaacactaactaagtgaggatgaactatataagtatataggatatcataaaacacaataaagatatacattaaaacattatatgaattatgttggatgataatttaacatgtttatatttaaaaaactcttaaattataaaaactataaagatatagcatgtttgcatgatgtttaaatgtgatgattgttaatggatgatgatgtggcatcttgttaattagtggattaatggatgatgatgtgatatctttgtatgagcttaaggaattagtgggggtaactttatagtaagataggattagatgcaattaatattcaaccattttttttaaacgaaccggtattaatattcaaccattgggcaagttgctatgggtttactccactcggagaactgactatatttctagctcttttagcgattggttcttgatcgatcggttctttctccaactttactaactcatctaccttgttttacacgggcacgctttttaaactactgaatggtatttttttaaaaaaaattatctatacgaaagttgctttaaaaagatatattaacccattttttttaaaaaaaattagtaaatatttaattaattataaaaaaaaatatgccgctccgttttatacgtgaagaaaatgggtttccaacgcaaggaaaggaacacagcctactagctatggtgtgttgtttctctctgtaatttaattggaatgtttgcactcagtttctaatcctcgtccccaaatcgatcaaagatgttatgcttttttaattgtcacagcttttcctgaagaatgtttcacatttcaaacggtaagcataccaacgactcttttttcactggtgatttgggtaaacgagaattacaggtgtattttcattaaaaataaggggaaaaatatgtggtgttcccaaatcccaagcaggccctagagaaaaatacaccaggggaatccaagctaagtcccccacttcctactacgcgcatatcgttccgactcctatagttcacctccttttggcactaaaagaagtgattttggtataataatcctatttttgagctaggatagcacaaaccttaccatttttttttatttcggcaagcatgtcccaattcaggaaacaaaatctaagacatactcccttgtttcaaagcgattaataatatttcaaagcgacttaattattataatatgaaaggaagacttataatatgatgaacagagacaaagtaagatagaaaaagtgaaaccaaaaccatgaaggaaaaagtgtaaccaacacaatgaagaatgtgagccggtaaattagtaatccgttatttctatagtgacgttcttttctcttgaagatgaagttttatacgcaaaacgagatgatattaatatatgattaattgggttttaattattacaaactagaaaatagattaatatgacattttaaagtaactttcatatagaaagttttcgcacgaaacgcatcgtttagtaatttgaaaagcgtgccacgagtatccaaaattttatcaaattttgttgaagaaaagaacagggtcacagtgataccaattaattacagttataattatgatcctagagctcaacactcggcaagccaagtcgtcactcatataaggagataacacaaattaagagtgccattaaatggtagcatgacttcattacaaaccactgcagaggtgactatcaaaatacatcgaagtatgaaatggacagcacaggagaatgtccgaacttgttcacaacactgcccagatggtatcgctgccagcatacaatctcgatttatgagggatcatttggagttcccctttcctactgttgtcgttgccattggcatgataaacactcggcaccacctccacaccggtcaagacagtaatgttcttcccaattaattcatcggagtccccttggggagtcttattgtgaaagaaccttgcaatgcagaacttgcccgagccaaggttgacaagttgagaatccttgcatcgcttccattcctctggctggtcaaactccttacaagtagctagtagctgtggctgggaattcatcgatgagagatcagcagcagccaagtcttgggtgtcggcagaaatgccaacccagagcttgagctcaggtacatactcaaccttgccggtgaagggtagcatccatttgccgaggtggctccatgtgaagctccgcatgtccatacaataggtgccgacaccttttacagagatgcagatgttcgagccgtcaccaagcaaagcataggaactgatctccaggtacctgcccaagtatgctctgtcatagatacatggcggtggcaggaggatctggcgggtccaggacttcaaggtgctgcttccacgatagtggcagtagatgaaggcctcgaattgattgtttcctaactttcctgttttactcctcttatccattatgtaaaggttgccaccgtcgaagtcaccggcttcctccaggcaggggacgaagatggagatgggtatctccttgggctggtgaagacagggcagcataaccacgcgtcttcttccgcctcaaagataaagcagcgtcccgactggtctgcacacaccaccctgcgatcaaaaagcggcaagcagtctatcttccaatagtcgtcaatacctgaacgtgaagcttggaagttgaagatggggcttggaagttgaatcctatccatgctgcttacggtggcggtggcggcctcctccttattattgttctgcttctggatgcaggcatcagccgcgacaactttggactctggtccgtttcggttcggtggagtagcgttgaagaaattgtggagcgtgaggtcgatgcagcgcagcgatttggattctgggaagcggctgtccatgatcagattcagaaacctccgagagagggccattatcggagtgaacttcaagataaaaaataaactacaggaaaagcatttgttaccaagaagaaggatgaaatcatcaaaatcaaaataaacaggaaagatttgtttaccaagggaaggggaaaaaacatgcctaccttaggtccaggtacagctgctattgtgagggaatgagtgattccagcaaggaggagagcgtatagctgcagggttggcaagaaggcatcaagtgagcagccttataatcatcagagagaacaaggaaagagagtggatgtagatctcggagaaagggcatacctcgccaagccggagaagggaaggaggagcacccagcacccccaacagaatggcggcggccggcggggatgggagtagggagatctgctagggataggttctgccgaaatcgctaaaaagcgatcagtcgcgggcctcccctcctgcgcggcgcggccacgtggcacgcgcggagagggggccgcggtggaacggcgcgggagcgccgtgcgcgcgtttctcgttttctttttcgttttttttctttcggtttttcttttcgtttttttctgtttttttccagatttggcgtttctcgttttttttctttcggttttcttttcgtttttttctggttttttttctatacgtggtgttttttttgtttttttcttggttttcggttttcaaatatgtatgtatttacatatatacaaagtttgtatacgcgtacacaaagtttgtatacagtagtgtagtagtagtatagtagtacaccgaaggtccctcaacttgtcatcgagttaaaaaatcatcctcgaaccgtaaaaccgaatacaacgcatccctcaacgtacaaaaccagtgcaaactaggtccctcgggaagaagaggctgacacgtgggacccacgctgagtcggctaccatgtcggacaaaaccggagtcacgctgcccgctgttctccttctccgcgctagttgttcttctcctattccagccgcaccactagcttgccgcgtctcacgtcgcagtgaaccagcaggtgagcttggtgctggatgcggcggcggcggaggcggccggggtcggggtcaggaacggcgcggtggtggacatgggcgacgaggaggagaaggggagtaggtcgaggcggatgctgatagtagtgacgacaacgcggtcggatggcggggtgcggcagcggcgcaacgccgcgctcgcccatgtcgagaagcaccgcctcttcagcgtcgtccacttcgcccacgcaagcggtgtctacgacgcctatttcttcgatgagatccgccagatcgagcgatgtcatggccggtgagaaggtcgccgcccactggcctccccaccccccttgcttgccctacctcctccctcgatggcggcccgcctctgcgcctgcggcctctgcaatggcgggcgagagcggtggcggagcagcggcggcggcgcgtcgctagttgccaagcgtcgccgtcgtgtcgaccatcgtcggccgccaacgccctcgtcctctccctcctcgccccgccgaaggcaacagcccgccgacgtcctccctagctgcctacccaaacaggagaagagtgagagagagagagaggagaaagggagaggagggagagggtgatgacatggccagctaacatgtgggggcacacgtgggtcccacgctgactcagccgccaagttagacaaaactgggttggaaaaccatcgagggacatattgtgactggttttggttagttaagagaccccgcatatctggttttacggttcgaggacgtttttttatcctgatgacaagttgagggaccttcggtgtacttattccaactatttatatatactagcaaagtgcccatgcgttgcatcggcaacactcaaatttcacgagatgattaatttttaagattggagcactttaaaagaatgatattgctagagaaattacacagttacaactcatccctaacaaataaatcaatccaaacgtatatgacggatctaccttctatgacagataagtaaaaagcaaggaaataaaattactacttcctctgttttataatgtaagtcattttagtatttcccacattcatagtgatgttaatgaatctagataaacatatatgtctagatttattagcatcaatatgaatatggaaaatgatagaatgacttacattatgaaacggagggagtataacacttccattgaaagtaggatgttcggcataatttgtttcgtatagaatggcacacaatcagaaaaaagccatgaagcaaaataatcaagctaactcaaataacttgattagctcaaattctaagataaatacttaaaaattaaatggaaaaaaaatacaacttgattagctcagatcttgagataaagacatataaaaaataaaagagaaaagagaaagctgtcatctcgttgtcgtcgtccctacgccatttggtgcctgaagggaagttcctcggcccggtgcagttctccaccgccgggtgcatcgctggcttcatgtgtgtgcgtcgtcgtcgtcgaggggaacgacccggccgccgtcggcagccaggagatcgcggtgccctaccgctatacccgctactcaagcacatgcagcaggcgcaagctagggcatggagatgtcgaggaggacgaagctgaaccgtcttcggtatgtcgtcttgcccgttgctgacctggcgagctcgttgccatgggccggctcgtcgccactccccctgacgttcgcgcttctccccaacggtggcccgacgtggagcggaaggcaaaagatgaggtagcaccgatctgatgaagcggaaaggaagggaagagaagagatatagtcattgacaggtgggctccacaagatgactcggcagcttagaccaagtcaaagcgtcacatcagcgaaacctcccttcaaaaccactgatagagttaaattaaaccagttctaatagttgagtgtaaagatatgtggtattgtgattcagggatgtgaattagattgaagttactccctccatccctaaatgtttgatgccgttgacttttttaaacatttttgaccgtttgtcttattcaaaaaattttatgaaatatataaaactatatgtatacataaaaatatatttaacaatgaatcaaatgatagaaaaataattaaaaaatacttaaatttttttgaataagacgaacggtcaaacatgattaaaaaagtcaacggtgtcaaatattttgggatggaaggagtatatgggagggagttaaaattaggggtgcaagtggggctggctttttttatggcccgtagtcccgccccacaaaaaagcccgtaaatttgcgggcgggccatcccgtatggttttgcaaaattgtttggcccatcccgcatagcccgttgggcgccaccacattagggcacgagactgggtctctgggagacgcgagacaccgccgcagccgagacgggagacggcggcggtgctactctcgtcttcctcgtcgcccatccatcttcctcggcgagacgacgccgcagcagccatccccaacccccacgtgtgttcggtgcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttcttcaagatttgtttgttcttcaaggagcaggggatttgtttgatgagaagtgatttctactcgtttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaacatccttatgtaccagtttgatgtagaccatgtgcaccgggcttcatccgagctgtcgatggtcgcctggtcctttacgttgccccatcacgccggccaatgcttggtggctcaaggtgaggcatggactatgagcagcaataccgtcattgatttgtcccgcggtcccgccaataacttgttgcacctccttgatttctctgctctagcaacttgtgcgacttttatttttcttcttttttttctaggattatcggctggtttagttctaatgcatgcaagactatgattgctcgattgttttttcaatcgatctttgatgttatgatttgtactccttacgcgattaggattttgtatggatctctctctctcttttgctttggttgttgtacgcgattacgcacgtgcggagacggagggcgtcgctcggtcggactcacggacgaaaaaattatgatgatcagaaagttacttatttttgaagtagttaatgtgtcccgaaataataatgatgttttcgccgataatttagtacgtcgtccgtatttgagtcggtttctaagttcgttcgtttttttaatacatcaagtatttatcttgaaggttagtgaaatatgcgttgaaggttagtgaagcgcagggccttgctaggggtgaaaaaaactgaccgctggtgagtcgatcatcggattctactctgcggtacggtctggggtttatgaagatcgattcttgttttgtttatccggtctaggtacccgaaaaagccgaaataccagatgatcatgtgctttcccactcccatcatctatcccatccctactcccagcgcttgagctcccccatccgccgtccatacatccatcaatggggtgggaaaaaaaaagtccaaactgaaagagcatgatggagactgaaaatatcgagactaagaaattccgtcgtaagtatttaatttattttagttagcagccttcattaaccgaaacgagaaaaatatctctttttgtctgacagagtacattatactccctctattcgaaattgatctacatattttaaaggtacatcaagaccaagaaaagttaataactctcttatactatatttactctagcaacaaactcaatgcatgcaccatccccactattttctggctaatagcaaatcaagatattgtatgtgggttataaatgcttatgtgcatggatgcatgcatcaatgttcatttactccaatgtacaaataacaaatagacctaatgaatgaacacaaatatgtagatcatttaggaataacctcaaaaaagactatatataaatcaatttggaatcgagggagtagttaatctattgaatggaagtaggagtacgtactactaagagcaagtctaatagtacagcccactactagctctaattcatctatagccaatttaatagctaattcatacaatagttgtttactatactattaatatatggtcccacctgtcatacacacagtatgtcttaaagtctgtgctgtagctggctacagatctgtagcccgctgctcttatctctcattgtatatctcattaaaatatatttatagctggctaatagcattagcctgctattgtacctgctctaattgaatagtacgagcacccaccagtagcaagtggtcccatcgatttgcacgtcgtgttcaccaaaatactattttcggttatttttgtaaatagaaatgtttttgcaattttactattttctcagaccaaaatacccttgatgtagaccccacctgtcattccctctccccctctctttcccctcttcctgtctcgaggacgggcgccggtggccggcgagcgtggcctaatgcacgtcgtcgagctgctcctcggtggcacggcggcatccccggcttggaacacctcgaatttcgagaagcacgggcaggggaagggcactcataagcagcgcccggacgagcgcggcgtccccgttgccggcggcgaggaagagcgcacgccttgagccacaccaccccggcgtagttcacgtccgcacgcccagacgcgagcagctccccggcctccctcaaaatatgcggtggcgatgctctgctctggtcttgctgagttgttgcttctgctggtcgccacatcttgaggagtaggggcagccagcgacaacagtagcagtggagagagttggggaagatgagttgctgttgctggccgaggcctaccagagcgccatcgcggatgtccgccgcgcggcgggggcttccgggaccatgggttaccccgagggcggcaggcgcctggatgacgagcccgtccacaaggagctgcacggtgttccgcggcgaggagacccacgtcgagcgcgtgcgcgaggtcaatggcgaagccgacgtcgagcaggacctcggagatgcggacagtgatggcgtggactacctcagcggcgatgaggactacgtcggtcgcgagatccaccggccactgcccgcctcccggccgccggccactgcccgcagcacgccacccccaccagccgacggcgtcatcgagagaggaaaagtggtaagagagagggaagagactatgacaggtggggctcgcgtcagaggtattttggtccagaaaaatataaaattgagcaaaaacatttttatttacaaaaataaccaaaaatggtattttagtgaacaccttcaatttaggatggcattccagtgaatcactttgaagcggtagcatttcagcgaaaacattcttttatgatagtataatcccaattttctccctacagagaaaattgggattaaaactcccaattcatcgctgctcccctccagcaccgcgcctctcgcttcctccgtctctggtcgcgcctctcgctgcctccacggctccaccccatccgcgccgctcgctgttttcctccaccgcgttgtctctatccccaccggcaccgctcgctgcttccatgcatcgctccgcagctccggcaaccggattagggacggaagggcgcggggaagacggagaggagaggaggcagatgaggctgccgcagccgccgccgctcaaagcgtccagatctgggtcgtcctctccgattcctcctgctttctctcatccagcatgatcttgtggctataagatctggcggcggtgagctcgggggcgcctgatccagcaacccgcccgctgtagtcgttgaagaagagggtgaaaaccctcaagcggctagaggtagaccaaatattagtttttttaattggtatttttatttgttttttaagcttttgttcttgttcttggctttgtggtggtagtattaaagctatgaaactttgggacaattattccaactttgggaggattttgttaatacaacttggttttcctttctttgattctgaggatgcaaacaacgatcggggttcaggacgatgggcgcgatgggatttgttcttgactgttttatttatttcggattcttttcgatccgagtaatcgggtatgatgcgcaggggtggaggggatcgtgagcaatgcggacaattagcgcttacacggacgaaaaacaagtgacgaaaggaaaaatacgaatcttttaattaggttattagttaatataagatataaaaatacgaatcttttaattaggttacccaagtcgggtagacctatccctagcagatctccctactcccatccccgccggctgccgccattctgttgggggtgctgggtgctcctccttcccttctccggcttggcgaggtatgccctttccccgagatctacatccactctctttccttgttctctctgatgattatataaggctgctcacttgatgccttcttgccaaccctgcaactatacgctctcctccttgctggaatcactcattccctcacaatagcagctgtacctggacctaaggtaggcctgttttttccccttcccttggtaaacaaatctttcctgtttattttgattttgattttgatgatttcatccttacttcttggtaacaaatgcttttcgtgttgtttattttgattttgaagttcactccgataatggccctctcccggaggtttctgaatctaatcgtggacaacggcttccctggatccaaatcgctgcgctgcatcgacctcacgctctagaatttcttcaacgctactccaccgaatcggaacggatcagagtccaaagttatcgcggctgatgcctgcatccagaagcagaagaataataataaggaggaggaggaggccggcgcaagcagcatggatagtattcaacttccaagacccatcttcaacttccaagcttcaagtgtggcccatcactgggagattggatgcttcccgcttagaggtcgcgaggtgctctgcatcgaccagaatgggtgttgttttctcttcgacggagacacacgcaacgctgttaccatgcccggcctctgtcagcccaagcgattcccactctccttgtttgtccccagcaccggagttgataatgacagcggcagcctcttcatcatggagtctgttgttaaaccgaagtcgacaagcagtgggccgcgcagcgatcagtttgaggcctttgtctaccgcacgccctcccctcgccgccacctttcgtccacctgccaatccctccctccaccccctttcgtccgagaccccaaattctccaacatacgcaccaagatcacctcgtacgcagtggttagtggtggctctgagatgtgcatatcggttgaaggggctggcacttactgcatggacacagtgaagcatacatggaggcatgtcggtgagtggatcttgcccttcaacggcaaggttaagtatgtacccgagctcaagctctggtttggcctctctgccaagaccaaccacttggctgctactgacctctccgccatggacgacgactgcttccagcagccagagctattgaaaacttggatggagctttccccacccaagaattggtgggatttatccaactctcatcttgtcagtctgggctctggcaggttctgcattgcaaggtttttctacactcgccatctcatgggctactattatgatcaaatagttgataatcgttttgttgtcttgactggtgtcgatgtcgtgccgtgtgtccatgatactagtagtggcattgcaaatggcggcacgggggatctccgaatgatcaagtatgagtctaaacttcacgtgcctaatggcagcggtgagatcgagagagtgttctgaataatttggatcttgcgttcaactctcttatctattactccctcaatctctaaatatttgacgccgttgacttttttaaacatgtttgaccattcgtcttattcaaaaatttaagtaattattaattcttttcttatcatttgaatcattgttaaatatacttttatgtatacatatagtttacatatttcataaattttttgaataagacgaacgattaaatatattaaaaaaagtcaacggtgtcaaatatttagggacggagggagtatgtagtatgtctaaataattttgggactagggctgtaaaagacatctgggtattccgtttggtttggtagtgtgtattatgtcctattttagtttcgttaatttattcctgagatattgatgttttctgtcacctacggtagtaccctttccaactagtaaggcagtcagcgtgcacgtaaccaaacaaaacactcaagtttatatagaaatgcagcaacatcaaattaatttaattaaaattatctttgaatatacttttgcaatagtttgtttgttgttgaaaatagtactacctccgtttcacaaggtaagttattctagcatttcctatatttatattgatgttaatgaatctaaatagatatatgtgtctagatttattaacatcaatatgaatatatgaaatgctagaatgacttacattgtgaaatggagggagtactgttttttctttagatctaatcaaacttccaaaagtttgatttgtaaaggtaaattcctttcatttgataacagagggagtactacagaatccatttattaagatactagtgattgcgttaataaaaaaaacacaacagcaaaataacctattttttggcttgcaagcatacaatgacagatttgagatttctggagagagttattgtattgtttatattgtttaactaagggggtgtttagatctatggttgtaaagttttggcgtgtcacatcgaatatatggacacacatttgaagtattaaacgtagactaataacaaaataaattacataatccgcatgtaaattcgagacggatttattaagcttaattaatccgtcataagtaattatttattgtagcaccccattgttaaatcatagagcaattatgcttaaaagattcgtctcgcaatttacacgcaatctgtgtaattagttatttttttcgtttatatttaatactcaatgcatgtgtccaaatattcggtgtgagagggtgaaaaattttgcgaggggatctaaacagaccctaacaatatgccggtactaacgtacggtggcatttgttcttttaactttcactatgttgcttatgaaaagcaagtgcacagaaattgcttaacaaaagttttggtacgtagcctcatttgtaaaataacatcgcaactttgaaagaaaaatgatatgccttggtcttttttttttttgctaaaattactaaaacatatatactggctttcatttggtgaataaattcatataacatttgcatctggtgaatagattcaggcaataattgcatcctcatggtaaaaggaggaactatggagacgacatcatgagaaaccttttcacacttactgcgtctgaatttcatttcctggagtgttagtcatgtacctcggctatgtaacagagtagctcatgaactggcagctatgggtagtgtctgcgatccgacggaggcccctgttttggctcctattccggcacaaatgatgtacctggttgttgatgattcagcattgtcatagtaatggaaatcctgatttcccctaaaaaaaaaaacttttcacacttgcatgcctatcttttatttattttctgtgatacatgattaagatggttaactaagatcttattagtgctgatgagcaaaccaactgcaaaattcccaagaggttaatttagcatgttggcaaactctatgttggtcgttagacctcaaacccagagtataaacctcattattatgatagttgatttttgtacctaacatttcgtcaaaataatacaacgcaacttttctagtgcatgcacaacaatttggtccatacacgaacaagaagtctgcccgttcgtcatgggaatatcttcaggaagttctagtgttgcgctcgcaattcacacgaacaggaacgcattgcacacgccacgggcctccctcttttctgctgctcctcctcatctcccttttgttgtgcatttgctcacatgatcagcaattataatcctccaaaaaaactttagctccattcaaattatctttcaattctccagaatgaagcataaaaagttaaaaactgctttgttccaacgcataaatgtagaactagaagctgtaaaagaaatgaggtatttaataaagctaagtaatttgataggaatacagaactgctgattgaaacttgaatactccctccatccacaaaagttacacatatttcacatttgagtttttctaaataaattgttcctatttgtagtctttatgcacttaagacttaaatgaatagataaattaaatatttgattagaactcaaggattcatctaaatactcattggttgcatgattgcatttactctttaattttgtaacatccaagatgatttaatttctccttggtcatggtaacaaaagtaacaggaagtaataggtgtaacttttgttgatgaagggagtataatataagtgataggcatttaacattgtaataatatatactccctccgtcctataatataagggattttgattttttgtttgtattgtttgacctctcgtcttattcaaaaaattttggaattattattttttttgacttactttattatccaaagtactttaagcacaacttttcgtttattatatttgcataaatttgttgaataagacgagtggtaaaacaatataagtaaaaactcaaaatctattatattatgggacggagggagtaatataatataggaaaataattatatactccggtgagtacgtacacatgcttcagtcgaccgtccatccattcaaccaacgcagagatcacatatccgatcgaacctacacagccaaagagatcccgggataatttaactaaccatcgctgattatttctcagtaaagcgagacatctctggcgaaacagacgcggtggcgtgcgtccatggcgctatccatcggcaattcggccatgatgccagcgcgatccgtcggcgattcggccaggaagcgaggcccggtggctacaggtaatccatcggcggtacagcgacgacggcgtggtggtccatctcggccgatcggcgtcatgacctgggcacaactaggcactactcccccgtcctaaaaaaactcaattcctgagtttccatgtctaacgtttgactgttcgtcttatttgaaaaaaatatgaaaaaattaaaaagataagtcatgcataaagtattgtttatgttttatcatctaacaataaagaaaatactaatcataaaaaaatttcatataaaacagacgattaaatgttggacacgaaaaccgaagaattcggtcattttgggacggagggagtagcatcgaaggagatcgtcttccctgtcgttggtaccaatccttgatttctgactgctagatattctaattcatggaatcatggtcgcttctaaatctctgccatcttttccccactttcgcagtgagccagggatcaaacagaaccgtacgtagtatcaatattggcagaggcttccataacctggaggcaagctgtccaacgatggcagcttgctcacacggatcctcgattgacgatggtgtctagtcaatgaatcacggcaacgtccggtagaaacctatccgccgtatcttgatggatggcatgtacccggattacaagggatatcgcatccttcttaccgccgatcaccctgcccctaaataaaggggatcggcagcactcctagggggttaggcactctcttcactcaacactcaatacacagataatccaccaaacaactggactagggtattacctatcctgagggactgaacccgtataaataagtgtcaccatttctttctagcatctagcgcaccctataaattttattgccgatcttagaaatcgacacaagtgctaggaggccctcgtactccaattatacttatttcaatttcagctgaaattaatgagctcacatactcctattataagtaaaaacttgccgcattattatgcagtgttctaaggtcatacaatctgcagttttgcagttactgaaatgttcacagattcaggcaactcaatgctcagcaagcaacaacaaccactcatataccaaattagacatttgcaaccaggttctcatatatccctgttcagcacatcagaactgctgaataatgtttcacctttttttatgacaaaaatcaagattacataatcaatttccacgatacagaacctgagaaccacacaatacagaaccacagagcaggggcaggggcatttcacaatacagaaccacacagccttgggggcattttcgcaaacacctcgcggacacaggaaacggtgcagcgttctccactggacgaagccgtgcgacggcgtcccccctcgccggtgacgaagtgggtgactgaccggtgcgggctcgtacgctgaaccccatcaacgagtcgaggccgccgaaattggaggtgcggcgcgggcggagtgtgttcctgacgaccggtcggagcaccgcggcctcctccacccgccgggctcgggatgtggccctgcccgcctgcatcagcgcgccatcagccctgccggccggccgcctccacgcacccccggtcgcagcggcagggcagggcggcctggcgcctcttcggtcgcggcggcggcgctggcggacgccgatctggagcgaggtgcgaggccgtctcaggccgcgtggcctcctgttaggcatttgttttgcctgcgtgcgggcccaagtaaagcagccgttcgattcggtttggacggccaagatgcacgcagtgtcatcctgtgacatgcatatactaaagctgtgtttgtttcaattaagattattgtaatctagattattgagccagattactataagctggattataataagccgacatagaataaattgttacctgtttgtttctctggattattagttgtttgttagctgttagccacctaataatctaaaaaaacacctttagagtggattatcatattatagtaatgtggcttatagattataataagctatcacaataagctatctgtttgtttcaacttactcctaataatctagattataataatcctaaggtggtgattggatccagggactaaactttagtccctgtcatatcggatgaatttggagtattaaacataggcaacttataaaactaattacataaataagagctaattcgcgtgacaaattttttaagtctaattaatccataattagtgtatgtttactgtagcatcacataggctaatcatggattaattaggctcaatagattcgtcttgcaaattagtccaagattatggatgagttttattaataatctacgtttaatatttataattagtgtccaaacatccgatgtgagagggacttagtaaaagttttagtcccatctaaaaaggctaaggccctgtttcttccagcttgtgattattataatctagattattgagtcagattactataagctagattgttataatctgtattagaataagcggttagttgtttctttcctagattattagagtctagattattgggtttgcaagtctaaagaggaagtggggtggcatggtgggtaatttttcactcaataatctaaaaaaaaagttcacctaaatgagcttatcagattataataagctgagcttcaaattataataaactaatttaataagttatctgtttcttttagattactcatgataatctggattataataatccagaactgcaaaccacaccccaccccccccccccaaaaaaaaaaaaaagcgcaaagcgacgggaggtcggagcgagcagagaagaacgcatttgattcagaaatctccatttgaatctctctcgtctcccctcgatccctagcttcctccctgacaccatgctgccgtcgcacctcaacggccactcccccctcgcgcgccgctgccctcgcctctccgccgcctcgccgccagccaccggggattccgatgcggcggcggcggcggcggacgctccgctggcggagcacgaccgcatctacttccagtcatactcccacatcggaatccacgaggccatgatcaaggtaagccgccatgcccacatccgtacccgattcagtcgccctctccgtccaaaccctaaacccccacaacccctgggccgacccgtgttgtgagtccgaagtcgcgatttggtggggatgacgtgtgttcggtttcgttgggcaggatcgcgttaggacggatgcttaccgctctgccatcatgcaccaccagaagttcatcgaggggaaggtaaatttgctcgccgaattgggggtggatgattattgcgtgctgttgggattggattacaaatttcggtgattgatttcgaaactttatgctatgcaggttgtgatggatgtggggtgtggaactggaatactctcggtgttctgtgctcgcgctggtgcaaaatgtgtaagctacaaaatccctgtgctgagatgattggccaatttaaatgcatagcataatgtttggatcatgcttgcaaaactaatttgaccgtgctctctcatccagtgaatcctactttagtgtaaagaagtacattttgtgctgattcagaggtactagtatagttttgcatgcttgcaaattgagcagcgataagtgttgtaagatggatttttttcaatgcttcattttgttgtgctatacaaaaggaaaaaccagctcagttcttgtttgtgaaagaaaaacagcttttaattttatcatttctatgtcctaacaaaagtgacatggatctgtgtgtgctaactaactgatggcagctgtgtttttccctgattcaactagatgttaagtcttgtagtatatggcactcttaacgtatttttctgttttcactggtccatttgtctgccttataacagtgaactttttccatgtgtattcaaatggacttacaggtgtatgcagtggaagctagtgaaatggcaactcaggtaacattattttttaggatatatactctaatattaaattgtattctttccatatcttgtttgttgttcttttgttgtttatgtgtggaccatttttttagttatacaatataaggacatagaatacacggttgcaaaatgacagcactcaagtgtattcatgaactaggtgtttgtagtggtatccataacaaagattgacagtgaagcttcctactcatcttctataaaataccagttaccagttaatactaccagtcacaactcacaagagagtatataacaatatattaaaatagtgtattgatcttgatctttgcagatattgaatattagtgtcatatttatagtaatctagcggatcatactattttgaaaagtaactactcttatgggtatgctgcggcaaataaatgtactcctttttgcgcaggctcgtgaaattgtaaaggcaaataatctggatgataaggtcgtcgttgttcatggacgcgttgaggtaagattctgcatttatgttttttttggttatatgtattctctcaatccctaagtatttcactggaagagttatctgcatttgccaagtagggtctactagattgaatacaaagtttggattatcagggcataaagcttgtgtttccttctctattttcacatgatacaatctctgagtcattattgtttgaaaatatatttacattagtatttttacatctttactttttttatctgcatttttttaacttacactgaattgacagtgcaggatgttgaagttgaggataaggttgatgtgataatatcagagtggatgggttatatgcttctctatgaggttcattcttttatatggttgttttttgcgtcacaatttgatattctcttatcttccctagttctatctccttctgatttctctagttctgttttcgtctgatctgcagagtatgctgcctagtgtcctgtttgcaagggataaatggcttaaacctggtggtcttatccttccatctcatgctacggtatataattatcacatgtcattttatttctcatgcatgtgcatataaaataagatagacctagagaaaaaaaatcctacttttgcaaccaatatcttacctatcttacatgtgcatacaaattacagaacagttctaagccttggcacaaattgcagaacagttctaagcctgattaactatgtatccttcttttcgatagctcttcatggcacccataacaaattctgagaggtatgaaggaagtgttgatttctggtctgatgtctatggcataaatagtaagttactattgttttgttattagagccgcattatgcatcacattcaccatctcatgttggatgctgatttttgcacactataacttgatttcgtgcttgtactgctacagtgtctgcacttgtgccacttgccaaaaagtttacatcggaggagccctccattgaaataatcggtggagagaatgttttgagctggccatttgtggtgagtcttcacaagactgttgtggataatacttttcaaataaataaccatatttacctgttgaggcttattaacttctttatgtctacttacaggtcaaacacatagattgctacacttttaaggccgaggagctcaaatctttcacaactaaatacaaagtttcatccatgatgttaggtgaatcgtctcttttcctgtataatattattcctgatgccgaatctgctatttgactcgaatctataaaatcttcttcaatcttcatccacatacagtttatcatatgaaacatcaatgctcagctgcatttttcaatgtttattcagttctgaaactactgatcggtctttgattgctcatctttctgtttatacaccatacatatcctatcttaatttgctgatagaaaatatcttccatgtgaagctcccattcatggctttggtttatggtttgaagtggagttcaatggcccttcaaatcccacagacaaatctccttccgatttgaatccactcgatgttattcgtaagaaaaggcgccgaggatcagaagatccagtggtgctatccacagccccagaggatgagccaactcattggcatcaggttctgatttctgaaaatggtgttatccttaattgatctattcaatatattacgctattcctgctcttcttggtgtaaatgtgtaatatggtcatttcttgttctgcagactattctgtacttccctgatcctatagaggtgaaacaagaccaaattatagaaggctctgtaaaagtgtctcagagtgaggaaaacccacgttttctgaatattcaactagattgcacgtaagttcttactagagattgctattttgtcgtccggctcaacacagttgctcgatagatgttataatcttgtagttacatggattcagatttagccaagctacacaagcactctgaattccttatagcatgctctgttttgaattttgtccatggtgtcaggatgtgaattatgctgcccatatgggcgattgaaatttgcaaggatgataaattgcatacattgcctgcttgtgcctctagcggatcattttgttggattctgatatagaagtccctgtttcctagcaagttcgaatttacatttgtgtagtactatagcttgatttagttcattttgagctttggtgcaagttttgttttaagcagctgtcctgctgtatgtatattctaacttggtacaagttttgtttgtgaatgaaagttatataatttctcgctttccctctctgacgctatgtttgtgtacaacagcacgggaggccaaacattggtgaaagattatgccatgcgatgaatggtgttcttagtttgctgatctggattccccgacttctgatggtaagatcctacaacttgcaagagggtctcttccagcaatcatgaactgaggtcattggcaattgatgctgaattgttgtatgcatgttgataacagtaacgagaattcctccacttattttctttcctttattcttttgagtttttccttgtgtttattttttctagttttcactggcgatgtagatgacccgagaatgcaaattttcggtttaagtgcaggggagataggattgcattatttcagtttgtcgaatgctttagttttgtggatgctttttcgttggtatcttgtctgactttgatgtgcttaactccgagtctccgtgtcagcagtcaggatgagagataagggtaaagtgagaagatgggaaaaatggagacgagctgtttttctcttgaaccaaaaaggctacagcataacctttgcctgctgtgacattgagcttttactttcttgagacgcttgtactttagtcattgcgtcagcctgcacaaagtgagcctctttttttttgttggtggtgttccagctcaaagcgaccaatgtggttgaattggaccttttggtttcacccaatcgtgaagcaggatgtagacttaagattttctgtcagatagattgacttaatgaatctcgtgatattcttctttcgctgcagtaataaactatagttaacgtgcctgtagattaaagctgctgtagccatcgtaaactttaaccccttgaattcttacttcccggtgttgactggtgagtgctgacagtcaggtgctttgagcgtgcagtcgtgcgtgtgttcacgtggatgcgactgacactggtcttaatttactaatcttttccctgacactgctctgtttgaagtttccagataaattatgttaagcgtgatcttacgtgtgcatcatttcccgcagcaaatggctgctagcgttgtctccacatctgcacaggccacaagcccacaacaggtcaggttgaaatgcaaaagctgatgtgctacattattgttcccaggacatcacccctaacgcaagcaaagctaacaaacttgttacatttgtctgcaccaggggctgtattatcatgcatacagatacagtggtagaactgaacctgtcaccaactcaccatgcatggttaactcatcattcttccaacttgcatgcattgcacagttgcagtacatattacagtacttggccatttgacaagttcagaacttcaggaaaggcctaatagctgcactttctctggacaatacttcctccgtttcacaatgtaagtgattctagcattttccctattcatattaatgttaatgaatctagatagatatatatgtctagatttattaatatcaatatgaatgtgggaaatgctagaatgacttacattgtgaaacggagggagtagtatctatctatacataatatgtacggtcatactccgtatgtgcccatacttggcaagcacgtgtgtgccactcgaggggtatacgtgctacatgtggagtagtaaagtataggtacttggtagcctgatagcgagtacgagtagtgtactgcttatatatacttctagcatgtattgggtccgaagccgacgtatccgttggctgagtcgacggtgatctggatcccttcctgctgtatgttccccaggatggagatccccgacgacgacggcgcgaacgccaggcagaacacggcgccgccgacctccaccagcaggttcctcgccggcagcgtcagcacggcgccctggtcgaagtagaacgacacggtcggcacgcgcacgctcgcgtacccgctcaggtcgtagcacgtgtcgagcagcgacacggccggcgagcgcgggagcgcgcccatggcgccgtcgaacgcgccgcgcagcgcggcgtacgcctcccgcgggaggcgcgtcacggccgtgccggtgtccatcaccacgccgccggcgccgtcctcggtgagctggaacaggctgtcctgcagcggcagcctctcgccgccgacgccgatccccgtcagcccgacgtagtagaagctcgacgcctggttgttgcgcacgagcggcacccacacggcgcccacggggacggcctcggtccggccgaggacgagcgacccggcgccgccggcgccgcggctcgccaggcagtagctgaacacgccgcccgccgcgccgccgagctggccaacgagcgacatggcgccccagccgaggccgagcagcccggccgccccgacgaagaggccgctgttgcggtggccgcagccgatggcgacgccctgcaccgccgtgccgcctaacgtgagcgtctcgagcgcgagctcccccttggtgtacgacccgtcgccatacgtcaccgagtagtcgcacttccccgcgtcgccgccgccgccgcacccggtgcccgacagcgtccggcagatggcggagccgcacgacacgccggagaaggacgacgaggcggccgggtcgaacagcgggtcggtctgcgcgtagcactgctcgcaggggcggcactgcacccagatgacgtcgctgccggagtccacgacgaggtactgatccgtgggcggcgagccgacgccgacgcggacgaagtactcgccgctgccgtcgtcgacgccgggcaccacctccgacaccaggtcctcggggaggtacggcgacgtcgaggccaccagccgcttctccaggtgctcgacgcgggcattgtcgcgcgcgacgaggccgacgacttggtgccggcgcgacgggtacgtggcgccggagatcgcgtcgcggtgcaccaaggagagcgaagggttgttgttgttgcggctacggtgaacggccgacgccgacgccgacgacgacgatgacgccggcgtggtgaagttgtgagggttgatgtagtggaagcgcggcggcgaggcgggggagacgatgagcaccgatgtggagacgaagaggaggaagaggatgaccttgccgttggcgacgaactccatggttttcttggcacgttttttccctcttggtgtagttgaaatgctttgcaagtgtgtgaggaggcgcgggcgaggctggtgaatttatctctctgtgcctgggagcctggccgtggcactagtgcaagtctcaaagtgtcaaggtctgcaactagtgctatgtacttgtacagatgtagtggtatagttgttgggagtagatgtgtcttcacctttcggatctttgacgctatcaattcttccatgagtgaaattcttttgttggaagagtgaaactatttcttcatgcatgatatcaaccactgttttaagggagaaaaaaaaagttagggagttgatcaaccagagtccagagcccaagactcaagcaaatgtagtttttgcttgcaaaatgcagaaaagtgaccgactttttgctaccgatggtttgaagtttagaacctggacaacttctctgggttcattcagaaatttcttcaggaattaacttgtcacgttagtaaacttttccttatcggtgatcacatcctgacacaatggaaaaaacttgaagacaaaagcattcatcagcctaactcgtgcgtgcgtgcagcattagtggagttggattacagtcagtttgacagcgaggcaacatgattcagttttgtccgtttttgggtttttgaatcttttaaggtgatgcctttaatagtttgcacgaacaaaaaggcctttcgcatttagattcgatatcgtcctttgcctttcttgatgcttctttttcttcttcgccggcagatgcagcacataaacgaatattggtatgtatatacttgctaattccagctctgacagaacaagttcatgaaaaaatgtggcaagttaaccctttgataccacatttttcgctgtaattgtgacagatttctggaggcatgcagccatggaactcaagtactagcacaagtgtcatgaactgaacctactcgccaaggtagaaaggaataatctttattaatcatgcctattggagattgcagcatggtgacgactgacgaggactaactgattgtgttttgatgagaaggtgctttcagatgtccctctagcctgtatcgatcaaaagcatgaagggaccgcacaaaattaagctccagtttgcatgctggattagcctttaagattggttctgaaaacaacaaaaaaaattctgctagctgatattcaaattagcaggtactgagatacttctgcacatgctcaccaaggcagggaatcatgtacagatacaaaattcagcataaaaatacaacagagtctactatacaatcaaacatgaaaagtataaacagagtctagtatatatgccatgctgcatctagaaacaaaacgtttgcatgcatgcaattgataatcaaaacttgattacaagaagaaagttactatcattgttgtctttttccaactaattatgatgtgccagtgagtgggatgagttagaaagttaggtttcttttggttacttttgtaggctgtgtggagagggattgtgtgtaagcatatactgtactaacatatcatcatctaaatatatgcaaacacatgtcattgttcaaaacatgacatctgagtcggccgtctttttgtcgttgaaaacaagttgttcagtccctttccaagcgttttcgaaatggtgtgctcactataccaaccattaaataagtagtagtagatcgatcgagttagttgaagtgttgaacacaaagttggcagtccattgcgtgctgaaagattaattagcgtatgatttgctcctgccactagtactatcattctctttctctaatctctgcattgtgatcgctgttggttgcatgcgtggttatcaaaagccggcgacaaaaatggtgtctcattttgttaacttgtacgatcgaaaatgacagattcacgccttaacctgtatagttaatctcatatctttacatgagcagcaaaaatattctcaaatgctacagacatttgcatatataccctctacgaaatgaacaccaaattgactcatgtaaagcctcatatattccatgtaaatattgtgtttcagtttgattgagagtttaacagacaggctcagttctgaaggactataatagcaacagtagcttaagctatgacaagtacatgtggacctgccaaattaggagctagcactaagttgctagccaggtacggacacacacaatgctatacggcacaatgaatcagttggtttggcgaaaaggaagggattggttaaacaaactgaaattcagagctagcaaagcatgcttacatgaatgggtgagtgagtgctgaaataatagaggtgggcgacaagaaactaattcaggtttggttttattagtatgtagtagtggggatgttaccagcagcagcagcaacaggtagctagtgaaagagcatgagagaaaggattaactaatgaattaatcgaggttttttggttaactacgttagcgcctcagcggtgggaggcactcatctagtacacctgtcgaattattggaggaaggcaatcggaccaaatcaacaacaaagggggaaaagtggagaaaaataacgagcatgttagtgttgataagataatttttgtttcgcgaaagcataagaaaatttttttcgatggttccaaaatccaaatgatgtgctcttgctggtgatcatacatgaacggtcctcccatatgcaccatggcggcgtgtgttatgagtagtttggtagtagacagtttgacgcatgtttcttttcttctcatcgggatgaccagaggaaagaagatcattcaaatattattaagataaaaaaatgttacaagaaaattttacattctaaaactattaacagatgagccgagacccaaactaattaccgctaagcgaacacatgattatgttccgcttagcatttgtgagagtcctctgcttccgagcggtagtggcggctacaacgaatcactgaagcgattcgcgacgtgggcacttcacttcgtagcgttggcaggtcgcggataggcccactcctggggggcggaaatgggcatgggctcgagaagagctaattgggctgcccgtgcgcgcgagcggctggagctggccgcgccgcagatttgggctcaacttttgcggacttttcgccaggcgtgatctacccatgtcgacccacggctcggcctgggtaggttggaaagtttatgggacaacctgcacgcgcggcctgccgagaacttcggctccaccttccgcgggatacgggtgcgtactgggcctcggcctgcagcagcagcagcatcaacaagtagcctgcaaagcccaaaaggcaacaggttgctacttcttcaacttgtttccgaacagggccggccaacgcatcgatccatccaacctacatctgcgccgatgcagcgttgcctcgagaaatccccgtcggctcgtccccgcaccaaagcagagcagcctcagaaagcaaagtttgacgtcaggtgatagatagattagcgcatcatctgatcaatcatcatcgtcatgtactaaagcagagagccctacagtacagctggtgttgtttgcaaaagccgatcaaaggccacgatttcagtgctccctttttcggcttgcatggacgcaaaagccacaggatcggcggccaaagctctccccatccgggtcccctatctccgtatacatacttcctccgtaccacaacatagtaacctagaattagatatgacatcatctagtataatgtatttagatatgagatatatctcgacacattattacatgtgatgtctcattagtcttaggttgctatattcttggatggagggagtatatccaccatcgatgctgcttcagtctctctctgggccagctctgtttgttctcgcaaagctacacacaccacagcacagccttgtacagtgatactaacctcttcctctgtcacattcatttcagagtttcagataaagcgattctcctcccagctttgattaatcattttctaactcaaagagaacctccgttagtcaagccacgacggaaatatataatttacagaaaaaaggttttattccgaatgcagcataagtgagtttcaaggcaatgcttgagtacttgttcagagttcagatgtgaggctaagaatcttgttcgatgtacaatggtagatgcagaaattacgtatccaatactagtacttaccgacacaaactgtacgcttagctaatctgtaacgaaacgtgacagaaaaaactgaagacacgattcatacatgggaaacgaaatgagtactaaattttttgaggaaatttcacaaaactacaggtattttgcacaatttatcataaattaaaagtttgtttcacaaaattacagatttagtatttccgtttatcacaaaactacaagtactttgtacaatctatcacaaaactacagatttaagaacttgttgacaaaactatagatttagtgtattcgtttatcaaagaactacacatttagtgttttcatttatcacaaaactacaaatttagtgtctccattatcataaaactacaaatttaacaatgctaaaacatatagttttgtgataatgaagacactaaacctgtagttttgtgataaatgaagatattaaatatgtagttttgtgaaataaattcttaaatatgtagttttatgatatatattgtgcaaagtacctgtagttttgtgataaacgaagacattgaatctgtagttttgtgaaataagttcttaaatatgtagttttatgatagattgtgtaaagtatatgtagttttatgaaatttactcaaattacttttacaaactttctataaacactgatgtgtgttgaatctttcagttgattcaatcaaacggttgaaatttttgtttgcaagaaactagctgggtggcccacgcaattgcgcggctagcacttaaataaaatcatatattttttatatgattttacttaaattttattaaatagctatctcattgtcttaagagtttgaaataccaaaccttatcatctacgtgtttctaattatatagttttttaaaagtcacaccagttgctacccctatgtcatctccttctttatttgcttgctcgatttatcactatttctattcattctcattggaacctttagaaattggatcttgtagtttttagagtttattatcacgttgggttcatttttataatttctagacgtcccgtcaaacgttgctattatacttctctatggcccgtccactgtctcttctctttattgtcattgagattttaaaaatcgaacataattaccgtttgggttcatttttactttctataagtcccgccaaaccgtcagcggctttgccttgtacttctctacggctcgcccgctgactcccttctttattatcattgatattttaaaatcgaacatgattatcattttttttactttttggaagttccgaacctttaaaaactgaaccttgtagtttttagagttattgtcttgttgggttttattttttataatttctagaagtctcgttaaacgatgccactatgctcctctacggcccatccgccgcctactctttattgtcattgtaattctaaaagtcgaacataactatcgttggaatccattttttattttctagaagtcctgtcaaccgtcagcggctctgcaattatactcctatacaccccgcccgctgcttctcctttttattgtcattgatattttaaaaatcgaatatgattatcaatggggtttatcttttttgctttctagaagtcccgacaatcgccttgctcgtttgcttcacagcctgcctgtcgttcttccttttaatcgtcattaggattctatttggtgttttattaacagtttttatatgtcatatcaaccgccaccactctactcctttataggcttgttacttaatttatctcgtcatgtgttttagatggtcttttctttcaatagtctttatttttatcacatttttagttatttataaattgtattcctaattgaaatcttgtttttcttctttttctaattttagaatttattttttaaaaaaataaataatatgtatcgtgttcttttaatatttttatttttttattttcaatttcagttgtttcaaaattgtattcctacttgaactctcttttattttttctaattttggatattattttatttttttattctaaattttaattaatctcatattgggttcttatatggatttttctttcaacagtgtttatttttaattccgaatttcagctaattttaaattgtattcctacttgaactcttcttttttttttgctaattttggattttatattccggcttggttcctgagcttccaagcttccaaaaatcatggagtctggttggttccgttgattttaacttggaatcagtatcggtattatgttttacttttttaaaattagagttacgctactactgcttcaaaaaatactgtcatgatacgatttcacgtttgcactgctgcctaagtgcctagtagcatgtagtagtcttctatgttagagttctattccggcttggttcctgagcttccaagcttccaaaaatcagactggagtctggttggttcctgtttggtttattgacactgtttccataaaatatgtagactcatattaaatcacaaccattaatctagatctattttaatccaatggctaatatttttctttttttttccgattaatgtgggaatttctagccactacagcgaacgtggagccttctttcaaagctgttttaataatataatagatagatagatagatagatagatttttcgtacatgtagtactactcttcgtacatacgctggtagcaactagcaactgctaactgaataaccgattattcatcgagtgcaaccaccacagctcgtagccaacatcaaaagccatttttgcgttgcgcccacacatgtcatgcgatccaacatgtcccgcgtctgctacgaacggtaaaaaatcaaaatattttcagagaacgctccgaggttgtttcaggctccctcccatggcgcaaacacatgaacacactaaatgctcgcgacgcgaacgcgaggctcctcttcccgctataaatactcctcacagatcgcactcgcttctccaagaaatccacacgaaaaaaaaaacaagataaagccttgcagtttctgaattctgatcagagagtggcaatggcaatgcaggtttcgaagaagtcgcgtttggctgcgccgagcgctctgcttctccttcttgtggtggccgctctgctgccgccgccgcgcgcagaagcggggcacgatggcgccggcggcgacgacgaaccgcctccgacgccgtgctcgccggccgaccgcgccgcgctgctcggtttcaaggccggggtcaccgtcgacacgacggggatcctcgcgacgtgggacggcgggaacgactgctgcggcgcgtgggagggcgtgtcgtgcgacgccgccacggggagggtcgtcgcgctgcagctggaggcgccgccgctgccgccgccgcggcggagctacatggagggcgccctgtccgcctcgctcggcgggctcgagttcctggagacgctggtgatccgcgacatggcgcggatcggcggcgccatcccggcgagcctgtcgcggctgtcgcgcctcaagcagctctacctcgagggcagcatgctcgccggcggcgtccccggcagcgtcctcagcggcatggcctccctccagtacctgtcgctcgccggaaaccggttcgaggggaagctgccgccggagctcgggtcactcccggggctggtgcagatcaacctcgccgggaatcggctctccggcgaggtgccgccgagctacaagaatctctccaggttggcgtatctcgacctgagcaacaacctcctctccggtgcaattccggcgttctttgggcagcagctcaagagcctggccatgcttgacctcagcaacaacggcttctccggcgagattccggcgtcgctgtgcggcctacgcaacctcactgatctctccctgcgccataacaagctcaccggcgtgatcccttctcagatcggcagcatttcttctctgaattctctctccattgacagcaatctgctcgtaggctcgatcccagagtcactgtttggtctgcagaagctgtggaacctgaacctgtcaagaaacgggttgtcaggttcacttcctcccggaatccgccatggattgccgtctctcgtgtccatggacctctctcacaaccatctcgtcggcggcattgatcacttcttcagaagcatatcaccagcaaggaggctgaccaagaatgcaagctcagacatgtcagtgatctttcttcctcggcaactacaacacctggacctgtccaagaacagtatcaccggagccttgccggagttcggcgccggcgcgagcttgaggtggctggacgtgtcgggcaatgccatcggcggccagataccaagctcggtgtggaggctggtcgggctccagaggctggacatctcccggaacaagatcaggggcaccatcccggcatccgtggcgtcgatggcgagcctccggtggctggacatctccggcaacgcgctcgtcgggaggataccggacagcttcgcccggatggcgaggctccggcacgcgagcttccggggcaacaagctgtgcggcaagataccgcaggccaggccgttcaacctgctccccgccgccgcgtacgccggcaacctgtgcctctgcggcaagccgctgccgccgtgcaggcagatttgaccggcgccgccgtgcgtggcagtgattgctgcttcgccatgggtgacatatatggtgcatttcgatcggtacagcacaagactactttgtgtgagatgttttacgaggtttagagaaatagagtagtagtgcattgtctgatttgtaatatctcctgatcatatactttgtaaatcgggaagttacacaaatctagtttagggtagaggaggatgataaatgttgtggtcgcactgtaaaatgatgacgtggaagtcggtattgggcactgtagctgcgtactaatttcgtttctgtcatacgtatctaattgagttttaatgttttatcaaggaactacctatatatattgatcaaaggagaaagacctgaaaccaggtgtgccatagttgaggtaggcagcatagacttttaatttgtagaccggcccattaagaccttacttggatagacccataccaacggggcggctaaaggtgttctttttgggagtgagtttatactgaaattgcttcagttggggcatgccagacgaacaaattcgccatctttattgccattttcaaagaaattcatcgcgtatgcattttcatatatacatcggtgctcatacattaaacctaatctgagtagcagagcttccaaaaacggatggattcacagaaactagtattggtaaaaatgtaaaaatacacgcctctaccacctgctaatctcaactcaacggatggattcacagaaatggagatggatcaacgcctctacaaagctcgatcagaccttgagcttgaagctgcagctgttggagcggatgcggatctgcctgccggcgacgaggttgtcgacgacgaggttgcaggtcgccttcccggtcatcttccacagcttgatggcgccgaacttgatgcggatcggcacgcgcgcccacaccgtgagcggcacgaacccggcctgctgctgccgcgccagctgcagcgccacggcgctgtccagccgcgtctcgccggcgagcaggatgacggggcgcaccgtgctccggtggccctggtacagcgccgggaacccgccgcggcacagctccgtgccgttgaacgacgccgtcacctcgccgccgtcgtagtagatcccgatccgccggttcgggttcgtcgacgtcacctccacctcgaacgcgtcgctcaccgtcgccgccgtcgcgttcacgtcgaaccgcgtcacggtgagccggtccacgtggaagtccggtatcttgggcttgaacaccgcgtacaggatgcccgccgtggcgcccagcgccacggcgaggacgagtacggcgagcagcgtccagcacacgcaccggcagcaccgccgcccgcggctcctgcgccgcggcggcggcggcggcagcggtgccggcgcgtacggccgtggcgcggtgatcggcagctgctccttctcaccgtagctcgccgtcgacctccccttgccgacctgctgctggctgtccggcgccggcgccggcgagccgacgcccaccgggtggattcggtggtaatccattgcgatggagatgctgctttgcaccgtcaagggaagaggaggacaatcgacgaaatggcagagttgatttggtgaaaacgttatggatgtctaagtacacagtgcaatttatacgtgacgattcgtgacacgttttcgtttttggtttggttaatttggcttctagacgtgatggatttattagtttatcatgttcagctcttgacttggttgccatggctgccgcatgtgtgattgacttcaaggttgctgattactcctcagtctcaaaaaaaaagtgtaattttataccgtccaatctaatatttgaccattttatcttatttaaataattttatgattattatttttattgttattaaatgataaaatatgaatcgtactttatgtgtgactaatttttaattttttatatctttttaaataagacgaaccgtcaaacgttgtgcacagatagctacagctgtacttattttaggtcggaggtagtattatttgtacttattttaggtcggaggtagtattatttttttcttcttgaaattaattggagaacacaagaaatctatgctgattctcgcaggaatggtcatgtccctttccttttaactttctgtgtgttcagattttgactactctttgtacgacgcgttacatttataatcatttacagtagcagctggattagttattgattaattaccgtcatgtgatcgctcaggttatcgccgtgttgcgtttcgatacgaattaagcgacttgcagaaatgtatccctccgtttcaaaatgtttgacaccgttgactttttagtacatgtttgaccattcgtcttatttaaaagtttaagtaattatttattatttttatatcatttgattcattgttaaatatactttcatgtacacatatagttttacatatttcacaaatttttttaataagacaaatggttaaatatgtactaaaaagtcaacagtgtcaaatattttgaaaatgatgaagtatgagctgcgcccgagtgctacccatgtacgctgaatctgatgtcacggtccgtacatcgtgttgaatggttgttgttaaccgagggacggaattactgacgagatcacatgaaaaactcttgaaaaaacatttgctcacaaccataatgacatcatgtcatgcgtagctgccgtcgatcacgaagcttcaggttagcaaagagcaagttcgtcaggagaaataggttgaataattgcctggaagacgcctctctaatctctgaataattaaccacgctgcagctgaccggacggctgcttgtcgtgttgaaaattcagagaggctactgcatcaatttggggatcttcaggcatgacgtgatcaacggttgccgacggtccttccgtattttgtatttacacgacaagcccaacaaactccgtgttaacaaaactcaaatggaatatcaacgtgtgcacatctagtagcatatatataaaaacaaattggtgtgacacgctagctactacctaacctatgtaactcaagcctctccaaaaacatatgtgttttttttttaatggaaccaaaaacatatgtgttgctgctactgaagcttgcaagctacatggtccttcctctgatgatttttataggatgttttgttttttaaaaccggatctttgttatgatttttaataaacaattagtcaaactataaatataactagttcaatacataatattccctcctttactaaatgtttgacactgttgacttttttaaacatatttgaccgttcgtcttattcaaaaacttttgtgaaatgtgtaaaactatatgtatacataaaagtatatttaacaataaatcaaatgatagaaaaagaattaataattgcttaaattttttgaataagacgaacggtcaaacatttttaaaaaagttaacggcgtcaaacattttaggatggagggagtagataaattgcatcatggatacaccaaattgcgtgagtggatgtgattaagtactttatagctaacaagaatatattttatggcagtccatggatagccaaacaatgcatattgcccgctttgccgtcatacactaaaatgtcattccatttcctggtggaatgcaaatacattagaaaaatctgggacaccttatctaattagatggcatgtgaatagctcaaaccgttactaatatctttgtcgttttacatacccgtacttctctatcttaaagttaactcaaacggggcgcttaggtagtgtttgaatctagagactaattagtccctgtcagatcggatgttttattatggattaattaggtttaaaaaatttatctcgcgaattagctctcatttatgcaattagttttattatttatctgcgtttaatacttctaattagtgtcaaacatccgatatgacagcgactaaaatttaatccattagcagcccagacagaagtgtgaattcaacaaggcaagtcttggtttgtggcctctcactctgacttcagtcagataccagctaatgatcagtttgattttcaaataaatgcatagtagctactgcataggatagacagccaaattccttcagtgcagctttcaacaaaaattcacaatacaaaatacgatccacccacaattccattttgcacaatatgtactttccatttcaacacaaaaatctgatcgtatatatcaacatttctaacaacatgatgaatttacaggtacatataatacatgtgtaaagtaccgacatttccgatgtgggtcatctcgatctcaacctcgatgtccatctcctggtatcctgaggcctcaagagctgtacaggagcagctgggattcgcagccaccactctctcagtctcctcaccaacttctcgctgctcttcttcctcgccggcatatgcctcgtgtatgcttccagcacaatcagtacaagtatgcttctcaagggcaggtacgcgaatatcgcagatgccacgagcattgtagctgctactttgttcgtgctctgaccagacaataacaattgttatatagtaattgcagaatgttgcaagatttagagttttgatgtgatggtttacaaagtaattcgtagttgtgagtgataatgtgagaagaagtaacgtacttgagggaacgctgcaagcaggagggatcggagcttgagaagaaaaatgtttccggcttgcacttgtgcctctaattgcgagatagcttgttgcagcgccagtagctgttctacagttcgtctcctaggtggagttgtgacttcaaatgcgcctatcatctgcccgttcccggtatgcctttgccatagcatgaagatggtagaaccaagcagaaagacagggaaaatgtaccaaatccagcctctgcagggtttagtatggaataggtattaacattgctccgtgaaacaaaattttttaactactggtagaagtatttcagttcgttttagccaaaaaaaaaagagaggtgatttcagatattacctgtaaactatgaagaggaaacagaacaagaagacgtatgatttaagtggatcttcccactcagccaaaaagagaagccttttgcctatttcaattaacggaaatagcagttcctgcatattaacagtaaatcaacaaacattaatacacttaataatggcttgaattgtgatcaatcttgatgacattggaagcaactatcagtctacaattattgagcaatctaaaactatgaatggaaattcaggcttaggtatgcctgtacaggtcactcagagctcagtggttgttccagaactcaagacttttcctatctgaattcatatcttagtttagaagattatgagaaaatgacatttagtaccttcaggacagccacattagtgtcgatgtcttccactttgacctgatcaagggtcgccctcgcagcctccactctgccagagtaacctacagatctctctagagccatttgcactgagctagttcctcccgtctgcacatctcggacagtgagatcccattcctcgggattgtcctcctctttgagtgtcaacaaacccatgttcaccaaagtatatgcagaaagtgggaaaggatcagcaagcgtcagatcatctgaactgctttgaacagaatcttcatctactctgaaccttgaggaataatctttcatctgaccatacaatgcttccagtatcttgtcccccttgggcaatttctctgccaaattgaaggcaagggtagtcttgaaatgtgcaggcagtatgtggaatccctccttcaccgtgcggtatctgagaattcctagtgtcgcaacagaaagcgcctcggccttatgtaaattgatcatcctgtacttcctaatgaacttgtgagcgtgcaacacctctttgatgattgcaaaccagtagtctcgacgagtgtgacctttgaattgaggaaattcgaagaacaccggctctcttctgtcaaagtaaaattgtatgagcaaagctacaagatgagcagaaacttaaaaaaaattttattctacagtagtaattactcacgtagagctagatttgtacatgacagctttgtcaaatagctgagcaccccatgggccagttgattcacgttttatagactgcttcaagtcccttgacagatcatacaccacagcctcgttgtatgagaaatcaacactgactggctcaaagtacaaagcatgggttgtcagtgtgagcctccctgcaaaatatgcaccttatacaccttaaggccatagtgaaggaaacaattcaccaacactgatcaaaattaccatagggaggattcttaaccaggccaagtggacgtcccaatgtgttgaagaatcggcttggttgtcgcggcaccatagatatcaaggatcacttctccatcagaaagttgaagagctggagctttgtgtccacctgatatacgtttcgcaaatctcagcaccctaacatcagaaaccagaggcgccatagtaaggcaatcatgcagtgaaagtaaccgagtgcctgaatattcagtaatgctcattgttcaggtttcagagaatgacaataactgtaacaatgaagagaaacaagagaagctggtgccaatgcatacttgtctaaacatttgaggtacttatggtagatgagaaaatgcaggcggcctcccgtagagtttgtgagcgcatcaaataagttgcgaacagtgatcgcgtgtgccattgcaggacacgcaggaataatcttggcaaatgcttcaggactgaccgttctcctcccatcaacctaaatatttcatcaaatgtttggattgatacttgagaaaccacaaaatatgtcaaattgacagagatatatatataacctgaatggccatttgtgtggggctcaaacagaacatggacccacaatcgtcgtcatccttgccgtcaacgaagctaaatgacattttctgttatagcgtatcggtttctgatcagagttgcgtatgaacaacaaacaagatggtgatgttgaattgggggtgaaaaaaaaaaagaaaaccggggtgtcatcacctgcaacgcggcgtccgtctcgtcgtcgggggcttcccaggcgatcatcatgtcgtaggtgagcgagtggaactcgctgtcgctgaggtagtcatggcgcttggtctcgacgcgcagggcaatgtaggagcagtactccacgacgctcctggcgtacgccagcggctggtcccccttctccggctcgaaccgccgcagcagctgctccacctccacgccggcgatcctgcagccacgatcgataaaaaaatacacgaatattaagaaataacgacctaatatcaaataatcagaagaggtgaggtttcgaacccaggttgacgtttctcgccgcgatcgatcaggaatcgatcaattaaatcaaattggacattaatccatacgacgaggaggagatgagggagatcataccgggcgcatcggtggacgacggaggcggcggttggggagaggggagggatggcgtagtcgggcgccgccatggcctcgccgtcgccgccgccaccgccgtcgacgcgcggggcgaggaggaggtcctcaaggagacccatctggggtggcgacgacggagcaccaggagggacgcatcgttcgttcgttcgttcgatcgtcggcagtgtgtccccgtcacgccgcccgtttaaggcaagcgagatttgttggagacgtgccgtgcttttgacggatgctctgcgacgcaatgcgatgcatgcgttccgccttgcccttttcgcggacagttaggcgcgcgcgggtttttttttccttctttccttcgtctccgacggactcggccgtccacccagccactcctccctgtgctgtttgccctctcgaattatcggattgtaaacgttattattagtttgaattaaaaaactagttgtatatggtacttaaaagtaaattcgagcttttggttgttctgatcaaccattgttttatagatacagcaaatggaacataataatgtattaccacaaataacgttgcagaatacatagttcatgcaattagtataccgttaaacggctcaggccgccgattaccaaccaagatttcgtaccccggtcaccggaatcttaaacaagacaaaaatccatatggccatatgggcacaccagattcctgatgaatcctgggacattcttttttaactcgtatacaacgacaatgatgccaatattattatcaactccatcgacatcacctgaaaaaacagtaatcaaacaacacagtagctaccagaaaattgtgcaggcatggaatagaaaccacctgccatactacatggcatcgacgataaatagagctctacataatggagttctatctctcctcattttaccagcaaatctatgtaacgaaaggcaccctgcgaactgcaggggctgatacggtaattaaattgtctcccaaagatggactatgggagtaaaaacaagcatagcagtttttgttttgccacttaacccagcaaaatggcgctaagaagacaccgtgtagcgattacttcacgatgcagatcttgatcacggatgcgacgccaatacggtgcagagcaacaacagcatcaccaggcttgcacaactgcttctgtacagctgacttgagagcagcatcaaggatgacctctgtcgactccgaatcggtggctttggcagaaccctcagccaggagaggaacaagacctctgtagattaggctgtgccttgctgggccctccgagctgattgtccagtcgaatgaatcggttgtcaacacggggacaaccacagagaggattggaaccctgggacgatacttggcaaccagctttgccgtggtaccaccacgagtcaagacaacaatcagggctgccttggccttgttggctgtgcgtacagcagaggatgcgagagactccaatgggctcatcggaaggggcgcagacctgatcatctccttgaagacagcttcgttgtcaagggaagactctgcctcaacacatatacgtgccatgatcttcacagctacttcagggtatgctccagcagcactctctccactaagcatgacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaggaatatcttctcaactggaatctccattccaagatcacctctagcaaccataaatgcatccgtttccctcaagatctcatcgaagtttacaacaccctcttggttttcaacctaaaaacaaggaaaaagttaagaaagaaattagacgcacagcaacataaccagcatggtaaattaccaggcacctcatatgtattatcatcatcacgaatatattttatcatcatggcagtaagacagggtcatttataacacggtgaaccatctagatccaaaatttcagttagcagcaaagaaatgcaataacctgaattcctcattttaatgcatatcaggcaacaagctaaaccctatcagtgaaagtgcatgagaaaataagtagctgctatttgaacaagcaaacgtgaaaaaaggttattctgaaactagttgttcaagcacatagaaaaggaacaaaattgcattttattacctaatatagcacaaaaaggggtcaaatggtcaatgtacaaaggcagagaccaaacaattctggctccagtatataccagaaagggacaacaaaacattaattaaagcatctaactgagaagtattgtcactcaaccgtcctggtaattaaatacttaagcaaactgtggaactgaaaacctaacaggacccaaaaaatagtgataatgattacaaacctttgacatcagcttgatgcgctttgcatgctgtccaagaagttgtctgacggtaaccaaatctgatcctttacggacaaacgacagagcaatcatgtctatgtcatttggcacaccccatcccaaaatgtcttctttatccttctcagtcagtgtaggaaggtccacaacaattcctggcagattgcaattctttctctcgccaagcattgctgtgttctcacacctacacctcacagttccagcctttggatcacaggacaaaacagtcaaagagattgtaccatcggcgcagagaatgacatttccaggcttcacatcaactggcagtttcttgtaactcatggtaatcatgttctcatcacccttgatctcataatcggtggtaacagtgagttcttgaccctttgttagcttgattggcttgccatccttcaaaaatccagtacgaatctcaggaccctgaagcaatgaatgaaatgttcagaacagtcaccacagaatcgccttaaatatgctactaaacaggtaaaaataatggaactaattgcagtacaagaagtgataaaaaagataaactgtgtgcagtacaattctgtaagtaacttatttgaactacaaagcaaaccatgaagtgtgagagtgtaaaaagataagcaccaatagttacgtgcatgacagaaacatcaaggcataatagaagaaatgactacactaataaagccttcttttacgtgttaatcatatcctcctacaaaagcaacaaaatcagaacactaggatttgaacactccatactccaaagccaccgatcccaagatctgttaaccatccttccaatccaactctacaaatgaataaattaacttgaaaaagcatagagacgaactgtaaagctaaatatgacaaacaagatgcacgcagctcatcaatctcaccaacaccgcaaacggatcacactacgaaccagttacacacttacacttgctcagaatccataagactccaaaactaactacccacatggagacgcaagcctgagcccccaatccaagatccagccatctgcgacaaggcaaaagcgcaagcgcaggcaaatctaaccccggataccattttgtcgagtcctccaaagtcaaaccgctgtaaactcaactcataatcctaccatgctgcctccaaatcaaacccagcttctcccgataaaaaagacgagcagatccaaatcgaaatccgctctgtatcaaacgcaagctaccccgactggtccgatccgaacaacccagcagcatacaagcatgtagagatcgacaagcaaagcagtgagggggtaaccttggtatcgagcatgacggcgcagaggacgccggtgttgtgcatggcctggcggaggttgtcgagggtctcctggtggtactcgtgggtgccgtgggagaagttgaagcgcgcgacgttcatcccggcgcggagcagcttctcgagcatggggacggagcgggaggccgggccgagcgtgcagaccagcttggtcttgggcacccgcgcgtcgtcgttctccagccccgccaggatcttccccatgtcgatgttcgccatggctgctccctcctcctccggtggtcgccgcgatccgggaggcggaagcttgcagacgacgagagagagagagagagagagagagagagagttgtgtgagttgtgctggctaaacgaggcgagatttgggggaggatttttatagagatggagtggaggaggggaatttttttggcgattcagtgggcgaagggagggaggaagaagagaagaggactggaggagaatagcggagaaagaaagatgagagatgtggacgcgtggtcaccaccgagttgaggggcagagggtcgaggtgaggcgattcagtgcctgcctcactgtctccatttctccacatggaaatcatccccactgatcttcttggggaagaagttacaaaatgcaactagtaggactgtttgatttgggactggtttagttctcaatttttttttcaaatttctaaatttttttatcacatcaaaactttcctacgtacataaacttttaacttttctgtcgtatcattttaatttcaattaaatttttaattttaacatgaacttaacacaactttaaggtttataatttgaaacttgtggtgtcgtggctaatatgcagtgtggctaattactggccaaaatcgcactgaatggagttggttgggtaaagtgtgtgggcgtgctaatcttggggtgagtttgacatctcgaggagatgattccaagacaacggcatataccagcgaacggcgatggggcggtgggcaatcagggcggcgccagcatccggcaaaaccagcgacgtccgcgtcaaaaaccgcgacctcaccctctgtttcccattcgtcggtccagcgatccatctgctagctggctgcctggtctttctcctcttccgttttcctttctctctacatctccacaactctgcttctattcctccatcattttgttatttttgctgtgtttagttccctttaaacttttaatttttccttcacatcatttgcacacatgtataagtattaaatgtggacgaaaaaacaatttacatgtaaattacgagatgaatcttttgagcctaattacgccatgatttgataatgtgatgttacagtaaacattttttaataacagattaattagacttaataaattcgtctcgcgatttactgacggattctgtaattagttttgttattagtctacgtttaatacttcaaatgtgtgtatgtatatgataattttttttccaaaacaactaaacacggccaaaacattaatttgttttgttttgccaaaaaaaatttagaaagaatctgcagttcgaattctcttgtgacgattgaccaacagtgtacgtacacgcgatgggcagacgtggttgcgtccattgatcatcctgcaccgaagtcaacttatcagaaacctctttaataaaaaagaaaaaatatgtaaattttgtataacaaatggtttcttccgcgagacagttcacaattggcttgcttaattgatgagaaaataagcgcatgaaagaatcaagaatggaactttcttttgtcctcttttcttcttctttagtcttttattaccagagaagaaacttctttagtcctttgttacaagaggagaaggttctgttgagtttggaatttctcaatccgtttgacgatcatttttgtttcgtaggcatggttctagaattggaacagtcaccgtcgaccttgacaacaacatcgaagaaaataaaataattttacagcaaaacagaagcaggtagtacatactccctccgtccaaaaaaaaaaagacaaactctggtttccgtgcccaacgtttgaccgtctgttttatttaaaaaaattataaaaaaaattaaaaagacaagtcacgtataaaatattaattatattttatcatctaacaataataaaaatacgaattataaaaaaaaattatataagacggacagtcaaaattggacacggaaacttagggtttgacttttttttgggacggagggagttctttacatggtaggttaggccaggtcaatacccgtggcatgtttattgaagccaaaactaaaggagtatttgattttctcgttgtgatagtggatttaatctaaactagcaaatcgcatgcatagcttatactacaacattaaagcaagctaagctgggtgaattcctaaagctaaagaaaaagccaaaggtgccttggacagtttgaccacggtcagttgcggctccctccatccgccatcagccgcgcaaagtagtaatgggctatacttttcccctcttaagtggatgggctttttagagaggaataagctcattttagatcccttaatttatcgtcaagtctaaaatttacccctaaccgcaatatcagacatgatgtgtcccttaagaaaaaaaaacattcaacattaccctcgcaataccgactaaattaagctagctcacaataaaaaaaaatccaaccagatctgcaagctaattggagtagccaagaaaatataacccccgccaaggactcgagtactgttgcatcgacattaagggggtgtttaaatccaccggcaaatttttttttcccgtcacatcgaacgtttaaacacatgtacggagtattaaatatatacgaaaaaaataaattacatagtttacgtgtaaattgcgagacgaatcttttaaacctaattgcgtcatgatatgacaatgtggtgccacagtaaatatttgctaatgatggacattaagtgtttagtggacattaactttataaaaagaagagatttagttacatactcaaatgtcttgatataacttataaagagacagcgaaaagaaaaaaaaaaacataacaaatgagggtagacaattgttgtccaaagacaatcgcgctgacagactccttttggttgatgggacaagaatgtcattgctgcaagagtgtgatatttttctagggttgtcccgtaaactttttgattagcccataaaacatgtagttatctctaaattgattttaaatcggtcttaagactggtttgttctttaaattggctccgcctaatcggttttgattttttttctaaacccatcttcgtcacgagcttttctagattaagttagttggcaactctattaacaccgcaaatatttaggtgagtccatgttaactgaaaaggcaccaataatgttatcctttggttgatctcgtttgagtagatagatagatgcagtatattgtgagtaacttattcagattaacagtagcagctgccagtaaagcccatgcagtttttcatgggaattttcttgcttagcagttgctagattaaattttaaaactatattgttcctttcatatttttttaaatgtatatacttcctctgtttcacaatttcacaatgtaattcattctatcatttcccacattcatattgatgtatgtctagattcattaacataaatataaatgtggaaaacgctaaaatgacttacattgtgaaatgaatggattactgtttttcgaaggatttatgaaaatgtaccaaagtcgcggggagtggccttaacaccacaacaccgatttttttttacagtgtgaaaaaggagtgtaatgatgaaaaaaagatgaggcaacggtgtatttcaaaatcgccaattgccaccattcccatctagcggcatgcatctcccgctcctcaccgaagtattctcggttagttgcgccacgccatgcacgctcatgcagctaagctagctatcgatctcatcgctatttatcgagcaacgcagcatgctgagctctagctataaacacggataggagcagcaaccccagcttctcgcagccacaccacccaaggcgcgaagaaggaaacgtagtcaataaaggcagccatgtcgtcgtctcgctcctgcagctccagcttcgcggtagtgtcagtgctcctcctcatgctcgccgtcgtcacggccagcgccgccaccacggcggcggaggagcccgcgcacgaggaggcgacgcacaacgagcggatcctcctggcagactccgacgccgacaccgacaccgacgcccaccagctgctgcacaatgtggaggaggagttggccgccgccaccaccatcgcggcgggccaagctgccgcggccggcgtgagggtggcgtcggcggccgaggatcagaagaaggacggcggcggcgacgcgggcgccgcggcgatgccggtggcgctggagcggcaggaggcgaagacgaagacggcgggccgcctcatcgcgacgcagggggacgacaagagcggcggcggcggcggcaacgagcacggcaaggagggaggcggcggcggcggcaaggaggcggagaagtcgaagagctgcgtgaccaaggaggagtgccacaagaagaggctcatgtgcggcaagacctgcaccatgtcggcgcacaccaagtgctccgccaagtgctccaagtcctgcatccccacctgcggctagctcgttcttgccgcgattcgattcatccatcgaatccttcggtttcgtagtagccttgatcatggtaattagcttgttttgcctgcttggtaaagaagggaataagcaggggcatgctgcacttgcatgagtgcctctcatctcatatatgtcgtcgaattaatttgtttaggcccaatgtttgttgttgttctagtcttcttaattatatggtgtttttgatgttgcatggtaggtcctttgtcgtgtgaaatgtggttacgagtttaatgagattgtatgttggtttgtttgattttgtgaatgtgagcagaattattcaggagtttactgttctgtaccctgaaaaaaaattgaaggtacagttgtgtttttacccagaagatgaagcttaacaatgaaatgttcatgaccctccagataatactccaaagggcatatctcacttacaagcaaagaaatgtttcatcaaaactcagacattagctgttgtagggacgtgacaagccaacgagtaacaaaggtgtcgatcaagagtatagatctcaaatactattcaaaagaaaactgatgtacaggtgtacaaggagctcaatcactcttcatcaatcttgtcattgaatcgaccagacatcacaaccaaacaataaactatcaaatgcaacccgctaacacaagacacgagagaagaggctacagccagcaaggcattacaatcgctgacattcgctccatctcacggtcatccacatctatcaagggcaaactggtatcttcagaaaccaatgagacaaacgcgaagaacgctgccggcagatgtcaccgctcatggcagcttcccttcaaaagtgacaacagacaaggatctcgagcactgttggttagtgtgtgtacaagaggaacaaacagtggcaacaaaatgttatccactgctgctgtgccttggagctcggtgactgggcacgaacgaacagctctccatggcaactgatgcccaacattggtgccatcagcgggaatgcatttcccattcagttgtgtatgtatgacagtgtgtggtcagtcaactacataacttcctggaagacaagactgagctcctgtgccgtgtttgcgactgccccttttcttctgttgaaaaaaacaagggaaaacatgtaaagattacaaaaatacataccacagaatcatgatagcctgacattcgttgtttggtttgtattataacattgcctagggttgccatagttttcttgccaagcttgtctaaggttagacgaacaaatttggcaccacaatatggtgaacaatgccatgtgggaccaaggtgcttaaaaaaaaatcttgccacaagcgtgacaatgaactatctcggccaaagctacctaagttgaggtgtggcaaagagtgaccatgaaccaaacggcaagtgacagggagctatgcatttaattcaggaaaacgtaagatccactggaaagtgccaattctagcagccagagaaagcaattcacgagatctgatctgtgggttgtgcattgttttgcgtggttattttaactcagcaactggcactcaaactttattctcaagcagtaaatgcaggtgccgtttcagccagataactcataggcacttacataattcattcaggtaaaaagtacaatttcagtaaagtatcatatgtattgcatcccatacctggaaagaaatggaagcttatttttgaccttctccaattcaataaagcataggttgcaacgctcccgcctaagatgaaaaaacagttaagaaaccacattactgaatctatcaatgagttagtaatactctagcaatataacataataggaggacagttctagcaatatactgtagcatactaggacagtctgactgaaataatacctttgctctgcttgcagatctacaccaacagaagagggaccagctgatactgttgaatgtattactgatccaaacgtcctgacaagcttcaccaacaattccagtgaaacacctaagtgcctgtgtagatttagcttttgtaagaaatacttttaattgcaatttaaaataaataaatgcatggcatataagatgttaaggcaatcagtgcagtacggtacatacatatgaataaattgtctctaaccatttctatatactcccacaacaggatcataataataacaaaagcagcggtaagttacctgtcagttttactctccagaaggtcagtaaggacgggcagaataacagtacataaatctagtgtgattgtttcacttttctccatcagaacacttgcaacatcagcagatacctgcacttgccagaaatcaggttgttataactatgttgtttagtgcactgcacacggaagagaaatgttcaaagtactgacggcatgatcagacatcttctccattgctgcaataatgccccgtatatcatttctttgccacatttgatgaacaatctgcaagtcacttaaaatagtcagatacagcattcgagcaattgcattttgaaagcctacagattttagtattgaaaattctgagaatgcaacagagcaatttagctaattcaacaggtcatatttcagtataaagtatacaagtatcaacagcctgtcgtacactagaacactgcaaaataggacacaacgtatgcctacctcttttttctccatatctctatatcttattaatcaactcaaataccattgagaagtttgagaataaagatactagaagtggggggggggggatcttaaagaaaatgcaaagtaccatactgacctgcaattttgtcaaccgagatcgagttgagcttagaaatagctcatgctgctccattagaacagatagaacatcctcatcacttgctatcgttggagtttcagcagcttgactgcttcctctctgcaaaatataagatacagaaagtgactctccatgtacaagagaagatcaaacatgaaaataggtgaattcggcaaaaccttccaggtataagctagagctgccaaaacaaagttggtttacagctcttcattacagtaagattcatgatctgttgatttatctttggttgaatattcaaggtatagaatggatttgttaagccctatctttggtccatgatattcacatacacaagctgggtaacagaagtcagtatgtgctaattcaacaactagaaactaaggggcaaaaaacagatccatccatccatgagataaagacataacccattaagcaacatttgctgctcttaaataaaacaagcactccctccgtttcaaattactcgtcgttttagcttttgtcctaagtcaaacattactaactttgactattaatttttaaaaatttatatagtccaacatgataagatttatgtttttagattcaccatgagaaatgctttcataatatatagtttacatgttgttgaactatatgaatttctagaaactgatagtcaaagttaggaatgttacttaggacaaacaaaaacgataagtaatttgaaacggagggaatacatgttgaattcttacgacatcgttttcctttattcatttatactatattttaattccatactggttagagatgatacaatcaaggtaaaatggtgaattccatatagaaaagaaacattgtggataatgaattgacaaggaagaacagaaaatcaaaagtagataaaatcttattggtttgtgtcacacatacagatgaatataatcggcctgtaggagccatcgaagaagaattgcttgttgtcggttcttcattaccaggtgactgatctct

SEQ ID NO: 80471 - DNA, 25349 bp, Oryza sativa
atggaatggagaaagcaaagaaagaattgtatggatgttgggaggaaagttttcaattgttgtatagttggaaggaagaggtacttaggagatcacctggaagtgttatagaaattgacattagttgatgggagagcatactttcataggtttttttaacaactcagaggaatgtggacttggaacaatacgttgatatggtttactcagtgcagaaattcagggcttcatatgagagagagataccagcaattccagacaagtcacattggccaaaggtgaaaatgcctttcgatttgggcgcaccactagagaagaggggtgttgggagacagaggaaattgaggattaaaggatgccttgagaatggtggcaaaagtagtgcgaagagtgatggcaagaacaagaaaatcataagaggtctagttacatgcaaaagatgtggtgagaaaggtcataggcaagctagctagctacaagtgcccattgaatggaacaaaaaacggtattaatatttctgttttttcactttatatcctttcaaatttgtggtgtatcatcctatatgtataaatatatgcatgaaaaggaagcctaggaaaagcaaccaaaagaaccttccacctgaaccttcgacaccaaaaagaacaaccaatgaagctacaataatgcaagaaagcccgggaatgtttacaaggaagctacaataatgctcaaatctgacaagttagaattattctacttggtgtgcatgcttcaaaccaattgtgtgtaacttggcttttgtgtatacatgcataggcgccttacaatgctattgggagaaaccggtacttctggagtggaagggctaaagaaatggctagtacttctggaggaacatctatcctaagaagaaaaaaatgactcccaagaaaatgaagacaacctaatgtattttagtcgtcaaatgtgaacttcaaagagatgtgaactagtattgtagttgcaaatgtgaacttgtcacacatgtgaactcctctttttgggtctctttgatgcttcatgtaaccaagatatttgctatgtgatgtgctgcaatgctctgtgcatatgctgctgtgtgctatgtgctgttgtgctatgtgctgttgtgtgctatgtgctgcaatttatttgtatatatgtgctgcaatgctgcaatttgatgatggtgtatttttgttgctgcgatgcaatttaatgctgcaattggagggaacaatctgacccgaacatgtgagaaaggatccaggggtatgctgcaattagagggagcaatctgaccctaacatatgagaaaggacccaggggtatttttgtcatttcgcatgctatttctgattaaaaggctcaaaacagcccaaagtggcattttattaaggtgtatcacctacggagtggcatatttataaggtcatcctatagagtggcattctgttaaagccacctctatggagtatgatattgttaaatttctcgttggggtcatccgttatgaccgacactgataaccccgagccaaatttgaaaatttagctgccataaattcatgagtgctaattctagccacagattagcactgataaatgcctcatcagtgccaatttttttccaccaattggcacagtccaccacatcaatggaggtttctttcttaaaccgtactgatatttgtcactagtgccagttgttgccctcccggagcgtatgcggggctaagcgggcaggagactatcaatgctggtttttgtttgtgtctaactggcactaattgggcgtcacatttaaagcgttctatggttgtgggacacatgctcaccaatattatctctttacaaagagttaccagcagatcaccgacagatgcaaatagaccatccaacattgaaaagaaccaagaataaacatggaacacaattccaagaacatagagatcacattaccgtgctaaagaatggacatagtttccccaccgccacaggctgccactacggattaagtcgctactgctccagatcaagtcgttgttgctattgatcaggctatcatcactccaattcaagccacagtgaaaggcacaaggaggtgggaggagggggggttgaatatgcgttctgatttatgaaatattctccaattgccgtaggtagaatcaataggcaggcacttcctaccaactctcagccaactctcgagtgatggctactacttccgagcttgtggaccagtaaagttttggttggctgggaattgttcttcctagcccctcacagaaagtataaatgtgattaacagagagcctaacacagagcaaatgcggatcacaaaaattgcagcaatttgaacacatacatgagggaccaaaacaaggggagacaaagatttttttcccgaagtcggactgcacggattgtactctccgttgaggagctccatagagtcgggtatctattaaccccttgcctcaccgagctagccaatgggaagaagtctttagcctccaagcaaccacctaggtttcccttgattccaagcgaccaccaagatcacaccttgggcagtgagttccaatcactagtgaagcttgctctaccaagataacctccaactcggaattcactcaaaatttcctcttttccttgcggaggtgcggttcaccctcacaaagttgcttggatcaatgacagcttgaggaagctcatgggagacacctagccatctaggaagtcaccctccaagagtaataagcaccaagcagtagcctggcgatgatccccaaatgcgcatctccttctaagtcacttacaagcactaatcctcaccacctccaaagaatcatactcgaatcaccatggtagcttaggaagtagttggaggaggtcaagaaaccctaggaaaagctaggagatagataaacgaaagtggaattgccaaaggagatgtagaggggaagggtggattttatacccactatcatatgtcatgtagccgttactcacatagttgaacttgataggtgccaaagaagttcgagccaaaaccactaggaatttttggccaacacttaaacaccttgaaaaacaagggccaagaagttttgggccagaacaccaagaacttccgacccacactttctgtttacatctgaacccgtgtaggttttgtacaaatgtgtctctcatctacaaggagtggacagtgagcacttggataaacgcaagcaaccatttcagtatgctccttaacagtgcagctttcctaaagtcaagagcaaaagatacaaagatttttaaataatgccatgagtccttgcgccgctttcgattctgtttgtaggggtctctatgcacacctaggcaccccgggacaaattatctgcaccactacaaaaaaaagctcatagagatttgttggagggacggtctgaccggtttagtagggcggtcagaccatcagacacatcctaaaaggtgttttagcctccaacggctagttttggtggttgggggtatatatacccactccccagcagcaagggtaaggttttggcattccattgcattatcttgaacccttgcgagagctctcacatacttgtgcacttagtttatctagtgaggtgttggagagtgagtttatccaatccatgtgcattgctttattgttagagctagtgcggcacttgatcatcctcggtaagcatcccaaacttgttactcttggaggttgctacctcctagacggtttgaaggagttgctcggtgacctctccgagaaggttctggaggaggcccggtgttgattgtgagtggctcagtgttcaccatctccggagtggaggaagaacaaccatagtgatagaggcttgggagaccacttcatgggccagcacccaccttgctcaccccttgacgaagggggcttgcggtggcttcgtggtttgagctatgaagaagttggacttgccacaacggtgacgtaggaagttggcaagcatccgaacatcgggtggaaaaatactttgtcacttgcctcctttattttgtgaaaatttactttgagcaagtttacatactagagtttatttgtgctattatcaccctagcaagccataacataggctagctactttgtgcacttagttgagactagttgatttaggttttgaactgtgcaaaaccgttttgatttacgtttccacgtacaaaactcggttctagccaaaagttttaaaaaccgcctattcacacccctccctcttagtcgacctccttgatcctacattctctctctcaagtctgtcttggtagcagccaagtggcggcccggaggaagcggaagtgacggcggcggccgcaccctcccctcctccagattctcctcctcgtcgtccttagcagatgccggtgccactccaacctcctcgccgcctccgagttgcaccaccccggatccggtagcctagaggtcgggggccgctagatccagcctcctagagttcagtgctctccggatctagtggcctgtgacctcaccgtcgtctccgatgccggcaccggcgctacggccactgctggtcgctggcactgagtggtgggtggtgggggccagatccggcagccccaagctcgggactaccacgttggcaagaaggatggcgaggaccgtggcgtcggggtggtggttttcttgattttgtgttgggtcttcttggatttggggggaaagggaatatgcaggagtttatgttctaggcagaaccaaacattgtttgcaatgtgatgaatattcttgattcttttttgagtgaaatatgatggatgttcttgattttttttcttccatggcttttccatgtatgcaagcttgaagcatcggctcgattcattaccaatagactattctttagtagtgttgtatacatcttgataaaatcattagtcccttataacagttttgtcatcattccgccaaaacccacttagggggctagatgcatttttacatatctcctacggattgggccactgccggcataatatgcttagtccacaccacctcttgtctgagtccagccacccccaactagcctccctgcacaacctaccagatctgctggtagatagataaggtttggacatagagacgacaacagtagtaggaggacttagctggctgagcaagtcaccatggcatctcgttcattgtgcccgacatccgccgaccatgagctgatccttgttatgttgtaagccaaaccaccggtgagctcaaggaggccacctcactggtgccaagaaataggagcattcggatggaggccctatttaattcccacgaaaaaactttttaccttgtctcatcgatcgtttgaacacctgcatgaaatattaaatataggctaaaagaataactaattacacagattgcgactaatttgcgagacaaatcttttaagcctaattgctccatgatttgataatatggtgctatagtaaacatttgctaataacggattaattaggcttaataaattcgtctcacggtttactgacgaattctataattagttttattattagtctacgtttaatacttcaaatgtgtgtccgtatgttggatgtgatacgccaaaacttttcacccctggatctaaacacagccgggacagtgaactacgcttgcgtcttgataatgatagatgtactgtgggccagagggcttctggtgcgtcccgaatttgattaccatttgaatagagagtggatagagcaaaaaggaaggagatcccacacatttgagttattgttagcgacctataatgggctggtgcttgcaaggttgtggcgtccaaatatggctggagatggtgagcaactagggaggggacaagaatccaccgttggcaggggcggatccagcaattaggattcattaggctgtagcctatcctccaaattttgcaaaaaaaaagaactatatgtgatatatgagatgaacatgcattcgagaagaggaacggacaccgggaggtcgagcaagatagaaaggaacacttggcattgttgtgattggggcagatgctaaagtggtacttcctccgcttcacaatgtaagactttctagcatcacccacattcatatagatattaatgaatctagattcatatgcgtgtctagatttattaacatctatatgaatgtggacaatgctataaagtcttacattgtgaaacggagggagtacatcttaatggcccatttggccaatacaacacttctttggcatggttggactggagcaagtgtatgggacggggaacagtggtaggctgctcatgtaggggtggatctcgcaaagcaaggtccaataggttcaaaccttaacattttaaagtacatatgatatctgatatgaacaagcaatggagaagaggaacatgcatcaagaggttgaggaagatgagcgtgcttgggctgattctaccttcatggctgtgcgtgagtgctctgcaaactccggtgtccaatccaatcctctcaggattagtcattagtttggtggctggtgggccttttgggcttggtttagtggtttaagttggactggttgtggttgtttttgggcttgctatccgggtaatatccaaattatttaccggatactctatatctgtcagatatcaagctcccgaacctgatcttgtatccgagagaaaatacacggattgggatccgctacccttgtaagcatccgcgtaccaggatttttgacccgaaattgtcccaaactaatatggtcaggtgggtgagcaggaaatacctgccccgttttcacccctaaacactcaacacagcacaccaaatgttagcatgcacaaattatttcacatagcaacaggttaatttggaaaacaacacataggccttgtttggctaatgggtttgggaaatgatttcccacccatcaaaaagcatctttaaatcctaaccattcattctccctcttaatcttaatccttcattcatttttcaattccaatcccacctcttatttcccattatccaaacatagccagaagacaagaaacgaacatgactagtagctgatagaaggaactactgcgaaccaccagatgcagaaccaggcccgttttcactagttaaaatatattgcaagtgcccagctgcgtctgtgaggcgcgcgaacataaagcagtggccattgcttgcatcacgtagcaagcgcgcagccatataccacactggactacctggacggtggccatcattttccaccatctccatgcaagtctcagggccggtagccttcgctgcagctagttcccttgcgcggctctccaaggacgccatgcgcagggtagcgagcctatcaagcgtctcgccagtaccactgctgcaggaccgcttattagaacttccagaggcatcaccctctgatgccttcctttttcccttactaccactgctctgagcatactgtcctttgatggagacagcgccggtggtggaggagtgtacgctgctgtgagctgctcgacatcaatgggctgccactgaacgggttgttgcggcgtgccttgggcagccccagcgacggcggaatggttgcggacaacggtgcgcatgctaaacaccgcatgatgaagatcaatgtgcttcaggggatcgtttttgaaggctatcacacccttcctcacctgtcacacagttgtacacatggaactttatacagcaaatatatgaaaaggcacagtacacacaagaggacataaatacagtataggcagcatgacaattattactgaagtttgcgacatgattaacatatatcatagccataggactcgaccactatttataaacattgaaaggaagaaacaagataagcctccactacaagaaatcttatgatagatgacgcttcatttacgtcacaaatacataaaatttcgtcacgtttcgtactgtgatgctcgcgtgacgaaaattcattcgtcacctatcatacgtttctaatggcgttttatgacgaaaccttttttttctgtcattaatctagtgacgatccttctatcgtcataactttgtgacgctcatattcgtcattatctagcctaaaaaatgtcataaagtatctgatggcccattaaaatccatgtattgagcaccatgtttatgggcttagcccaatggcaagcccaactagattttagcctagcccatcatagatgtagcatatttcagcccaattctattatatccatttgctttaataacaaataatgaatgaataaatgggccagtccattgcaaaagcctatataggcccaaatattataccacaccattttcagcccattatattatcatttacattagtatcaaataacaagtgggctaagcccatatagacccaacaatcaaacacaataacaacacatatagcacaaaggctacagcccaatagcatctaacacaacccgacaaacatccaatacaacacaaaatttactacccaggtaacagccaaatccagccaattgctcacacctaggcaagcacaaatcctttcaaatctctaaaccgactgccatgagagcacccccaaagtcccttccataagctaaactgaaaatctgccaataccagattaatgatgctcagtgcagtttctagctagattgcataaactcaaggatatcacataggttcgacattatttttgctactgtggctgtgtggcataccagcattcatctctgtaagcattgtccatgacagaaacatcttgtctgatagcgtcacaagcttgttaccctgacattttgtagtaattggagttttcaagaacaaaagaaatgcagcacgaaactatgatagatgcagctttgacattctctataaggagtacatacctctagattcaatctgaataacttggaacagccagcaagttcatctggcagtacggatatagtgttgtttgattcctacatgtagggcactacattatgtttaggacagaggatgaacagggaagctatagaaatgacagctgtatatattttcatcaaacaaagaaaccttatggtgaaaataaggaatacatcgatggtggcttacattgagttctgacaactccaggcaactggcaagactagctgggagatctgtaaggcgattatttgagcagtcaaccctaacaacaacaatgcatcaacttacatgaatataatcatatatagtctcaaacattgcttctggtatttagacatcatactaattgtcaacatcattatatctaaaatatgtgacaaatttgaaattcaaattcaaattattgaaacaaagtcatatagcaaaacgaacaaaacaaaagttgtagatcttgataaattatataactttgttgttgagaattttttcatttaaaattatttactacctgaaaacttatttgaattgagagaagggaggcaaaatggacttctcggcgagggaggagcaaaagggttggaccgcggcccaaagagggaggaggggaagggaaagccggcccgaggaggaagagagaggctgtgggctgaggagggagaaagtaacacttgggccgaagaagcccaaggggagagagagattttaatttgttttccatttattttaatatgttaaatgaactttgtggtattaaaattagttattgagctccgaaaattcacggaaaaaatcagagaataatttagaacatatagaatattaaaaaaatatttccagccatgatttttaaagaaaaattttagtttcctcagtaattcacttgattaaattgcttcaccttttaatatatttttctagaaatgcattataaatctgtgacgtttgcttttaccgcttatgacaaattaatattcgtcacaatgtcccattgaaatactttatgacgatttctagttggtattaacgacgaacacctttttttcgtcactaagccaccccatctcatacttatcgtcataaaatggaatgtgctaatgacgaatagctccgatgtcacgagaaattcgtcacagaaggtcatatttcttgtagtcacacatcaaagtgttccccttctcagtgcactgaattttattccgacatatctgaaaagtttttttcattttggatggtagtttataaatttgagaatgggcaatgaaaactaggggggcagtgaaagcaaatgccatttcatccaagaaacaagaaagttgtaatgaaaattgcctttgtgcaaacagggcccatccatggttgaatctaaagaggctctgtttgcattctctttttttttgtcccactggattgtctatactgtgatggcagtaaatgagtaactccaaaaacttgatagcagcatgatccttcagcagctggatcatttacaaatgtacttggcacctacagttatgaagctaagaaattatgaactattaaaaaccaagaaagaccaagttgacagcatcattctgttctagcaaacaaaattatgtaccaggagcttctaaattacaggagaacactatttgttattacaaggagctagtcagtgatactcaacagtcaattcaagccttcaaaattgagcctaactgcctatgttcatattacacatgaaggtaacaccatggtagcaagatatttggtttgcaaaatgaatttgcggatgagttacataccccattttggctttcccaccagctttcgtcagtgacaatggctgaagtaagggggtcccggccttgtccggttgcctgcgattcaagccacacccacagctggaaccgcttctttgcactgccccagatgtactccaattgcccttttgtcaccttcttcctgcacttggtgaacattttcttcgccaagttctcccatgccttgggtttgggggagttcgaggtgttgttgtatgccgccatctcctccaagcaacactcaagaaacacacgcagctcgaaatcggtccagcgaccacgcggttcggacatctactgaaatgctagtcaacaaaaaatgaaagagagaaaagaactacacaagtcaattgaacggctgacggtggcaaggctcattcgacgcacgaactcgataacggctttgggggacttggcacacaccgtacagagggcattggcgatgtgcacgacgtcgtcggctagagccttggcggtgcccgtgtccgaggcgaccgactcggaggagccctcgccggactccagagtggatcggcggatagcgattggtagaggtgacgtggttggaacaatctccctttccaaggcagggtgtgacagctcaacctctcctttccgcttcttccccctcgcctccattcccctacttcaatttattacactccgagtttatgttgagcctaacagctctccacaccacctcgttactatatgcacctggaatgcacttcatcggccggaaacgatcaaaagagcgacgtgactgagtgtgcaaaactaagatcagctccattcatctgtgtagtgcattcctcaccatatatgtagtctgcaatttcaacatttacatttatttttagtcggactgaaattctgctctaaggaatgttttatattaccaaccatttgttatttggtaaagtgcaggtgttgttagaaattctaattaatctgtgaaccatgtactactagaatttatttaagagctagtatatctaagcaagtaagagtttatttagctgtggattgtggttccatattaaccactgtgcagaccactaatgtgagccctaaaactcccaactcctcttctctctccttatgtctttctcacgcacatgcaagctgctgcagctagcttagctcctctttcttcctgctgcctgctgctgctaaggctcttcctccttcccaaatcacggtccaaaccatggctaccgatttgccgctgctaggtgtggatcagctctgctttgactgcggctgtggcggtggctgctgcagctacgactgcggctgtggctatggtgacggaggctgctgcagctgcggctgtgctgtgggtgctctttctctccctctttccttccctctctggctctagcatttgtgcgctgtggatacaagtgcagagaaaatcgatgctcatgccatgactgctctatgtgctaaatgaatgatggtaagaaatgaggggttcacctttgtgtaggtgacgaattcgttcacagtcatgcacccttgtgcgtcctcgccgatctgttcacctcccctcctcctcggtaaatcacctccctgcctacccgttttttttttttttgaaaatgtcaacgggggcgaagtgcccacctgaatatattacgccaaacagacttacacatggcaaagcaatgacgggcaaagcaatgaccgcgcaagtgcaggcgccctggaggataacagagtgaatacatggggaaatacaagggaagagaaacacacaggggcaacataaccacccaaaacacatattgatgttttccatcaacaagatcacaccgccaaacacccaaaccggctgtatgagtatttggcctgattggtaatgaaggttggttcttgcagtggatggggcagattcttgcatttcactgattcgtggattttggggctttggctatttcttctccactccctgctactccctttcttctccccaactctgctcattgctcaatcctgccatgtactacttgggtttcctatgcatatgcaccggcttgcattaattgctatagacatggccatactttgaccgcttgactgcggtgcgctaagagcgagaacaatagcaggctataagtcagctgtaaatatatatagagaagagagaagagagagaaggaaaagcggactacagatccccaagtccgctatatttgtgtaacggatttgctcaaatttcttttccgagccgatctagggtttccaaaaccgattccgttttggccgttaccgcgctctcttttaaatagtaaccaccgctcttctcgtttcacggcgtcacttccgttttcaccgctctaaccaaaaactttccccaatcttccacctcgagttctccggcaacacccttcaagctttccggcgatccgcagacgcttccggcgactccaatctccgccaatgacaatgtcaacctccgccagtccaccgagctcgttggccaccgaatacatcgaggtaagtatccatcggctaaatcccttcttttcctcgtagatttggttcttcttccgctcaatcctcgattttcttcctctgtagcacctcacccaccaggttgcaattcctagtgtagccgatgaattccagtttttccttggcccaatcggaaacttagaccccacagagttcatcaatggagaaaccaaccgaatccccttcagattttgccaatcctgaccttagcccttggaaaggcaccttcaaatcctggccatcagccgaagtcagctagcctgcgtggtacaagaggatgttgactagcaaatcaggtcactggaaagaaattggcatagcccaagccttagcccttactgcagcaaatatggcaaggaatgaacccatgatggcagcatccacctatttttggtccatagccatgaacacgttccttttctctcaaggaccgatgaccccaacactattagatatcatcatgatcactggtctagatatcacttcatcggctaacttgtccagcctaaacactcaactcacccatgagttcaaaaccagaagcataggtggttggtcaggttatgttgccaagaacatgggaactgggccggttaccccaagagaacacacagcttttcttatgatgtggctggaaaagttcttattctgtggtccaagctgtggtccgaccgcaaactggcaatgggttgctgaaaatctagtagaaaagaagcattttccccttggcaagtatctgctaggctatttgtatcagaccctcaatactgcaattgacaaaatagcctctggaaaaacaatcggcacagggggtccatggtggctactccaaatttggctgaatctgcataccagaaaagtggccaatcggccagcactagccgatgtagaattcccaagattcgagccgatcatcagggacgatggagaaacaagcaccacatgccgatgtatgtccttcgaagaagcagcatcggttagcgcaatgtccaagctatcggctgaacctttcagggaatggttcaataatttctatgatgggttccccaagaatgataggatctggtttgcatatgaaggatctgctagctttgaactaccaggtgacttttgatttgatgaaatcaactctgacaaatatgataaatctagagaagtattctcaacagctatcagccccttcatcatccatgtcggcatccatcaaggcaagaatatccagatgacttacgaattctatcatccaacaagcgctgtaaggcaattcggcatgggacagctaccaattagcctattctttgctgacaagatccaaagtagaggagagatttcatcattccttatgatggatcggctgctgaatctaccaggaccacctcttggcagtattgacaacatcagactaaggactttcaggagtgtggcctttgactgatggtggatataatggaaaagacatttgttccatcaattgccgtccatatatttgacgaacctgtttcctgacgatgtcccacaggtaaaattctcacattttgttaattttattaaccacaagccgatgcgtctttaacttatgcgatcctgttctttatagacaacagaatcttctcctcctcaccagagcaaaagtggtgtggaaattgaatatgcactagggctcctacctaatggtggtggactaacacctccagtcatcggctataatgcccccaagacctccacattgctgcacggcctgtctcgtatgccgattgctcgtgctgctggaaggaaaagagcaaaatcagctgcggcaccatcggctgcaaagaaaaagtctaagaagcaaaagactgctgccgatgatctgccagccattgatccagatgtagcagatttcctggaggatgaagcaatgtccgaagaggtgaatgaagcgactgaacacatcagtgaaacacgggaacagacccccctgccgatccacctggccctcagataacaccatcacctccagtacgtcccacttatcagcccagggtatgcatctctttctcattcattgtccttatactttagaaccgatttctgactttgtgctttgcagaaaaagaagatagcttccaagaaaccacaaggagcagctgcaccggttaatttccctgatcctatcaattctctttttcagttttcaaccgatgctaacttgtactcacgttttcagccccctcgacattcaactcctgtctttgaatcaagtgaaagtactccatcggttataggaagtcatcatgtagaagaagaagaagaagaagtagcaccaactcctgctgtccctgtaagtataaaccttaattttgaaaatcatatcgctaccaatctttctaataatccacaatatcaatgtttctctctttcaggttctagccgatatgttctcttttgacatcaggctattcttggatgatgaagaagaaacaagaagctaagctctagtgcccctagccgatgatatcaaggcaaccttattggatatctcgaaacaacttgaaggctccctggagactttggttacaagctgcggatccatcacggacagactcaatgaaatccatgacaagatcctagatgagcaccagcggcatatcttaagcaacattggcttaaatttgaaaaagcccaaaagagaattgccgatcagcgtgaaaggagagatcttgaagcaaccatccaagccaacagaacgtccatcaatgaagaaaaagctaagctggatgagttggaggctggtccaagtgcaactcaaaccaacattgatcagctaaataaatggaagatagaactcatagctggactagagcaatgcaatgcacaacttgctcttgaacaggaaaagcttgccgatctgccaaaagccatcgaagaccaaaaaatccaagttgaaagcatctgtgaagcatctaactgagctgaccaagtcattgaagccgatttccagtactaatgcagccgatgccaagataatcaatgaagtagatcaagttaggcaaaaggcaatatcggctattcaaaaatatgtatccggatgagccgaaccttgtaattttcaactttaaacttacaaacttttgggctgtaatgaattccatgttaaacctctgccttcaaatttttgcttttgaaatccatattttctatatctctgcaatgttgaagacattgataaaattataatttggactaagggcgacataataaatatcagccatcatatatcggaggaatacaagcgattatgataataaaaacaagtaagggcgatacaatccatatcagccatcatatatcaacaaaacatagctgattatgctaataaaaactgctaagggcaatataacttatatcagccatctcaaggcgatgtcaacacatcggctagcatgcatcggcaatactcaactgatcatgaattgacccgaacacttgggtaatatttcttcagatattttccattaagtgctcatccataaacttcaccatcaagtccttgcaacatataagctcctttggacacaaccttatgtatttgaaatggcccctcccaatttggagaccacttgccgaatttattatcccgagttcctatcggcaagattaacttccaaattcctggtaaaaaaaaaagattaacttccaaacaagctctccctcagaaaaagacttaggcaccacttttttgttataatgccgagcagcccattctttatccttggtaacttttgcaagagctctcagtctggattgaaccaagtcttcttttttcatcggcaatgatattataatattcattggctgtcaactcattctgcaaatccatccttctcgagccgattctaatctcccatggtaaaactgcctcgtgtccatatacaagtttataaggaggaacttgaatcaatccatggcaagccatccgataagaccataatgcttcagccaaccttgtgttccattgccgaggtaaatcaaaaatcttcctcttgatcaatttaagcaaactcttgttagatgcctcggcttgcccattggcttccgcataatacccatactatcagcaaactgaacaaattcatcagatacgaaaatagagccctgatcggttgtgatagtctgaggaattccaaatcaataaataatatgttccttgacaaactgtattgcatccccagaatcaacatttttcaaaggaattgcctccacccacttggtaaagtaatcggttgccaccaatataaacttgtgtcccttgcttgaaggtggattaatcataccgatcatatcaattccccaacctctaaatggccatggcttgatgatagggttcatagccaatgctaatgctctctgaattgctccaaacttctggcaatcttgacatcccttgtaatatctgaagcaatcttttaacatcgtcggccaaaaataccctgcgcgccgaagtaaccacttcatcttgtgagcgattggtgagtaccacaaataccttcaagtacctcctccatcacaaccttagcttgatcagtactcaaacacttaagcaataccccatcaatcgtctgataatagagctcatcgtctaataatgtatacttcaaagctttgtagcacaattttcgtgaagccgattgagatggggtctacaaatattgaaaaagatcgtatctccaatcatcggctgcaattgtggcaacttctatttcaatatctttcaccatcggcttatatcctgatgccccctgagccaaatcattagcttcaacattttgctccctagagacatgcttcaaagttaccagccgaaaactattcatcaattcccggcacttttcattgtagatcatcaacgtatcatttttgcattcatattctcctgccaactgactgattaccaacaatgagtccctcatgatctccacatcatcggcttccacttccttgagcaactgcaaccccttgagaactgcttcgtattcggcctgattattagttgcataaggtttaatagtataagcaaactcaaaacttgccccccgaggggaaattattaccaagccgataccacaaccatgagtatacaccgatccattgaagaataatgtccaaggtgcaatatcaaccgagccaatcgaattatctcgatgttccacaatgaaatcggctatagcctgccccttgatggccttgggcgattcatacctgaggtcaaattctatcaaggcatatatccactttccaactcttcctttaagaaccggagccgataacatatatttgatcacatcggctttgcatactatagtgcattcattggataacaaataatgcctcaacttggtgtaagagaaatataaacacaaacataacttctccaccggaaaatacattgttcctgcgtccaaaagcctgcgtcttaagtagaaaataagtctttccttgccttcgagctcttggattaaaactgagccgattgacttctcgccagccgacaagtataatctgaatggtattcccttctgtggagcaatcaatactggaggagagctaagatattccttaatattattcaaagccttctgttgaaacaagatttcggcaatacgaaaagggggtggctatcaagcaggaaaagtggatgggtttagagacaaggaattttatataggttcaggccttctcaatgagaagtaataccctactcttatccggggattgattcaccgagtgtattattgatcgtatgatctgggagaaaagttatgcccaagaggcgcccggacccctccttatatagtgagaggagtccgtattacaagatacagcgcatattcctgacgaaataggcaagtaaaaataaatacaatcgtaaccgactaggatctcgggtatttccttgatacacaagttaagatataactcgagccctttaacgatatcttatctatatatggtacccctatacccagtcggatatacatgccgtgtgggtatggggtatccataatctccacacattctgctgctctgccccccaagtgaattcttgatcggctttcaaccttagcaagggtgtaaaaggttccaatctcccagataagttagaaataaaccttctataaaatttaccttgccgatcaacttctgcaattacttcttgtcttctggaggtagaatcttcttgatcgcattgacactcctctgaattactttgatccccctctcatgaacaagaaaacccataaactgcccagccgatacattgaaagcacacttcgtgggattcattttcaagccatatttccttgttctttcaaaaacctttttcaaatcggctctgtggtcttccacctcttttgattgaacaaccacatcatcgatgtagacttcaaccaacaagccgatcagatcatggaatatataattcagtgccctctgatatgtagccccagcgctcttcaagccaaaagtcatcacaacccactcaaataagctgattgcaccaggacacctgaaagcaatcttgtgaatgtcttcttctgccataaaaatttgattgtaacctgcattgccatccataaaactgataatcttgtgccttgaagtagcatcaaccaattgattagcaatcggcattgggtattcgtccttaggggtaaccttgtttaaattccaaaaatctatgcacaccctaagcttgccattcttcttgatgaccgagacaatatttgaaactcattcagcgtatcggcatggcctgataaaaccaacatcatataagcgagttacttcagccttgatagcatcatacatatcggctttgcatctccttggaggttgctggtaaggtttgtacccaggtttgataggaagtcgatgttcaataatcgattggctgagtcctggcatctcgtaatattcccaagcaaagcaatctctatactctttgaaaagctctatcaacgtggttctaaactctgtcaataaatttttactaataaatgtcggccttggcctatctcctgggcctatgtcaatctcttccaaatcatcagccgacatgaaaccctgtcctaatttgccatcgagatcatccaccgtgtccttggtgtagaaatttgaaccctccacgatgccctcaaaataataatttggggtctccatcttcaattggttgtatatcacaatcggacacttttagaaaattgttggtatttcttaatgacattactagaaatataatttccagcaatggcgcagaaatacttctggtatattatggttgtagagttcatccacaagcgcatggatataccattgtagcatttcacccgagattattccaagggtattgtatttattttatcccgtgggaagattatgtagagagaactcaactaataatttatatattacttgtgataatcatattctaagcgggggttacgaaaatccaagggtagagtgacacacaagcatttctactcattctcataataaataatctaatgtcatgcccggaatttctatccaaaactccaaacgcttacatgtgtgtaaaccctcgtccaggaatcagtcgaggcacacaataacaaattgataatagagtgcaattattgctctatttaataggcgaatataaagtcattacagaggtagatagttcctatcaaacaatagagatctaagcaacagaaaataaaataaagagcataggcgactccatcccaccagcagcttgaccagggctacgcctaatcctccacaccttcagcctcactgtagaactcctccaatgatgaatggttgcaaggtgagtatatgacatactcaacaagccatgcagcaaatatgcaagtgtaggggataacaaaggatggcataatatagtctcatttgcataaatggcaatcaataaatacttcagaattcagaaaaacagtaaagcatttaattaaacaatattaatccaacgctatacaacatacccgttgcataggcccaaccattctgaacaaccattcccggctgcacagttctatctccaaaccaggaatataccattccaaaccaggagctaaacaagttattaccaattacaacatcatttattatggtgagaggtgtgagactaatcacgaaagacattgttagactcgcccataaccgcgggcacggctattcaaatagttttactctggccagaggtgtaccactgtacccacaagacacaacctcaacatcatgtcaaccatgcgtcgcgatacttaacaagaacctgaatagagattgtgaatagagattgtgacaataccctccgcataacacaattcaaagcagtgcaccattcctagatcataatcactaccttataaaacaaggcatggactccccagcgacccccctgggcttatctccgccacttctcagtctggtgccccataatgaaccacactatataaaaggtaaagccgttgcccacgctggcttgtggttggcacggttaatgtttcacaaccaaaaatcgtgaaccggttcttaattgtcatgagcacgaccatcaaaactgtttacacccaaatttggcacctaggattaaaataggaaagattgccaaaatttggaagtctaccggtttcctccgagtaggccggtctgaccgccgtgtgttcgccggtcagaccgccagttgagggccggtcagaccggcggtgtgtggccggtctgaccggcaggtctgagtccgactgtgttttgtcgggtctcgaggtttccttgctcgggaaggcatgtttcgggtttcctttggtttctgccccgagttggacgtggaggagggcctgtagagggcaagaccaacccctatataagggacatggccggttcattgtaaaaaaccaatctacaatcaattaaccgaatcgttttttcatattgcttttagttttctcttagtttgtccatctttatcggtttgcgccgtaaaccgtccgccaccgctgcgagagtgcgacatctctttgtaggtttgtcctgaaaaccttccgttttgcccacgagatgggtagttatctagaaatcggctccgctagccggtttagttatcaaaacccatttaggtttagctctttgctagatcgaggtggttggcgactctaggatcaccgcaggcttaaggtgctgcgatcgtgcttgtcaacttgtcaaaaaagttgccaacacgatttttgacgactctgctggggacgagatctgttcatcgtcaactcaacttcgacttcgtcatgacgtagccgccatccaagacggaggtggagccatccaatatgatgccagtcaccttggataaattcgaaggagaagaccgtaaagctatggaggagtacatcaacgaactcacacgggaggcattgatgagggcaagcactaggactcgtcaaggtgtgaccatcaagcccgggccacgtcctaagctcgctcctgacttggtaagtaatgatgaggtaacacaatctatccaacaacaagtagcatctacaatagattcatctatgattgcttttaaagataagttagatgcaacttttgaggataaatttgatgagtttttaagggttaaattcggccctcttatggccaattacatgtcaaaaaataaagcctctaccactgctaaccaacctcctatagatcaaacgggtagtaaaaccgatgaagcggcgcatgcggccggtctgaccgggcctgacggccggtcagaccaggacttagccgtcggtccaaccggccaaacggtcggtcagaccggcactcaagccagtgccggtccgaccgcgcctctggatgccggtcagaccgggccttgggccggtcacaccggtgcaattgttccgatacaaggaatacatccaatgactaatgctggttatttgtatcatcttagaacatttgatcctcctgtatctactgctgcaagtagtccccaggttcccccacatgttcctaatgcttataatgatgttgctagggggtatccccccgatactagacaaggccaatataatcatattgcgccacaaacacaatctattaggccactgaatccaccgccaagtcaacatgggcctaataatatagaggatataattagtgagattattaggaatagattcgggattgaaactaggaatcgtgctagggtttacaaaaagccgtatcctgattattatgatgatgtgccgtttccccgtaattttagagttcccgaatttaccaagtttagtggtgaggatagtaagaccacatgggagcatgtagatcaatttttggcacaatgtggtgaggttaatagtgatacttttaaattgcgcttgttttctttatctttgtccggtaatgcttttacatggtttacttctttaccggcaaattctattcatacttgggctcaactagaagaaaaatttcatgattatttctatactggagaaactgagcttaggttatgtgatttaacatcggttaagcaaaaatataatgaatctgtcattgattatattaagagatttagagatgttagaaaccgatgttataccttgaatataactgatagagatttggctagtcttgcttttaatggtttaattgctcctcttagagaaagattagatggccaacaatttcttgatgttagtcaacttatgcatagagctctggctcaagaaagccgggttaaggataataaaaaacttgttagaccatatgacaaaaggcctaatgttaatgtggttgattaccctgaggctagtgatagtgaggaggagggtgatcatgatatatatgttgccgaatggtcatggactaataaaaataagccttttgtttgttctaacctaatgccaactcctcgcaaagatcgacaaagtgaatttaaatatagttttgatgtggccaagtgtgataagatttttgattatcttttgcaagaaaaacaaattagattacctaaaggccatgtcataccatctcaagaagagttgaaacgtcgtgcatattataaatggcatgattctcattctcattctattaatgattgcaatgtgtttcgacgacaggttcaatcggccatagatgaaggacgattgaagttcaccgatggctccaagatgaagcttgatcatgatcctttttcggtgaatacaattaatttcaatgataaaaaggtgttgattcggctggagcaagccgaatctactaagggaaaaggagtggtcattggcgaaccaagacctaagatgatagtgccaaagaagccggaggttggcgtttggaaggaaaataagaatgaagcttcaacttctaaagcccctaggaagaccaaagtgacttttgacatgcttttggaaaagtatgagaaacaaggtggtgagagagctcgaaataaaggaaaaagaccaagatcacctcctagggagcgatttggttattcaccaagacggtcgcattcacctccatatcatcatccacaagacatgtcatggggttcttatccaatgccgccgctgggttatccttatccttattacatgccatggggagcaacgccgccaatgttcaatcatatgcctctaatgcaattcaacctagggtggggaggaccaaggaggccaattcatgagcatttgtcttcaccaaacaacggccggttttatggtaaaaatcgggctaatgaagaaagaagggaaggaaagcgcatcaaggtggagggaaggacttcggaagtaattaccatcaaagaggggtctcatgatgtgccaataccttctggagatggagttggagtgtccccgaacaaaaaatccgaagccgataccagctcatcgcagtcggccggtctgaccgcagccatacggccggtctgaccgccggcccgacagcggtccgaccgacgcctcagggccggtctgaccgtacgccgagtgtcggtctgaccggcacatctggccggtc

SEQ ID NO: 80472 - DNA, 11521 bp, Oryza sativa
aatcctaggtggatgcctaaggatttgacgtctgctcaaaagagaaggttgcaatgtcttcgggctcaagagataagagagaaaaaagccgaagaacaaagagataaaaggtttaatgagttgcgaccaccaccggtatggaggcgtaaatccatagagaacgaaaagtcggttgttgtagaggagaaggaggaacaatcggttgataagggtgaatcatctccaaaagaagacatggatattaacatggtatgtatgttgcctatggatttttgtgctatggatgaagccgaggttgctcaattctcattaggtcctaaagatgcggtttttgagaagcccgatgagtcaaaccgtcacatgaagcctctctatctcaaaggccatgttgatgggaagccggtctctaggatgctagtagatggaggtgccgccgtgaacttgatgccgtactcattattcaagaagttagggcgtgaggatgatgagttgaagaagaccaacatgattctcaatggcttcaatggtgaaccaacagaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacagcgatgatgttgaaattgttcaagcggatacatcggccgaggttgcaatggccgatgctacttttgagtggcgtcatgggaatatccaatgcttatcggggagggatctttctagctatgattttattagtatctctgatggcaaatttgtacctatctctgtaaagccggctagtgtagcacgggtaagccatataaatttgtataatgagtaaagaggctaatttagagtggttacaaaagagggtgcaagaatatcggtctacaaagaacgatattggtgaaaccgttgaagattttgatgaagtagagaagcttggaaaagggtttacatcagccgatcctttggaggaagtagatataggtgatggaactaaaccaaggccgacttttgtaaacaaaaatatgagagccgattataaggtaaaaataatcgagctacttaaagagtatgttgattgctttgcatgagaatatcatgagatgtcgggtcttaaccgtgagctcgttgagcatcggctttcaattaaaccaggttttaggccttataagcaatcacctcgtcattttaatcctttgctatatgactgagtcaaagaggagattgatcggttgttgaaggcggggtttattaggccatgtcgttatgcggagtgggtttctagcatagtcccggtggagaagaaggggagtggtaagattagagtttgcatagattttagagatttaaataaagccactcccaaagatgagtatcctatgcctatacccaccataatgtttaatgatgcgcgggttcataaggtgattagctttctagatggtaatgccgggttccaatcaaatctttatggcggaagagaatatgtacaagacggcttttaggtgcccgggatttgttggtttgtttgagtgggttgtcatgacctttgggttgaagaatgccagcgcgacgtatcaaagggcaatgaatttgatcttccatgatttgctaggtattattttagagatctatattgatgatattgttgtcaaatcggatggtatggaaggacacttagccaatttgagattagcttttgagaggatgcgccggtatggtttgaagatgaacccacttaaatgtgcttttggtgtgtcggcggggaagttctaaggattcatggtgcatgagagaggagttgagattggtcctaagaagatagaaaagattcgtgatttcaaagcgccggcatgcaagaaggaagtacaaaagttgctaggtaaggtgaattatttgagaaggtttatttctaacctagcgggtaaatcgatacttttgttcctatacttcgcttgaaaaaagaagccgattttacttggggggcaaaacaagaagaggcgtttgaagagttgaagaggtatttgtctactccacccgttgtgcgagcgcctaaagccggaaagccttttcggttatatattacctccgaggacaaagtcattggtgccgttttgatgcaagaggaagatggcaaggaatatatcattacatatttgagcagccgtcttttggatgccgaaacgaggtatgtctttatagagagactttgtttatgcttatactatgcttgtaccaaattgaggcattacttgttatctagtacatgcatagttgcttgtcaagccgatgttattaaacacatgttgcaaaggccaattctaagtgggagaattggcaagtgggcatatgctttgatagaatatgatttggcttatgaaccattgaaatctatgaaaggccaaattgtatgtgattttatagtggaccatcatgtagatattgcttatgaggaaaaggtttgcttagttgaagttataccttggaagatttattttgatggttcttcttgcaaggaaggtcaaggcataggggtagttttgttttcacctaatggcatgtgttatgaagtatcggttcgtttggagtattattgtacaaataatcaagccgaatacaatgctttattattcggcttacaagttatggagatggttggagctaaatacgtggaggcttttggtgattcggaattggtggtacaacaagtcgccggagtctacaaatgcttggacggatcactaaatagatacctcgattcatgtttagatattattgccaattttgataattttgctattagacatattgttaggcatgataattctagagcaaatgacttggcacaacaagcatctggctataatgtgaaaaagggattatttctggtattagaagagccggtgcttgattttaaatctttgtgcaaaattggtaaaactggagaccaggggcggtctgaccagctgcttgccgtcggtctgaccggcgatcccgagcagtctgaccagccctgtgtggccggtctgaccggttctgggcagagcactggggggcatgtttcaatcaatttagaggccgaattaattgtgaatttggacgtttgtgcccaggaagcagaacaagattggagaattcctttgattcgatatttgaaagatcctacacttaaggttgatcggaaaattcggcggcaagcattcaaatatacattgcttgatggagatttgtatcaccgaaatatagatggtgtcttgttgaagtgcttagatggagatcaatctaaagtggctacgggagaggtacatgaaggaatttgtggaactcatcaatcggcccacaagatgaattggttgcttaggagagtggggttctattggccgaagatgattgatgattgctccaaattttatagaggatgcgaggcttgtcaacggttcggcaatgttcaattggcgcccgccgccgtgttgaatcccataatcaaaccatggccgttccgaggatgggctttggatttcattggtcaaatttatccttcgtcatcaaaggggcataggttcgtgctagttgctatggattacttcaccaagtgggccgaagccgtgcctttgaagaatatgactcatacggaggaaattgactttattttgaagcatattatccatagattcggtattccacaaacattaactacggaccaaggtacttcttttatgtctaaggaagtgaagagttttaccgaatcttatggtattaaattgttgagttcttctccttactacgctcaggctaatggacaagccgagtcgagtaataaaacattgttgaagttagtgaagaagaagattgaggaatacccaaagaggtggcatgaggtgctttctgaagcattgtgggcgcataggatatcttaacatggtgccactaaagtcattccttttgagttggtttatggtcaggaagccgttttaccggtggagataaatcttggttctcttcgttatatcaagaaagatgatttgtcaagtgaagattacaagacgttgatgggagacaaccttgatgaagtcatcgagaagcgcttgaaggcattggaagagatagagaaagagaagaagagggtggccaaggcgtacaacaatagggtgaaagcaaagttgtttcaagttggagacttggtttggaagacaattttgccttcgggtactcgatccaaggagttcggtaagtggtctcctagttgggagggtccttatcgagtatacggcattgttcgagggaacgcatattttttggagacacttcaaggggagcgctttcagcgagcaatcaacgggaaatacttgaagaaatacttcccgagcgtttggcaagacgcttaggaggtactatggccggtaattagattatcgtcctaagaccaaaatatgttctatgcttttagattcacgttgttcatcaaaaaagcagggggacatgtgtttacacccaaatttgacatctaggattaaaataggaaagattgccaaaatttggaagtctaccggtttcctccgagtgggccggtctgactgccgtgtgttggccggtcagaccgccggttgagggccgatcagaccggtggtgtgtggccggtctgaccggcaggttcaagtccgactgtgtttcgtcgggtctcgaggtttccttgctcaggaaggcatgtttcgggtttcctttggtttctaccccgagttggacgtggaggagggcctgtagagggcaagaccaacccctatataagggacatggccggttcattgtaaaaaaccaatctacaatcaattaatcaaatcgttttttcatattgcttttagttttctcttaatttgtccatctttgtcggtttgcgccgtaaaccgtccgccgcaactgcgagagtgcgacatctctttgtaggttgtcctgaaaaccttccgttttgcccacgagacgggtagttatctagaaatcggctccgttagccggtttagttatcaaaacgcatctaggtttagctctctgctagatcgaggtggttggcgactctaggatcaccgcaaggcttaaggtgttgcgatcgtgcttgtcaacttgtcaaaaaagttgccaacaaaaaccatgtgctcacaacccaccattaccatgttttagttcgcatcttaataaaccatcctatcacgattgaccatcatgagctaccattaatccatcattaagtaatagtgaatcattagttatcccattcatatgagctagcgtctctaagcatggctaagcatcctaattactttagctaaaaccatataatgttctagctaatccaattattaaccgggtgacaaagtacaagtaatcaataacaaaaaggctataacaaaggaaataggtcattcccacccgatgacatagttgaatcgaaacaatagctataaacgggatcaacatgctcaaagggttttttgggatctatgtgacttgccttgctggccttggaattcttcaaagtcttcaagactaaccattctgtcctttccacacttgagtagattcttcagatagttcactcttgggcgtttaggatcaggatcaacagcccttgtcttgtacagcctcaaaggattgctttaagaaccaggctcatcctcattgccaccatcatctgactcagatacagctggagagggagagcggggtgcatcacgaatgacaatgctaccagccctcctggaatggatcggaatctgactcccactgtaaaaatctccaactttttctttgcccaatcttcccctaggaccacgaaccggggggctcgagtcagcaggaacatcttgagaaagcttctatctcttctcatgaggcataatgaccactgcaacaagaatcaacaaggttggagtgcaatggttaaaagaaacagtagcagaatcaaggttactggctgattggacagagaccggaagttccgggccaagaacaccgaaacttccagccagcaaaactgaagaacggaggatttaaccaggccagtgcatgtgacaaaaaaacctatcgatcagcaatctacaaggtagcaggaacaattctatccaaaaggttttctccctaggttcacatatttagagatcggggcagaaacatgatgaaccaaaagagaagatcaaaagtgctaccttgagagggaaaatcgcaaatcgatcacgggatgaacctcctagccaccaatgtggttgattccacggagaggaatcgaatttccacggttggaagagaaaatcgccgagaggagcactgtagcggcggctagggtttgggaatcggggaggagaagaagtgaggagagagataccaggcttgggctccccctgggtatttatacccccgacccccggaagttccggtcagttccggactggggtgaccggaacttccggcctgacagaacagagcgtagttaggcgcaagttcaatggaatagatgagaattcaatgatttggaaatgaaaacctatggacataaagagacttatgatgtatatgaccagccaacaatcaacattacagaacaatggttaatatacatcacaagaagggataaaaaccaaattttcgcaataaaaacacatacaaaatttttcacaaaaggatttttttttggataatagagggaatgtttgagctttattcctggtatcaagaccatcttctacacaagaagtgatctcaagacacaaaagctcaattttttttaatttaaattttaatgacacatgtttggctatgaattagccaaccacccatcacctaatgttacgagagtctaagatattgagctcactcctaagctcgcaaaaccttttctcatctaaaggcttggtgaaaatgtcggctaattggctttcagttctcacatgggtaaggcatatgtccccttagtctcatgatctctcaagaagtggtggcgaatgtctatgtgcttggttcttgagtgttggacgggatttttggctattttgatggcactctcattatcacataggagtgggatcttggtgaagttgtagccaaagtcttttagggtttgtctcatccaaagaagttgggcacaacaagaaccggcggcaacatattcggcttcggtggtggataaggcaatggaattttgcttcttagaggaccaagaaacaagggaccgcccaaggaattgacaagtcctggttgtactttttctatcaaccttacacccggcataatccgaatcggaatagcccaaaagctcaaagccacaacccttaggataccacaagccaagattaggagtgtgaactaaatatcttagaattctcttgacagcaatcaaatggcactctttaggctccgcttgaaaatgggcacacatgcaaacactaagcatgatgtcgggatgagatgcacataagtaaagcaaagatcctatcatggagtgatataccttttggtccacacatttaccattatcgtcgaggtctaggtgtccattagtaggcatgggcgtcttgataggtttggcatcctccatcccaaacttcttgagtatgtctttcacgtacttggtttgagagatgaaggtgccctctagtgcttgctacacttgtagtccgaggaagaaagtcgaactcgcccatcatagacatctcgaaccttttagtcatgattctactaaattcttcacaaaaagaggcattagtagaaccaaatattatgtcatcgacataaatttggcatatgaataaatcactcttaaattttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagactaactccgagataggtccattgagaaagtcacttttgacatccatttggaataacctaaaatcaaggtgagcggcataggctaaaagaattctaattgactcaaggcgagcgacaggtgcgaaggtttcacaaaattgagaccctcgacttgggtaaacccttgcgcaactaaccgggctttgttccttacgaccaccccatgttcatcttgcttgttgcgaaagatccacttggtgccgatgacattttgcttgggtctctccaccaaagtccatacttgattgcgagtgaagttattcaactcctcttgcatagccatcacccaatccggatcaccaagcgcatcttccaccctggttggttccaaagaagagacaaacgagaagcgttgacaaaaacttgcgatacgagagcgactagttaccccttttcttatgtcaccaagtatgttgtcaacgggatgatctctttggatagtgtgatgtatccttgaggatggtgcactggggggacctgagcctgatcagaatgctctaaagtgccctcagcatcgatcccatccacttgtgccgttggcacgtcttcactgccattgatccggaggttccggactgtagaacccggaacttccgggcctggagatgtccggaggttccgatcaataggacccagaacttctggctcagcagatacagcacttgtagggctattggatgtcgatgacggaggttgatccctatcttcttggtcatcctgcgtctcgactggtcgtatgtctccaatagccttggtacctatagcttgatttggatccacatcccctacaacatgtacaacaacttgctctccttgggagtcattagattcatcaaatgtcacatccctagtgacttcaacaataccagaggttttgttgaagacacgataggcatgtgcatttgatttatagcaaagtaagaatccctcatccaccttaggtgagaacttagatgagcgaggcctcttacttaaaataaaacatttgctcccaaagacacgaaaatatgaaacattaggcttcttaccactcaagagctcatatgaggttttctttaggatcttgtgggggtacaagcggttgatggcatgacatgcggtactcacggcttccgcccaaaagacatccaaagtcttgtactcatcaagtattgcccttgcggcttcaatgagggttcggttcttcctctcaacaatgccgttttggggaggatcatagggggcggagaactcgtgcttgattccttcttcatcaagaaattcctccacttgagtgttcttgattctcctccattgtcgcttcgcaccctcttgatagtgagatcatagaggttttgggcttgctttgcgaagcgcttgaagacatcttgagcttcgcttttgtcatggagaaagtacacccaagtgaagcgcgaaaaatcatcaacaatgacaaaaccatacttgttacctccaatgcttatgtaggccacgggcccaaataaatccatatgaagaagctcgagtggtcttgttgtagtcatgatgttttttataggatgtggactcccaacttgcttcccggcttggcaagcactaaacacacgatctttctcaaaagaaacattagatagaccaagaatgtgttccccttttagaagagatgccaaattcctcattccaacatggactagcctacggtgccatagccaacccatagaggatttagcaatcaagcatgcctccggattcactctatttacgtcgaaatcaacgagacagagatcaccctttaacactcccttgaatgctatgcaagagtcatctcgcctaaaaatggtcacatccacatcggtaaacaagcaattaaatcctaacttacacaattgagacacggataataaattgtagcttaatgaattgacaaggaggacattagatagagattgattcttgaaaatggcaatcttaccgaggcccattacatttcctttaccatcatctccaatgacaatattttcacgacttccacccttctcatcaagacttgtaaacatactcccctctcccgtcatatgattggtgcagccactgtccacaacccaacttgagccaccggaggagtatgcctacaaaagaaattaagcttgggatttaggaacccaaacttgtctaagtttgggtcccttgatgttagtcaccaaagcctttggcacccacacacaagtgcggtactcatcattgtaattcccattaaaataagcaaccactttgccctctgaatttttggaaattacatatgaatcatagtaaagaccctctggccggaacttccggccagccccttcggcctatcagaagcccggaacttcctgacaaaatgtccggaacttcctgtcttacagggcaggaacttccggtcattttgcccggaacttccgagtgtctgaccagtgaggggacaagtcacctcaattgcttgtggagcttttccttctcttacaaacatcaagcattctttcccatttaccatcacacgcttagacacaggacttccaccagaaaacccgagcccgtgtctatccttgttaggatgagcggtgatggtcttgtaaagggcatcttttgaatggtagtcttcatgcatccatatctcaccaatgtgcccaacctttcatttcttttttaagagcttgcatagcatcaacattagtagcatgagagttcaaatcaatattgtaacacctagcacaaccattgctagtagatgggttggaagaattagaaaccacatttggttgagaagtgctattccaaagagtgtcaaattgaacttcaagatctttatgacttttgtctaaactagcaaacttctcttgaagagtttcattgacatccctaaggctagctagagaaccattagccaaattaagctcattagctagttgttcatttttagcacattctttagctaggctctcctctaaggcaaggtttcttttcttctcaagaataagtaattcttcttgcctttcgagagattgttttttactatccaaagctctcattaacttagccaaatgttgcatagcgggtttgctaaagctcttaagcacatcatctaattcattatcactttcctcatcactagaatcaacatcaagagaggtgtgagagggcttttgagtcatcaccttgcagccttgggccatgaaacaagagtagtggtaggagtcctcgtcgtcattactcaagttgttgaagagacgctccttgcttgaagaggatgacttgaaggtgacggtagcaacaccaccttctccttcaaccttgtcttttggcttgggcttgggcttgacctcgagatcttcttcatctgcagagtaccacacctccgccatgtgtgcctctgccacatgagcacg

SEQ ID NO: 80473 - DNA, 720 bp, Oryza sativa
  unsure (1)..(720): unsure at all n locations
gagcacccgagtaagttgtggtcgagtacaccacattatcgagaacgatctcgacaaatgcagagtcgtcgcgcccaacctaccaacgaagaccgacnnnnnnnnnnnnnnnnnnnnnnnnnnctggactactcgagaaaaggttgttaacggataattcctcgcgaacgtcgtcggcttgatcacctgacatgattgtgaacggacatccggatatgctacaagttgggtgcatgagtcatcctggtcacatgagacgcacataataaaccaactctagcacttccattggtgtgcgagagatcattctacacgttcgctggtcctcgaaccagtacatagtaatctctcgcaccgcaagcttccatcggtgttcgagagataattctacacgttcgctggtcctcgaaccagtacgtagcaatctctcgcaccgcaacctccattggtgttgagagatgattctgcgtgttcgctggtcctcgaaccagtacgtagcaatctctcgcaccgcaaccttagatggtcgaggtacgactacagcaatagcgcaacggtcctagcaccatgaattcaaatgatcgagagacacctactcactggttctcaaccagtcaatcgtagcgatctctcgtacatttacttacagtggttgagttacgactactgcttggttcttgaccagctgtgtagcgattctcccactatttgcacttctag

SEQ ID NO: 80474 - DNA, 707 bp, Oryza sativa
ttcctgcagccccagaatgtctagatagttgtacaagtgcgcctttatgtcttgagtatggggcgatttcagaaccagcagctccaactgttggtggggtgatttcagaactagcagctccaactgttggtgtagaacaaccaccaattcattatgttgattgggatagcttggagatagatggaacattagatgatgagggaaggattcacgtcatgaatgatgaccaattgtttgcactcctaggcttgagggataagggcaaaaaaatcagtgcatgctgttggttcaagtagtaatgttcaaacaagtggtcctggagtccttgagggcatcgagggtgcaacaattcctgtcgacaatatagtaccgggtgagcttgttataatctacgacaagaataacccttgtatggatcgatacactaagtacccctcaatgaaggaattcagattggctgtaagatagtttgctatcaagaaggaatttgagctaggcaaagtgaaaagtgacccagagaggtatagggtaaaatgcgcggtggagggatgtacatggagtcttgttgggcgtaggcagagtgataagaaaactgtaatggtactaacctgaaacataattttttttgacattaattctagtgtgcctagtattgtttacctggttttaatggattacctttcctttcataacaaagaccatacttg

SEQ ID NO: 80475 - DNA, 6929 bp, Oryza sativa
acgccgcgctcgcccgtcgccgctccgcccgccgtcgcgccgcccgtcgtcgctccgcacgccgccgcgctcgcccgtcgccgcttcgcccgccatcgcaccacccgggctcatgagtgtgcgtcgtcgcctcgtcgggtgcagcagagctcggccctcttcctcctctcccgccgtgcggccaccccctatcccgcaggcgcgggcagtcccgactcggcgcggatggtgacagagcgcggaggaggcgacgagccgacgacggtcgacggcttgggccagcgaggatgtgatgccgaataggggcggtgaggaggcggcattggcagctggggcggcgaggaagcggcctcggctagggcacgacggccttgggcgcctcgtcagggactgccggcgggaggagttcgtcaatccggtcttgtggttggagagctcgatcgggatggtcatgccgtggagcacctcgacgacggtggaggagggatccggagaagccatggtttccgccgcctcacgaattgccgcggtcgcggccgcagaccccaccgtccccaatttagcgccgcaggaaccaccgctctgcccgaagcccgccgccgcgcgctccgcccgccgacgctccgctgccgtgcgggcccgctgccgtgctcgcccatcgcagctccgctcgctggccgccggcctccctaaccaaagaagagaagagggaagagagaaaagagaagaggagaagaaaagagaagaaaaaaaaatatgtgccgctgacatgtgggtcccacataatttttttaattttttttgctgactaggatgccacgtcagcgaaaccactcactagggaccttgagtgaacagttttatatagtttaggggtggagatttctggttttgtggttaagggacctgaaaaaatctcgctgttaagttaagggacctccggtgaacttattccctgcatagaataaccttggcccaattaaattcatcgggagaaaggagcacagcagcagtgaagaaatcggcccatttatgtggtatataaactattgggccagaggaaccatctggcccagtcaacatgcttggcccacagatttgaactcaaatgccgggaagcttgtgcagcgtatctcatatttttcagataatggaataatatcaggcctttgcttccaagaaactacagccacttatattacagagtcagctaatcaaagagcaaataaaattcaggaattgaaagtgcaaagatgagcgcggatgataccggagaccaggatattatggtgggcatatgctctgtttccatggagaggtaattgggaacaatttgatctgtctgttctgctaacttgtcgtggtgatgagaacatgttgtgcgtgatgtgaaatactccctccgtcccattttaagtgtagccacgattttccatacccaattttgatcgtccgtcttatttgaaaaatttttgaaaaaaatattaaaaacataagtcgcgcataaagtattattcttattttattatttcataacagtaaaaatactaattataaaaaaattaataagacgtacaatcaaaattgggcacgaaaactcataattgcacttataataggacggagggtgtatgatgaaccatgggaaatctccacggttcagacactggttcagctaaggtaccaaattattcctgcaattgtggcatatcctggagagtggagacctgaactcctgaactgaattcgatcatggccatatgtagatctgcttaacttcagtgcaggtctaaaaatcttgcctttaggttcgtgagcgtaccagttgatttgatcctgcaatcaacaagaaataaagacaaagaaaccgcggttaaatccataaatgatagccgattggccagccaccgatgacatatcatttatcttggagccgatgtcatatgtaaatcgatcggcaatcatgaataaataagaatgaactaaatctacttgatcggttgtagatatcaacaatatataatccttatatcgatatatacttaaatcaagtgattgggatagattgatcgtcatgccgagacagtttaaatcacttagatcaaaatatatactaacaatgagattatagatgtttatagcatagccgatcaaatagatctagcatgtatcgactaatactccgataccactctatattaagatattaaagcaggaaaaatatattaaacaaaagcctaatatactctgttgtaataagatctttaacataaagggcagatctagcatatcaatcaagcacatagaatataaggctaaattaggtaagatcagctgaaaccccgatgctaccctagtcggcaaccaaaagcaggctagagattgagattctaatcacgacttataagatcaaactcaactgatgctactataagtataaaaagaaggataatatctagacaataaaacttgtttcatagagtggtagataccctgtataatctaggtcaacatggatatttaacctaatcggctgccttctaataatagatgttagccgattgaaggttagatagcgatattatcaaagattatacagaatatatgataactcgacgaattacataaataagattagagtatcataaagatgtaagcactaatcccgagaacgcaagccgccataacaagttttacctctagttgaagatcgaaaccgatgcagctcaacccgaaagcaagaactcgtcgaaacaaaacgaaagtaaaagggtggcgatgcgccgagattgtattgaacgtgtgttgttgtattacatggggctcggggtctatttatacccaagattacaaaatatatccgtgtcggacacgacacttatctctaacaaactctaagataccataagtctttgcggcagatttttgcccaaaatatctctaaggaaattacataaaataacctaattaatagatacaattgtcgtctcaggactcaatccatgcatggcaactctcatgcaatacattaactcaacccgacaatgtgtatcacgccacattgtcggtatcggctcaatcggccaaccttgcccgactcgaactctgccgatcctgatcgtagccgattcggacttttagccgattctcgctctgttcccggaacaacgtctatgtttggattctgcttcgatctatctctatctccgatacttggattactaaattttgttgttaacaccatacatgaaaggggatacctattctgaagatttactaattaagctacattgccattaattttgactacttcgtcgctgttgatctcttcctcctcttttttttatgacaggtattataatacctagctttcagaacgaaagccaaataggatacacataagtcgttttacagaaaaaaagcaatagaaaagaccagacaaaaggcatgaccagcatctgtaggatcgaaacacaacaactaagccaaccagaggggggtgaatggttggtataaccaaaaaccaaaacttttagcggaaataaaagttaccctcaaattcgatggagatcagtctgaccaagattgatctgccggtctgatcgtgcctatgccgtcggtctgaccggtgttgatctctcggtcggaccgccctggaatcgcctgtcgcccctgttgccaccgccggtctaaccgccttgcgcccgccggcctaacggccgcgatgccgccggtctgaccgccggtgtgtcgctggttagaccaccgaaacccggtgaaacacaaatcgaagaactcttgaagtggatgacgactttattgattctctctatgtttacaaagtgcaccaacagcagtcctcacaaaaatctcgaggaaactcgaaaccctgactcaactatcagctcaattgctcttaaaagcgataccgagaagtctcacgctccccctctatttataccctgaggtaggcagcctaaagccacaaaccaaactcatactagaaatcctaaacaccttaggaaactctctagtaaaagaaacaaactttgcatacccactcataccaaatttggactccttccaaattcgactccgcatcccatacgcacacaataactccatcgtatgccatatggaatcttcaccaaccacgtgtattgaactctagccttagtatcctgcatgatctccaaccaccacggatgtcgtcttatccgcaaaccgactcccggtccatcaccgcaaatactctcctgaggcatcgagtcacctacacatgaaataaacaaagaaaccatattccgagaccaagctatctccaacttgactcattgttagcaaacaacagtattacatacgcatagtatccatctagaagccataatcatgaaacaatcacggatatccaaacaaacaacccgaaaccgaaaccgacacagagtcggccggtcagaccgcgggctgcgccggtctgaccgtgcgatacacgccggtctgaccggcaaccgcagcccggtctgaccggtcacataaaataacagcacctgtaattcacctgtaaatccaatcatctccaaaaccacttcgtgaataaattccaaacatcaaaactgataatctccgatgccaattgtttatcacagaataataataaaaaacacctttaattttacagtctcccccttgatgaacactttggcaaacccataaaaaattttttggtgtttggaaaaaaacaaaagtggtaaaaaacacacttcgtacaaacgtacacatcatgctcaaaagtccaaaagaaaacttctctcacttttgaaaagaaagaagttcccaatcgaaccaaaaacaacatgctcacttttcaactcatttacttctccaaaaaatttcaccttgcgtctcccccttttgacaatgatttcatcaagcataggaattatgttcattaatgtagatgagcttagcctacatatagcatatcatgtcatgtgttgcaataaaaagaagatgaacccatctataatatagcaagcatgcatgaaagtataaccatgaaccaaagattttacaattaagcttgaatcaacaatcaaaattcatgatttcatacgatttataatgcaacaccttaacaaacacataggttgaagaataaaaactaaacacatatacctattgcattaatcactctttctcaaataacctttagcacaaaacaaccaagagaattttttactttttctttgtcttgagcctttttgctcaattttttctcttttattccgggtacgtccctgtcgtcgatactgttttcagggatgcggcacccattattttgctcacatcgaatacgtccttgtcgtcaagactgtttccaaggattcggtattcatttttttcatatttttattctcttttcacaatgagcaactaaagctatttgaggaataacaattcaataaagcatatatatagagagcatttagaaatcaaaccacatgctagcatcaacatttcatatttacttaattcaagtatagaatttaagtgtcatgcatcatcttccttaaaagcaaaatctaaatctcatgaaaagactagtatacatacaagctatgctagagacaaataaaccttcaaagtatcgctagcatgcacaagaaaataccatatgtataacacaaagctctcttttctcaatttttctcattatcatatttttgcttgataaaaccatgaggtgcaaaactccccctcaaatcatgccaaaaggatgaaatattcccaattcaccatgaagaaaaacaaagcaattagaatccaaaggtttagtgaaaatatcagcaagttgcaactttgtgtccaaaaactgcaattcaacatctcccttctcaatatgatccctcaaaaaatgaaagcgaatatcaatgtgctttgtgcgtgagtgttgaacaggattcttagcaatgttaatagcactattattatcacaaaagagaggtactttctcaaaagtaagacaataatctttcaaagtagataaaaaccaaataatctgtgaacaacaactagcagcagcaacatattcagatttagcagttgattgagcaacactagattgtttcctagaagaccatgcaatcaatgatgtaccaagaaaatgacatgttccactagtacttttcctatcaattctacaaccccaaaatcagtattggaatatccagttaagcatatagaagatgaagtagaataccaaattccaaactcaagtgtatgattcaaatacctcattattcgcttgaccgcttgacaatgtgaagcacgaggagaagcttgaaagcgcgcacacaaacacacagcaaattgtatgtctggtctagaagcagttagatacaacaaagatccaatcatacttctatactctttttgatcaacagctttaccatcttcatcaggatccaacatagccgtagaaccaattggtgttgaaattggcttgcaattctccatcttgaaccttctcaaaagatcctttgtgtacttcgtttgatgcacaaaagtaccttgaggtgtttgcttaatttgcaatcccaaaaagtacgataacttacccatcatgctcatctcaaattccctgcgcatagtctccgcaaactccacaaccaaagcgtgagttgaacaaccaaagatgatatcatccacataaatctgaataaaaagttgattatcaccatgcttaagaacaaaaagcgttttgtcaacctttcccattgtaaaacctttcgcaagcaaaaagttcttaagcctatcataccatggtctaggagcttgtttcaagccatacaaagctttagacaatttaaaaacatggttgggaaaatcaggattttcaaaacctggtggttgtttgacataaactttct

SEQ ID NO: 80476 - DNA, 72475 bp, Oryza sativa
ctgagatatcaaaatatttcgtgtacacccaaccattgaccctttgctttccttccaagttcttatgctaattatatttgttgaaatgtagtctacatgatcatttacatgtattgtatacatctttacagaagagtgagggaagtgctgttcccactccatgggctccaggaatgggtaggaacatcgaaaagtatgttttgagggaccaggtttgttcattctccgtataattattgattgacctctcttgtctatgtaaatgctaattactgtgagttctttgtcagcaagtaaatacattgtcggtagtgtgattaatcataattaacaaatatctaggcggattttaaggttctggatgtgcatatgtgatccgctttgttgtatgcacaacaaaatcatttaaatttagattgaggcagctatgcaatttagtgcaaagttagattcaggtggatgaactaatcatgggatcagattctatctgaacaagtggataggtggcgcatgtctagtccattaagagagatttgcaatgttcttaaaattagtgaactcatttgctgacatgaatgccatatttggcatgctaatagaaatctgtccaattttattgactatctcatgcattcattctatttaaaaatctgcatttctaatttacatgagcaaatcataaatttggtgcaggttgctttaagtagcttgatcactcagtgattatcaattatatatctgtcttgttgcctttggtgcttagtagcgatttgattatcaattgtttgtcttgtgatatcaggaaacccgatatcgtcaacgatatcttgatctcatggtaaaccatgaagtgaggcatattttcaagacaagatcaaaagttgtctcttttattcggaaatttcttgatggtcttgactttttagaggtgggcctgtgcaatctattctgttattcttcttttgtatattcttccagtccttcaaatctgaatattctatgtcttttctaggtggagactccaatgatgaacatgattgcaggtggagcagctgcaaggccttttgtcacacatcataatgagttaaacatgaggctttatatgcgtattgctcctgagctctatctgaaggaattggttgttggggggctggatcgtgtttatgaaattgggaagcagttcaggaatgaaggaattgacctgacgcacaatcctgaattcacaacatgtgaattttatatggcatatgcagattacaatgacttgatagagcttactgaaaccatgttatctggtgattatctcttgatgtctctgaaacatcttttttttctttttattttaggaagtaatagtatcttcatgtcaattttgtatgcaactgcaaaatgacctaaatgcattttccttgttccgtaggcaattcatgatttgctattgttctgtcatatcatttttttgccgtcctatcttgtttttactgaaatcaacatgaagcagcctgttcattttatctaatgatctgattttatggttgacaggtatggttaaggagttgacaggtggctacaagattaaatatcatgctaacggagttgagaaaccaccaatagagattgatttcacacctcccttcaggtagagacattgggatgtatttggattacatgtattgctctatatgcacttttaactggtaatgttcagttgctacaatgttactttgcctttaccttgctgcagaaagatagacatgattgaagaattagaggctatggctaaactcaatatacctaaagatctctcaagtgatgaagcaaacaagtatttgatagatgcctgtgccaaatatgatgtcaaatgcccacctccccagactacaacacggttgcttgataaggttgtttctttacccactacacattctttttacactgtattttgatatgattttcgttaggtgattttgctatcttataatatcttatttacatatatgataagctagccactttgatatgaagaagaatgtccggtgtaatcctttttgttgcttccataatgtacagtacatttctgaacattttcacattagctcacaaacaaataaaagatctggggtatattgcaaaatccaacctgaagctatttgcttaaattttaatataccttttgcttttgtttcccttttggtattccttagccaaattaataaggtatatgctctgctctaacagctagttggccatttcttggaggagacatgtgtgaatcccacgtttattatcaaccatccagagataatgagtccattggcaaagtggcataggtctcgacctggattgactgagaggtttgagctctttgttaacaagcatgaggtatatactaagtcttcattgatactttcatacttgtcctcctttctgtttccttacagtgttatgaaatccattttttaggtgtgcaatgcatatacagagttaaatgatcctgttgttcagaggcaacggtttgaggaacaactaaaggtacttgttagattttgtgaacatttgcaaattgtatatttttctttggtaccagcctgctcccaagcttcgagttatttttggtattttggaacatctaaatagctttgcatagtatataattgttggaaaccaacctactcccatatgtggtatattttggtccatcattttaaccagcgtactcattatgcttgggagttttggatccatcatatatatacacacacttgtgtttgcattgttaaaagtagtggtaagtcattggaagggtgggatatgaagtgtcaaacagacaaacagagtatggacccttacaccagtggcagatttattgttgcatggtgtttccctagcttcctatgtggcttgctgaaaaactgtacatgttcttacgtatattatgtgccaggatcgtcaatctggtgatgatgaagctatggcattggatgaaacattctgcacagcccttgagtatggcctaccaccgactggtggttggggattgggaattgatcgccttacaatgttgctgactgattctcagaatatcaaggtctaattatttcttcatttgtacttttgttcctggcattttttatttggtctttattcagttgaggtatttaaaatgctcttttgatgcaaattcaggaagttcttctattcccggctatgaagcctcaagattagatatgtccacaaagcaggaacctgtcagaagggtacgtccatatacttctatatcacaaagtaattctttatgttttttgcccttttaagcatttatgaattttcatattgtacatgttctctaaaatgttaaatatccaggacaataataaaaaccatgcacttttttagggctagtagcaatgtagcattatgcgtataacagaactttgtaaagctcagggtttcatgcgcttattcaatcagcactgattcaattgtgtcgaactatggtcataaatgaatgaaatgtgcctcactattttcaacataccattatgtcaatgtttggttgggggttgtgtcgaactatggtcataaatgaatgaaatgtgcctcactatttcaacataccattatgtcaatgtttggttgggagaaactatatttgcattggacatgatttaggatgcaagtttgtctattgaatggtatgtgaaacatttcacagtatctcgttccaaaagaacaagtactgtaaagtttttttgtcatgcatctgtagattttggaaggaaaagactggaatatccctcaactgtagaattttgcccgccctttgtcaaatgccattgtgctaactgtacttctatgctgcagattaaagcagactgaatgctgactgagaggatttcaattggccctcgagatggaggatttgaaggaaacttataattttgttttaattgtgcatgtgaggtttccatgtcctattgtactttatttttggagaacattggtggtcagttaagcaaacagttaatctcgctgcaaagatatcaagcgtaacttataagatgacttaagtttgtgcaatttctgtggccttacttgaaaatgatagcgcgttatttgcggtcttgaattttgattgattttggaatgggtggagctggaaagatgatgctacgttgttggaattttgacgcacaattccctgttcagtaaattaatgtttatttctgcaaaaccaattgatttggttggagaacattggttggccgactgaagaatgtcgaacgtctgctccggtcagggaatgtgcaaattaatcgatgtgatgctgatagcagcgacctgtagtattgcagcctctcatctttttcttatgcttatcagctaaaatttaaatttttaatcttaaatttggagttgattttgaggttgtttttatcgaagtttattttttaagcctttgcttttagacattacgaacacatataattacaaatatgttgtttagcttatttcccaaataagtggaacgtttggggctgttgatcttgccagcttctcacgtagtacactacaacatatcacgcgccaataaaaggcttaggccctgtttagatgggactaaaacttttaagtccctatcatatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattatgcttaaaaaatttgtctcgtgaattagcttttatttatgtaattagttttgtaagtagtctatatttaatactctaaattagtgtctaaagatagggactaaagttaagtccctggatgtaaacaccaccttattaaggagaatgagaaatcatattggataaaagacccctttttaaaagattcgtgtatttattcaatatagatgtatccatgagtcgttgggttcattactgtaagataaactagattgataccccacgcattgttacaggattttatggtggtgataaacaactttgcaaatatatgcttacaaacagaattgaagaatggaaatatcaaaagtagacattcaaaaataataaagtgtaaagttggcatttgagtagtagatggtcaagggacatagcagtggcttaaaccactcacataccatgtataaaatgctaattgaagaggttctattaaagagaatgaagttagtatataacactgtgggagcttgtagcagttgcacctttaagagatgtgaataccacaaatgtactatgtataaaagatctgttaagaagaataaagttaggtatatagccctgtttgagagagtttctatcagctatagcttcttcaagaatctacatctcctcaaaccatccagatttttattcgaaacttgagaatatggagcctcaacaagacattaatttgtttttgctaatttcgaaaaagaaccccacaaaattctgaacaaaaacatttgaaatgaacctcaagatctcattccaaacttgcttgagatgctcgaaatatgtaaaatttgagtgagatctcatgaaattgtgaacgcctgatgggatgttggagagatagatgagtgcttgggtacgtggacagggaggggaaaaaaagagaggaatagttggtagttcatatggatgcgcacatcctcacccttgttgaggtggaattcacttctatgtacaattgcaattaagctctatatcctttccaattaaagatgtccaattccaatattcttaatctaaatgttctaccttttgttgagtggaacatagatgcttcatcggcagagaacaaatgctaatcttcgtatgtccaactagcaatcttttgtaatagcacctatacatggttgttgtaatttatgtcagtgatgatatactgatctccactattacaatattctagtatatatgcaaatcaggatcagtcttaatcagagtgttctaattaattaatactaggcctttttgagttaagtgaccaccctataaaaggccctcaaaccaaccaattattttactaacacatttggtttagccataaaaagtgttaactgtttagggcacccgcaatgattatctataggctctctacaagagatccatgtcagcatatttttctacttggaagagattaaatgaagagagagagcaaaactatctactaacctggagatagtctatagagaaaaacgagacaatggattagagagctatagataccgttgtagacataccattgaagtggtttactattaatctagtctattgctgagatgtacatgttttatagatagcaacttactttaccattgcgggtgctcttaggataggttattaatcataacaaattattcgtgcacattgattaccccaaagtctataattgttaatacagggaaggacttgcacttgcttttctgggcgtggggacaggagaaaggtgccaactgccaagtgtagtggccggagaagtggagatctcatttgtcggtgcagaacttgtggtgcaagctccatccgtagctagggccatagaaaaagcgttcttgtccataattcgatcccagtggcctctctgacacgcagcacattgcggattcgcggttggctctttccttcacggttacgaaggctgtctcatctcctcgtggaaaaacattattcagcgtgtgttttttggtcctattattgatcgatcatgcagctcgcatcacggtccatcaagctttgatgcctcactgtccatcaagcttgttgttgtccatgccggattgccggtcgatcgtacgggtcttgctagttgcatgcatgtgaacctaacacattcatcccgcatagagaacaagataacttttggctgcgttctttgctgggaactcccaactccccaccatcgttttctgcatgcacgcttttcaaattttattttacaaaaaagtttctatacgaaagttgcttaaaaaattatattgatctttttttaaaaaaaaatagctaatacttaattaatcacgtgttaatgtgaacatcgttttgcgtgccaaagaggaggggttcccagcccctcctcctgaacgcagcctaattactcctttcttcccataaagattttattttttgggtttttatctaacgtttggccatccatcttattttaaaaaattatgtatttttttaaaaaaataatcagcatatacttcctccgtctcatgaaaaacaaaactaaaactagaacatgttgtgacatacttcctctatttcaaaatataagacataaccacccttaacctaaagatcaagaaataattattatcacctcatcgtttagattacctaataaatagaacgcatgcacctaataaaattagagatcttgatggtggaggatttaaataataatattttagtggaaaatgtgtgctagttaatgacatgcatgcatgcatgtcttatattatgaaaacaatttttaaaagtagttgtgtcttatattatagaatgcagggagtattctagtggtaggatgtgtcacatcctgttcaaggtttgttttttttttaaacggagagggtaactagttacgtataagttaaaaataaaaatgaatcaatatgatttttcaaagcatcttttctatagaccttttttaaaaaaacatattattccacctcttagcaattgggaaaacacgcacacaaaacgagggagtagaagagtattctgaacacagccttagagtaagtttaatagtatagcccactattagctccaattcatctatagccaatgtaatagccaattaatacaatagttacttactatactattaatatatggtcccacctgtcatacacacactgcgtcttggagtccgtgctgcagctggctacaaatctatagcccactgccttctctctcatcttttatctcattaaaatatggctaatagtatgctattgtacctgctcttataagttcgtttccactacaagcagtggataaagttttggattttcgtggtacgcttttcaaactgataaacagtgtgtttcgtgcgaaaattttctatatgaaagttgttctataatatcagattaatccatttttcaagtttataataattaaaactcaattaattatatgttattaccacctcgttttacgtgaaacacttaatttttatcttcgtctttatcttcgtaagattcaaacaccaccatactagttgaaatggagcactttttatatattagtaaacgggattgtacagtaggacgcaaatcgtctgtccattaaacaacaggcccgagaagaaggatgatggggccggacggccggtccggggaagtcgcccgtcacaatccgaaaagcgcaaggaggaaaacgtgagcaagcgaaaccgaacaaccaaccaagcaagccatgcacgcgcgcccgcacgctgacgcggcgccgtgtcgtgacgcgccccccggaattagcaccagccgcgcgcgggggcgccaccaccggatcagttcccccatccgcggggcccgggcccagatcacgcgccgtgacctgacctgacctggccccgcacgccacggccacggtgggcggatatgccgcgcgcacggccgcggcaccgcccggatatgccgttttcccctctgtcgcccgcgagcagatcacgcgggagcgcggcagccaacccgaaaaggcccgggaatatgcccacggcggtggtggctatcgataaacgaggatggagaaaaggcgggggtttggtttggactttctgccaccgaccgctgctttttagtacgcgatctcgaactcgagatcccttttgcaatctcgtcgaaaacggctctcggtttcacatacacccaactagtcgtcctaccttgttataatcactactaatcaatgaacacacagggagttaattagtagtagtagtaataaactaacaaactactaacacacaacttgatgattagtagccgttcttaatcaggcacgcgtatctcgtgtggccaggaggaggaagaagagcaaaaatcgcaaatccggaaactggagtagcagcatcagcagtagcagtactaaacttgtactgcaacacatggcaagcagccagggagagagaagaagaagatagagatagggacagagagagcctgtactgcactgcactgctgcctagcctatctatccatccccatcgccacatgcctctcctgcagctgcggcctgcggccaactcgtagtactcctataaggcaaggcctcgctaccccaaccgtcccctttcgcctccgcgtttcatctcctcgcctcgtctcgcctcgcctattggccgcccgctccccgcatcctcccatctcgccgcgttatcgccttccgcctcctcctccgccgccgcctacgcttctcgccgccgccgccgccgcctacgcttatcttgttgtgctggttgcatgcgccgcggcgcaggggctgacggagaggggtgcgcgtggaattgagaggagtggcggatggaggcggtggaggagcaggtggcgccggagcaggtcatcagcacgaggggaggctcggtgctcgggaagaagaccatcctcaagagcgaccacttccccggctgccagaacaagcgcctctcgccgcaaatcgacggcgcgcccaattatcgccaggtgcgttgctcctcgttcctaatctagtaataatctggatggtttccggatcagtccgccgcgcgccgcgaattccttggtttccctggcccccccattccatgcgttcgcgacgggaatctgcagcaatttttggctccaatcttcacgaccacggaagaaacctgccttgcctgtttatgtctcttacatgttttgtgcgctgattgtctgctttatcggtaaccttgtgcagcatgaccgattcttatgtgcgcatcctatgataattttggtgttctttccggaagtgcctttacttgttttcagaatagtaaatgtaaatctcaaaataaattagtacaagaatgttaacacttaatgctatgcaaattgcatttggatttcttgatgatttttgttgatcacactgatgaacatgagcattaacacttccaatgcatatctatctgggctgtttctgctaaggcatcatagtcttcgatgatagaagatataacatttaaagaaaaacaatgtgaaggccgcatggaactttgtatgaactaaacaatccatctgacgtgtttattataaactcttgaatgaatagtcctacaaaatgtgttctccaatttgtaattttcttgtgtcctttttatccagtaaagattcagcaacagcctgggttctcaatcatctataattttctgtcatttactcactgttgccaactgtttttcaggcgggttctttacgagttcatggtgttgcaatgccgacaatgaagggaattgtaaatgtgttaaatcacattggagcacaaaagaaaggaaaacaaacccaggttctatggcatagtcttcgcgaggagccggtaagaacactggtcactgatagaaaattaagcatctctagcataagaacattaaattatgctcaccacttcaaaactacaaaaggttggaaacttggaatgaacaatggattttgaactgtctagaacatccgtttccaattctcagtaggtaggcataaataaataaaaaaacatagagaagagggtgtgtatttttcttaaaaaaatatatgaaaaggtttctaagtaatatgtacttatggaaattacataacttgacatgcatgccttaacagtatgtaaatttcaaatttcaagtgagttctggaccagtttgcttagcttgcagtaagtgtcctttgaacaggttacaccctttccttgttacaacaaatactacttctccctataataggatagagtagtaccttatatcttttttattttatgtttgacaaaaaaggaacttagtaagttgtaatttccaccaatgttgtacaggttatctacatcaatggtcgcccttttgttctgcgagatgttgaaaggcccttctcaaaccttgaatatacggtattctttgatgtttgtcttgaatttttctagtcatgcctagagtgtgtatgcagtatgtctctatgtttcttgtttttgtatgagaagtccatgaaggtgttaaaccaaaaatattttttcttgctaaacatccacagcagaagttatgatacagatgtcctgagacccaggaaaatatatagctctgtttcttaaaggaatgatgatgcattagtgctattgcagacttggaatgcttttcctgttaaatctcattttgatttgggtaattctagatatgttttcaaggctatagaaacatgaaccatattgagaaggcctatcccttcaaaacaactttgattccacatgaagttactattgttctattatcattttatttttccattttaacttttttttttggtatatgtactactactgtagggaattaaccgggaaagagtggaacagatggagtttcgcctgaaagaagatattcttcaggaagcttcacggtacgtcggctgccaatattgttttctacccgtatttactcttaagaggtttgtttgtttgttttacctgaatatttgatggagcagatatggtaataagatcctcgtcactgatgagctgccaaatggtcagatggtggaccagtgggagtcagtggtaactgatacagtcaagacccctcttgaggtaagaatagattcaaggtttggttatattgttttattatttttagtccctttgagaatttgtttcctttgtataggtatatgaggagttgcagcatcaaggataccttgtagattatgagcgtgttcctattactgatgaaaaggccccaaaagaaggagattttgacaatctggttagttctgtatgctttttttgaactgttagttctgcatgttactgttgtttccctatgtgcgagcttttatgtttagttggaaaaggtttaaactaatttgcacagttgataggatccacatttaccagggttcaatcatctatagactccttgtgattaatatggtatactgaaatttggttcatatgatagttgcataacattgaactccactgtttctaacaggtacgccgaatctcccaagttgatatagaaactgaaatcatatttaattgtcaaatggggaggggaaggacaaccactggtatggttatagcaacattgatttatctgaaccggataggatcatcaggtaagtacagactgtaatttgattggtgatattgttgcttcttctacctatatgtacaattgattgataaacagaattctccatacagactgttgcctattttgaaccatcatgtggtgattttgtatttactgagtacaaatctactaaatgcacatcatagatatcttttgcattatattcttacattttgtgcctgtaggttcgtgtttgaattttcttatattgagttgtgccgggtgctattggctgcaggtatccctaggacaagttcaatcgggaaagtcttccattctggaaatgatgtagatgactatatgcctagctcagaagaagctatcctcagaggagaatattctgtcattaggagcttggtacgagttctggaggtaatatcctggatctgttaattcatatcccttttacattagacacttagtgtggtcattttttgatttcatttgttcagggtggtgttgaaggaaaaaggcaagttgacaaagttattgataaatgtgacacgatgcaggtataccattttatgctcttcatgatactaacttaatacagctatattaatatatttgttgttatgacttgttgtgactatggcagaacttaagagaggctattgctacataccgcaatagtattcttcgacaacctgatgagatgaaacgggaggcatcactttccttctttgttgagtacttggaacgttattacttcctcatatgctttgctgtctatgttcattcagtgtgctctgctcaacaatcaaacttttcagaagaagttagtttttctgattggatgagagcaaggcctgaactgtacagcattcttcgaaggtgagccgtggcaccttactataaaaatagtaccatgtacagcttgtaagagtgtatgcaggctaaacatggttctgttttttatacatgagatgagctcttaaaaattaacatgtccattttgttttatatcactatactattcacaagtaaggtggaattcttatattcagtgtaccaatatgtacttactttccttgtaacacattctggactttcattttagatcttgttttagataagatctcaatgcttcttcaatattttgtttggactaattactagggtacacaggcattaatactaggcagcctttgtgtccaagaaatattagtcactgacatttcttgaatcaggtcatcctggtgtcaaaaccatggattgaaaaagtagtcgttggctatttcatggagctaggctcattgcctattccttttcccttctctaatatctttctcaaagtattgtgtgtgtttttgtaatcttcgataagcattaccatcatggttttatccaaattaatttgaactcacctctttatggcttggagaactggaagtaaatagtaaaagatgagctaatcttttagctcttgatcaacatgcaagttggaacaaacaattttacttaaacaacaatggtagttttattatcgagtctatatggcattgaaaatatgaatattgacatgactaactttttgaaaattggttaattcattacaaattcaactttatgaagagataatttaagcatggataaaaaggtcatactttgcacactttcgattttaacagttgtcttgatgagtgtactatgctctctttctgagtcatcatcataacttctgccgtatctcatccaagttatatgatatgatatgattgatatatgaaaatcactacagtaaccagagaccatgtttatctttgcttctcacactttgtatttattgagctcttcataacagcaagagctgtcacaaggcctcaaccttaatttgacaacccattccttgcaccacatgagaaatcacaacattggtgaagtttgtggttcaggagttagtctatagcatgcacaggattaccacattaaaagaaaacaaaatccaggagtaatttgtgaaatttatattggagatcaataagtggtatggatttatagctcaatattacagcgtatttactgtgtgtatttgaagaattaccgcgtttgttttaattaaatgtaatcagtcaatttactgtgcgaaccctaatattaaaacggttttttgtatacatgacactagagaagtgctctcatcttcgttctttgatgtgttcccatatctgtccttcaaaaataagggaggaaatgaaggataaaacagatcccttctccaacttaggcattttgcattttaccattcatcacaaggatcttctaggcatgaatataccatataaatattgggaaatggattttatgcacatagtgcatatgcacctatttaactgtaaactgaaatcttacttaaagtttaaaaggtcattgttttcatagaggacaaggtggtgtggctacatgtactggcttctatagctttgtttcatatggttgctgcttcacggaaacctgctttagccactatagcgtgtagcagcacatgagtacaaaggcatttcatgattccatatgagccatgcattgcatgtggagtcctgatgcaaatttcatgttataatcatacaatgtcaaagggtaaagagcagaaaggttatattactctatttccaccatacactctgcatgcttttaaaacactggaaagtgtgtatgatgatgcatattcaaggacaccgtataaaattatccattttagtaagagcatcagtaactttttgtcttttggcataaccagtaaactcatatttttacattttgataatttcaggctgttgaggagagatccaatgggcgctcttggttattcaagttcgaaaccctctcttgcaaaaattgttgaatatgctgatggacgccctcatgagatggatattgttgctgccatgagaaatggagaagttcttggacgccaaactgtgttaaaaagtgaccactgcccaggttgtcacaaccttcatttacccgaaagagtggagggtgcacctaattttagggaaattcctgaatttccggtttatggtgttgcaaaccctactgttgatggcattcgagctgttattcagcgtattagtacaagcaagggagggcgaccaattctgtggcataatatgagagaagaaccagttatttatataaatgggaagccatttgtactacgtgaagtggaaagaccatacaagaatatgctggagtacacggtatgcatcatgtctggttgctttgacagatttgtaacatagtggatgctcaagattatttgctctaaccctaggttaattttgcacctgatctaacatagacttgtaatttttttccttcctgatgtatcagagtgcaccaatgggaaaactctcataagttattttgaatattaatatccatagctaagctaactatatttgtttcttttaactacttaacttttaatctgaagtaactgtccaaaggacttgttctaattctggttttatgaaaactttagttctttgttcagtttttggaatttgtatacttgtctactattgtgtttcgttgtgcttaataaactaatacttgaagcatgtgctctgttgagcttattcccaaaactgttctgttggtctaaatgatacacaatgcaccaacaccagggaattgatcgtgatagggtggaacgaatggaagctcgtttgaaggaggatattttacgggaagcggaacgctatagtggggccataatggttattcatgaaactgacaatggtgagatatttgatgcatgggaaaatgtaaataatgaagctgtcctgactccattggaggtgtacaaacttctggagtctgaaggtcttccaatcaagtatgctcgagtgccaatcactgatggcaaagcccccaaaagttcagattttgacacaataaccttaaatgtggcagctgctcacaaggatactgcatttgtttttaattgccaggtactgcacttcatttgttttattagtccagaattctatgttaggcaactcttgaattatatgaaaggctacaaaggttgagtttaacttactgatttttgtagatgggcaggggaagaacaactacaggtactgtgattgcttgtctgctgagattgcgaattgatcatggcagacctattagattgccagcttgtgaatataaccatgaagatccaaatgaattgggttactcaagtggagaagaaacaacggatcacaatggtcaccttaattcaagttcaccaagacctcatactgtgacagaacaacatcctagatttggaattgatgacatacttgttttgcggaagattacaagattatttgacaacggaatcgagtgtagacaaactttggataatgttattgacaaatgctcggctttacagaatattcgccaggctgttttgcagtacacaaaagtaattaaccaacagcatgtggagcaaagagttaagagggttgcattaaatcgtggtgctgaatatttggagaggtacttgaaattagttgcattctcagcatatctttggagtgaagcatttgatggtttctgcgggcaaggagaggcaaagatgtcatttaaagcatggatacaccagaggccagagatccaaagcatgaaatggagcatacggttacgacctgggcgttttttcactgttaatgtaaatatcctcatctcttctaaccaaaaatatcatttttgcacctttgaggaaatggcaccattagttataatttactatttgtaggatgaatccaaagcatcttttcagccttcacaaggtgacgtaatgatggaagccattgtcaaagctcgtaatggttctgttttgggaaagggatcaatactcaaaatgtacttctttcctggacagaaaaggtcaagcactattaacttctgtggtgcaccacaagttttcaaggtatttttatttgtaacaaaaatttgcatttaatagttgcctattcaatgcatatgcattttttaatctagttattcatgttattgatcaattctgccaattaaactctgccattcgaactttctgacccatcataggtaattggtagtagcgaacaaatatttctgtctacactccatggtgcagttatttctgcaaaaacataattgagtcatcaatatttctgcctcagtaacaaacaggatttccaaattttggagctttgatgttgtgcctcctgcttaacactaacagtggcaaagatatttttagtatgttttgatggagcatcagctttggtggaagcatgctattgcaatagtttatttgtttgtttggccttctttatgatcttctatcattcgaccatttgatttgcaatttagtttacagacttgcaaaatgcccattctagtacatgaacttatgtagtccatgcgaataaagccaagctgcacaccatggttaattttgtggagttggacagtgattaggatgccatgcagatgtataaatgaggaagagtcataggaacatacatgttcaatcaaccgtatgataatgcatgatggttgtacaataaaatagtacattgtatagaaataattgaagaatgtatggataggaatagatgaaggacaaaaaagccaaaaacaaggagttatttgatataacatgtaacacacggtccttacatgtgcacgtgggccatgacatggcgccctaatcatcacccatttcatcaagattagctacggtatgccgttttggccttggttagttggtttgcatgcactacacttcttacaccaaaatgaacactttataagtttgtgtacttacccccacctcacaaattcagatatcgccagcgtaatttactcatgttatatcttatatgacacatgactttagtagagctttcatgtcttagtgatgtagacaaaagattagtttggtagcacctgcacttcaaagtccaaattctgggaattttcgctcttcatgcttccagtgtttaagtgttaatttatggacaatatcgttcttgttccattacttttcaccgaatcctcccagctgtaaaggtcagcttaccatcccaatcatgggtgatgtatgagttgtacaattccatttctagatgactctagagtctagagccaaagtgcaaacttttgtttgcgaaaaggaacgggatgaattttgccctggtggtttttacagcatcatgctcgtcgtaatttgtccctcctgcaccaccttgcctttgcaccatccaattccaaagccacagcatgggtcaggccaggatcatgcgatttgcttgcattcttctatgtccatccctattggctactgtttgctaaatgaacttgcatcaagctagtgcctatgcaatgctcccactagaatgtgaggctgatcctagttaacatcatgcaacaccacagttgaactgctataactgtcatggctcatttcaatggttcttgtgatgaagtaagaaaatcacttctaataaaataaatgctaccaattccaacctaatcccactgagatttgtttttattatccagtttcaaagaaatacttgtgaacagatggctattacattatctcaataaagagcgatgatgttagccaaaagattggtaatgtttgcatttcaagatgtttgatgtcagagccacatcatgaaattctggattaaacattcatttcatttacgtgcagtgggtgtgaaaacctatactatttctcacttctgtgtgctacttatactagttgtaaagaaaattagtagttgcatttcttctggcaacagaggtagtgcatgtactaaatggaagtttcacttttagaaaactgattttataataaaggattacttagtcatgtaccttattatattttttaatattcctttcaggttgatggataccctgtgtatagcatggcgacaccaactgttgatggagcaaaagaagttctgtcatatttgggctctaaagatactgggagaagcattcctcaaaaggtggttgtcacggatcttagggaggaagtggttgtttacatcaagggaacaccttttgttttgagagaactagatcagcctgttgatactcttaagcatgttggcataagtgggccaatggtgagtttcctccaataatgtaaatattattttcatggcaaaccttaaatgatcttctatgcaggttgaaaacatagaggcaagactaaaggaggatatactctccgaagttaaacaacaaggtggtcggctacttctgcaccaagaagaatttaactcgtcaacaggccaaagtagtgttgtaggtttttgggaacatataggtacggaggatgtgatgacaccggctgaagtatatagtgtactgagaaatcaggggtactgtatcgactacaaaagaatacctctcaccagggaaagagaagcattagcttctgatgtagatgcaatacaatcgtcggttgatgagtatgtgccctaatccacaacttgatatagcttgacaaattgtgttactcagttgcaggctataagaatgatttgcttctctacaggaatgctaggtactacctctttatttcacacacaggatatggtggtgttgcttatgcaatggccattacatgcctgggactgggagcagatgaaaagttcatcatggaacaaacagcagaaacacacttcatatcaacttctcttacaaaaagtgtgtctatcaaaacatcagctgatatagctctcaagcaaggtgactaccgtgacatattaaaccttacaagggtactggtacatggcccaaaatgcaaagaagaggttgacactgttattgacaggtattgtgcaggtttttacttcattcaggcatttatgtaaattaatcaatgaatcatagttatgaactaacggggaacttatattagtttagtcatagatgttactcgtgtgattattgctatgcatattctgaaaaccaatctctcatgaaggtgtgttggtgctgggcatttgcgggaggatattatgcattacagaaaggcactgcaagattgttcacttgatgatgatgagacatggtcatatctaatggatatgggcactaaagctttgaggtaattttcatataggattttctcgattacactgctttctcttcatgcttagaaaagccacagtagtttaaatgtgcacgccccttgcatttacatttgtattgagtaattgactatgcaaatttgttaatggatagagtttgtcctgcttcggcaatttattcggagtgcacactccatttcatgagaatcttctatgcatcatgcaaagtacttactgtatttactgcaattttcatagttcgtatgtagatagcataacagttatatgaacaatcacgcataaaaaattgatcacgatactttattcatatgcagtttgaatgcattagagaactcatattcagggattgaaaaaggaatctcgacttggctgatcaaaaaccaccactttctttaagtgtatttcttcaacactaagcactctgcatgcgtgcagtggatgtctacaaatatagcatagtttctaaaatttaaaaactagaaaacaaattgcacaagtattcatatttagatcaaaatagtgttagtttttgggcacccaagatatagtcacttcaggaggttgctcggtttagttaaatgctaaacagttgcttgatcaaaaagaatgacactgcacaaaattaaggggaaagcacttgtcctgtggaatgtaacaaaaaatctaagagacattttctttgaagaaatatgttgggtttttctgagctgaataaatacaagctatatgtatagcattgtgtttgggtgtagcagtatcctagacggtcggtcctacatgtttacagtatcctataggctgtgtcctaggagtatatgtttccagttccagatggtcaatctcttcccaatatgtttccaaattattaatattatgatttcaactgtttaactgcaggcggtacttcttcctgatcaccttccgatcctacctctactgttcatctttgcgtgagccaacatttgcatcatggatggaggccaggcctgaacttggccatctctgcgataatctaaaactggataaatagatatatgagttatctctccattggatcattgaacagcttgctagttcgtggacttgaggaagatagggctgaaataatttcttaggaaggaggaaacataagaaccggcagaaaggagtagttcgtaggacattttaccagacttgttggcgccaattggcaccagcaaggatgtatatataattccgaggttaaattgtagaggaacatagctgaggttactagttttgtttttctccgtttattttgcaataaatgttatgtaatttgtttatatatatgcatatccttgttctgtctgcttctttatcagtaactcaaaactgttgccacatacggatattgtaatacgagctgtattatgcaagtgtacagtacattgtaaaaaatatatataggaaaagtttcgaaaagaatatactcctatatgggtgaaccgtcatccgcacactagcataaatttaaaaattggaataatatacatccagataactaagcgtgatatattcctagatttttcttttgcacgagcaaatctatactttctattttctatatagttgtaacttaataggtctaaaatttaagatgtaaatatgctacttcatcatctacaagcaataattctacttcatcatctactagcaataattataaacaaagctcatgcatgcaacatcatctacaattcatcgaattctacaaatcaatatttaagcatatcaaataatcaccttttcatattattttcacaatattttcaacataaatatgaatgatttttataatacttaacatatatttatccatataatcaaagcgcgagatatcatatttcatctgtaatctcctatcggtcttaaatttatttctctttgaacatagtttgtgaaagggtcaattaggcctagagagggggtgaataggctaatttaaaactttatacggaagctaaaactgagttagggtcggaaagtctgatccacagtcagactatccgaaaatatcagatagtctgatgttggatcagactgtctgatccactaaagagtcacaacaagcagatctagcacacaaacaagagtatagcgcaaacagcgaatagatctatagcagcacaattaagcaaagctaaagagaagatgaagagatatcaccaacaatgaagttcacggagttgttcccggagttcaaatctttgaggggatattactctccgttgaggagctcactaagagccgggtctttgctaaccctttcctcaagaggttgcactaagcactccttcttccactaaggggtatctctttccttgtggaggtgagatccaaccttcacaaacttctcccggccaaccacacgtagatcggtggctcgggagtgacacctagccgtctaggagtcctcaacctccaagaataacaaacaccacacaactcttggtcaaaccctagtgctcaagatcgagtgaaacacacactaggccctcaaacaccaaatccacaaccaccaagatccaccacacaaagaacaaggagggatttgagtgagggaggaagagttcaaagatccaaagcaccttagcaccaagctcaaccctaaagtgaatgtgaatgaatgagttgggtaaccctagaaaagggttaggtggggggtatttatagatcccccaaaatgtggccgttgggaagggaatcttttcatcccacctcggaaagtccgaggtgacatcggataatccgatgtttttgaccccccccagcaagccaaagacagagaacgaaattctggagaatttcggacaatccgatcgatcggatagtccgatgtcatatcggatattccgttatttttgagtcatgaatttcatcctctcacatagactcaagttccattgagttttggagtctctgggtcatcggatactccgatcacatcggatagtctgatttgaaattcactcaagaggaataaaaagcaattcaaaaccgagagtgaagttctgagaaatttcagatagtccgatgtatcggatagtccgaccttatatcggatagtccgatattttatgaccaacactaagaccaaagacagagggcaaagttctgtgaaatttcggatagtctgagcatcggatagtctgatcaagatcggatagtccgacaggaataaaacaggaacacttcaaagaaaggattttgagcactagtgttctaccaattatatgcatgtggtatccctcttaatagtatggcatcccaatactcaagaacacatgatacacaaggtttagagaggtgattaccacacaaattgccacaaagctttctatgcttaagttccactcctttttcatccttgcatacatctcaacaaaaagcattagttatcctctaattgtgttgtcattaacaccaaaacaaatgaggggtcctagatgcactttcagtttggcaaactaatatccgtttcactcttagctcgattattgagtaaagtgcattggaggtccataaacttctgtgggtgtgtcatctaggtcctagaactctcaaaatacatttttgtgtccctcaacttatctcatgtgtcatataggtccaaacgggctccaacccgctccgtgtactgacgtggcatgccatggtggtgacgtggcatatgctatggtggtgcctacgtgtcagtagaaaccatatatcaatcacatatagaaaaaaattaagaacatattttttctcctctcctttttcatttatttttcaaaattaaaaacattattttctcctctctctctctctctctcactctctctcctctctttttaaattttattttttctatgtgactgacatgtggatcgcactgacacgtaagtgtcaccatggcatgccacgtcatctcacgaagtgggttagagctcgtttggacctatatggcacctaagacaagttgagggactcaaaaatagggacctaagtgacatacctgctcaagtttagtgactatccatgcacttcactctaaaaattacttagtaatttccacagcaaaatacggagaatcacctagtaagaaatacggggttgttaagatcaatgtcatttcaaaccgtaccactcttggcaaatttgttagaggtgtgctttcatttaattttttttatcgaactttgttaaataaatatataagaaatcctgccaaaaactgtaataatgcactactgcttatactggtacaatattcagtttccaaaaatcagtactcctagttaacggggaagaaggatgtgagtttaaatacaaatttgaatttcaaatattaaattcaagtttagaatcattctaagcaggactagtagctatggtaaaatccaaatccggcaacagaggccccgttcttgtgagctaacagatggttggcataccgccacacttcccaagttcctagctttacagttttcacaaaaaattttttcatcgacgtttattatgggacatttttcaactttttaatatttaatttatttatttgtgccctcaaataatatttagtttcatccattgtccaccctaactaggagccatatctttacgatgtttgagaatagcacctattgtcaaggaaaatgcctgtcatactaaaagaggagaaaatgtgtaaatgtggtacgtctatagtcattctaatggcctgatggtgaaaaagggaggagttatgaaacaagaccaatgaggcaactaatgacccagtgcaatacgggctcaatttgtagtcattttggtgaaattaatgtgtcatttagggggttgctgctaacttagcaggtggtctttgttgccaaggcaaaagaatggctgtgttgtttggctgggccttggagctattcttatagcttgctcgagagccgggtggttagttttatagtcgggtttgtggttgtggccgttttttagttgtgttcattgtcgagcttgtggcacatatggttgttataatttaataagggtgtatcttgttttgtactcggggttataccctctcttattttaatataatgataaacggatcttttgggtattcaagaaaaaaaaaaaaggtacgtctaatacatgctcgttagctgtctacaaatacgcaaccagctcacgtactgttatccaggaagacttctgaataggcctgtgaacacgttgtaggcttgtaactatgtatagatatggagttggactcaaaatcaacccatgcgtcacgtgccataataattttgaaactcaaatcaacccatgtaccaacctagctaggcgcgtttttcatctcagcaaaccgtattttttaacccacatttgtttaaattttcatgtaaatgttagaaccaaattgaaatgggctgtttgtgcaagcgtggtctagaatcgtctttttaggaaaagttaatatataccaagttttcatacgtaaatcgttttacactaaaaattaaagccgagcccgatttgaatgtgttcgagtatgtttgcacattagattcggatataaatacgttcaggaaataaaatagagattaaaatgctaaaataacagagccagtaaaaaacactaattaaatagacaacggtaaggaatcatttagcaaacctagaggaaattaacaaagaattttttttatttttttaatggaacgaattgacgaacaaaattctacccacattgtccctatttgaaacagctctagccaatattattgaagttggatattcttagatttataaatctatatctagatttgtgtttacattcataatattaatttgaatgaattattttgtttgtgaaaatataaaattctaaatcactacaaattaactaaaaaccctaacgcgttgtttgttttcttgtttagcagttgtaactttctcttttttaagcacattttcaaataaatcttttctatataatagtttttttaaaaaaattcaaataaacacaatttttaagtttgtagtaatcaatattcaattaatcataagctaatggcttacctcattttacatgcaagtggaaattaaaggtaactgctactccctccatcttaatatataactaatttttaggattcaaatttaccccatatataactatttatagctctcttttaacccatcaaccaccctattttctgtagactataagtcctacgtgcatcaatgaaggggttgtttagtatcccatgatgtagcggtttgggctgtgttgcaaagcccaactattttgttgcagcagggaacagcccatcctcctgtagccgctgtagttagtagcggatccagaaaatcgattcattggtgtcataacgtgtctatcggtgtcatagtatactaattatatttagatcacagtgttataacatatgaataagcagttttgctataggttttgccgaaaatcgtcggtgtcgcctgacaccggtcctagtactatagatccgcccctggctgtagttgtaggtgcagcgctgcagcatgttgattctccgaacaactctgaagggtgctatgattttttcgccttcactccttaatccctccaaaattatctagaaatatctatatttcggagaaaggggagtactgctcactagaactgagcttaaatccaacaaacaaagttttagaattcatcaccaatacacacttcttttagaatttgccacccaatttacttttcttttagaatacaacactaggctgcgaattttcttcattatgtgccactccatctaccagcataggttgccccatccttgttaatccgcccggtgttgccgtcgttcatccgtcggtgctgccggcgttgtccaaatttgattagcaaggaaaaagttaaagagggaaatataaaggggcgagataagaaagagaagcaatccaagcaaactaagcatgtaagatgacgtcatcagttgatgaatcaaccaatccaggtccggatggatgccaaaatccatcataggcaaacgacggcaaaagcgcacgtaggttttggttcgaggtaggcccgcaatgtagcaggaagaggacgatggtgtcctggcacaactggcgttgcagaggactatagcgacacagtgatggtggcaaacagacgatgacggtgccacagatggatggactatagcgacacagtgatggtggcaaacagacgatgacggtgccacagatggatggcgatgcagatgatggatgtcgacaacgatgacgccagcggacagagggtgactcgactgatacgagtggtgaacagacgaacaatgacttgtggcttacgcgagcgcggttggtggactaggacgacgcaaccgacgctggcggacaaagtggcgtagaacgaaaaaaattcgtatcctaaattcctaatgtcatagtctgaaaacaacggatagactgataaattctgcagggcgcattgaatgccatattttgaaatttctgcagatacggatcatacggtccagatccttctacgattctccggggattgtccccgttctttttcccgggctggtgggccgtccgttgcgctctcccagagtcccatttgccccctttctccctgtcgagcaccgcttggccgccgtgcggcgaaaccctagcgattgtagcggccggaatcagaggcggcggaagccatggcggacgacgactacaacgacatggacatggggtttgccttactctctactatctcactctctctagtcctttttccgtatgatcatgggaatccaatctagggtttcgataggcatcgcctgttctaataaatttctaatcccagaccggtcgaaccagctctctgtgtaacatgttgcgccggtaggagtctgtgctgggtgattcgttggcgctcctcatcgccatggggagcatttggggtggtgggttcgttgattcgagtcgaagctagttatggcgattgccgcgattcactcgattggtttttggaaaacgagaggtgttaatgttggatgcgtactggtcttcacgggtaaaaggtgtctttggagtttattcttggggcatgttttgatcgttgagtcgagtattattcttagggcatgtttcgttcgttgagtcgagtaatggctcttagaagttgtctgagattagtttgtcagcaacagaaggggatactgtaaagagtgatattctgtttccctgcttgtttggttatggttaggtttagcaggttctttgaaatttaggtttgcttggatgaatcaattgggttaatgcgacaatcccgctcaccaattatgggaattttcattgatgattctataccgctttgtttgagagaaaagaacattgaacgcagtcggggatggggggttctcatgcgtacctcctgcttgctcctttctatggtgacatggacatgaagggattggctagaccgatataggtcaggggagctatgcaattgatgtaataggaggcttggtgcaaatcatttatgcagcagtataaagaaaggggaaaaatatatatgcatataaggaaaacaaggagaaaaatgaaagataaaaatggaaaaaatctattacatattaagatagatggtcattgtactaatatggaatcctaactttgtcacgctagctaaaaacttagaggatctctaacatcttgcttctaattggaacaagaatgtgtggtttcattcttttctgcttaatttactgtggtggcttggcggttaaaacatatgaattagttagttatatgtccattttctcaggaatattcaattttagtgtaattactaaattacacagaccaaagttatgttcattagtgttggtagaagtgaaaattttgaatttcttttacatttcatcctagtgagatatctaccattatccttgcacaactatatgattgctgaagcactgattgttatatgtcattttaaaggattgttttgttggatattgattttggaatggcattgtattttcctctgcaggtatgaggatgagccaccagaacctgagattgaggtacacacattgctatcctcatgcagtgatgttatctgttaatggaaaagaactgatggagttctgttcaataataggaaggggctgaagaggaacctgagaataacgaggatggccctgatgaggttgtaggggcagaggctgaagataaggaacaagaaaaaactcagcgcccacgcaaaacgtcaaagtatatgacaaagtatgagcgtgcccgcatcctgggtacacgtgcattacagataaggtatgtttctatatatcatattgcacagtattgccaatttgatggctaatagtttaccatacagtattaataacccttgctgttgttttatagcatgaatgctccagttatggttgagcttgagggagaaactgatcctcttgaggtaaattctatttttccaaactatacatgcaataggtatttgttcaaacaagcgataacctctacatattcattattttgatttttgccagttccatataccaagcttatattgtacaacttaaataaccttttacaataaacatctgtttccatcatgaagaatgaaaatgaacaatggaattttcttgtttaggcatacaacacctgactgccaactaattaataaaattaacgtttgaatatataattcaacaaagtacacatgtttgatagctgtatgtaattgtgtatagacataggccagcaattcaatcaatagaatgtctttttttcgtcatggagggctgccacgccgagtcagcttgaaatctaaatatgtgactgacaataagttttcgtctgcaattatactagtatgcacaaggttgtatttgtacacatatttctttcatcaaggctctagatactattatttggtagccttgtgattctgtgatttgtttccacaatataaaaacagataggacaaatgttgacaagcaccctgacttgtctatttgaattagttcttctacccagacagaagttattagtcagggctcttatacattgtttttcatggcatttcaaatatcatgaaattgatctagtttatgtggagaacaagtggcaattgattaattctgtattatgttttagtgtttgatagtccaataccaaagattggttttgttgtaacacttgatatattatatggctgctggctggtaaatatgccactgctatccctgaagtgggactttcatacgcattagttccatccttattccaacttctagaaggtttattatatctaaatcggaagagttaaccggaggttttaaaaattctaggaaaaggaaaaggcaggtgccgggttttctttgttcatgccaaactttgttatcatgatggacagagaaaaggaagagatagaagaaatcaattcttccggaatatgaatacaatttttgttgactcccatattgttctcaatcttaaaattttgtatgtttacacgtgtccctcttcctccatgtcatgaaaaattttcacatgtttttagaattccacaagggtcttagattgcttttcccggataaaaaattattttggtatgttttaggcatggtaactgaaatattttggtagagtactcccacaaaaccaagatgagatgaatgttgactgcacttatcaacaactcattataaatactacttagatttcttctctctttctgtcagaaattgtcagttgattttattctatctttcaaattacttgctatgctaaactattgtctttgtgcaaattagattgccatgaaagagctgagagcacgcaagatcccattcacaattaggcggtacttacctgacggaaggtgagatttgaataaaagacatttatgtgtttcctgattttgtaacctcattataatagtttactgtgtgttcaaatatagctatgaggactggggcgttgacgagcttattgtggaggactcctggaaacgccaggttggaggcggctaagctgtgactgaggctactcaaaacgaacagcaatgtgctgcaagttgactttgcccttgtagtaatatggtctgtgcaactccattatgactggatgctgtatcagtgaactggcgtgatgatggcatgccatgttgccttgacatgtatgccttctttccgcagtgtaactgtgactgaaatttgcatggttgcatcagtttgcttggaccatttgcagactttgtcctgtgaatgttcaaggcttaatgcttggttttttttttcttggcctaatttggtagtcgtctagcagacatgagcgacatttttgcagtacgtagacatcagacaaacgggcggatgcctggaattgtgctggaactgaacttaaattccggttgattcgtgttctgggtccatttccacttttccagtataagtatcaaactctgaactgaaggctatatagataaatcagaaaataatttttttttctccttgtttaatcaggagttatcccgtgtttttggaacttttggtcacgtgccgacactttctttgatggtatttgtataggttgatctctattaaattcagagtagttctgtcacaaattaacaaccacatttgtatgaggcctacagttgtgtattcttttcaccaaatgcagcacacatcattccctaataccattctatcacacatctgtgctttcttgtacatcataccgtgtcgcttctttctttttacattgaacaacagtggccactaattacagcttctccttgctaataaaactcgctgagactgtagttcagttcattcctcggaatcggaatccattgggcatgatccgtcatccacggtggcgagtggatcaaacatgtgcgagtttggatccatgcaccctgacacaatgtccagcttgcagcgatctccctgccagtgccaggggatgcagcaacggttcagaactggctaggattaatcatgaatttgagataaaggttaaaagttttaccccctcttcgtagtagctgcccatctcgcagcttgtgatgacaacgttttcgtctgggaagatggctctgtcgcatgccccttctctgttcagttcgtctgctagaccctgcatcgtcgtcacagataatttttaaaataactctctttattagcacaaaaggtgcattctaaaagttaacactgatccaaagaggagtttcaacttttccagtgcataagctatcaagaaatggtaattaacaataaaattggattcaaggtacaaatcaagcttgtttgattgaaaacaacacgaactcggagcaaaattttacctcgttgaagaagctcaagggcttgttgagccatggcttggggaccctgaacttgagggtgtacggtccatcccaatccaccccgtttgtgaaggagaagacgagggtcatggctgcgagtgcaaaaccaaccagacaaaatctcactccgatgacaacatgctattacatacatacagtactagtaacgaatccatggccactcagatgacaacatgctattacatacatacagtactagtaacgatcacttgaacatatggtgtcagcatgatgcaaaagcttaatttaagttaatgagaaattgcaggcgaatcattcatatcttcaacgaaacaaaacaatcagctgctgaccatgctgcggcacacgtatcctgatggtgtatatgggaggatcagctgatcccctctcttgcagcgtcatctgcctcggctcaccaccgcacatgatcggctggttaaaaccacctgcagcaaataaagtctcagttatcaactcctgaatcagattcagatcaaaccaatttgtagcctgaatttttcccggacactgggtgggtgaaaaggagaattaagagggtgctcaattaccattaaacgcgatgccaaactgagcgttgggggtcatcttggtcgctgccgggttgtagaaaaggatcaggccctctccctggtaagaacacagcggcagcttaattagctactatttccatgatgaatctgccaggttgctagtactaccgctgttccatattataagttgcttttgactttctttttcttattattttttaaagtttgaaaatataacaaaattcttaacccaaaacaaacatattatcaaaatatatcaaatgttaattttaatgaaactaattcggtgtacatgttggtaattattttaaaaaaacatagtcaaatttttttaaaaaaatgattaggaaaaaaaaatcaaaatgatttataatataaatcagaaggagtagttgttacatgtatgatgagtgaaagtatttctttttgtgaagaaattaaacttacagccgatggaggaagaccgttcatggtcttccagtagaccggcgccttgcccagctcgaactccgcccatgtcggaagcgagcacctgcaacaaccaatttttttttttaaatcaacacaactttttcatcagccacaaattaaaggggagagctcagtttgtgagttactcactcgttggtctgcggcacggcgggcgccgtggccgcggcaggcgccgcggcggcgcctgtgcggactaccctggccgacgaggaggaggaggagctccggtggcaggtgatggtcgcagcgcttgccggccgccggggacggcgctggacggcgccgccgccggtgctcaggcggctgcaggaagagagcgtggccatcctacagtctacacttgtgaattgtgatagctgatgaaagaaagagaagagaatccgaagtgagtttgcgaaggaggcatatataaggatggatcatgatattatcgtggatggagaggtgaggtgaggtgaggggcttggctgcgcgtgtgtggtggtgaggtggcgacgacgagctggccggggcgtgtggttggattggatgagtattcttctgccttgatttttttccctctttttttttgttattttttcatttttcttgccagccgcctctgttttcttcgctatgggacaagagaacgcgaggctcaagtacattgttaggcgctttagcttttgccctgtagcgggaaagatctccttcgccgctaaaatatctggccttttgcgtacaaatatctcacaatgagagagctggttttacaacccctttcagattatattttgtgtgctttagaaaattttgaaaataatatgttcgatatatagagtatgttgtagtaagactgctttcttctagcgagtttgaagaaagattcatcgtacgcataaaaggataaaactcattaacatattattaattaatcattaatcgttataaacttaaaaaaaagattaatttcgaattttttccttcgaatccaaactttaacttacttgtttttcattagcacacttttaaactactaaatggtgtgttttttctagtaaaaaaagttttatatagaagatgtttgaacaaatcaaattaatctcttttttcaagtttataatgattaatgcttaatcatgtgtagaacttctcttactttttaacaaaatatccatttctctccacggtagctaagtgatcacagtattgcacatctatacttctatatctatactaatataaaaaagaggagttgccccctccaatcctactggtgaaatcatccgaatcaatcactaccgttcatctgcgtctctcctgatccagatcgtccgtccgccatctctcctatccgtccgcttcctcctcctcgcgcgatgagcgtgcgctgaacacgcgggactcgcgctcctccccagcgcttttgctgccgctgccatcacgcgccgattctcctcgccccaccgctgctcccgccggcgctcctcctcctccgccctcttcctcctcgcattccccgttcgccgccttcggagggtcgtccccttccggcgtcgccgccgccgccgccaacacgcgccgcttctactcgctccgcctcgatccaccacttctccatccgtcaatcggctcggtgaaatcatcggccagaaatccatcgctgcatcatccacccaaagccccatccccattctcatccccatcgccatcgtcaatctcgcctccttgatggcgcaatccccgcatcgtcgcaataactgccaaggcaagtatatcatcccctcagcccctcatgccctcgcccttcccccgccgttgtcgccttccaccacccgtatcccgcagcggcgtccgtcgccagctccccttccctgcacgcaggcgctgttggatttggatcgagagccgtcgtccttggatcaaagtcttcgcctcactgccgtcgtcgggcagtggagaagaggagatccagtgtatatgcactgctacagctgtcccaccgcctacggtaccacgtcacgtcaggtggaggaggaaccaaggccatccctcaacacctcaggcacctcatgagttcgactcccacagtgcacgccgccacgtcaggtagaggaggtggtgcttgcgtgtgaatgcaaggtcggtggtgatggcacattgcttggacaccgccatggccccgccctctctacttggtacttgcagtatatggcgatgttgccggatctagcgcatctacacgatggatgaccttgtcatgttcaggagttcaggtgatgttcctccccttctctaaagatttttatctgatgttggtggcgtatggtgtttgattaggggaattgagtggtttgcagtgtgatactgggttcaaccttcctaagaaggagaacggcagctgcggcggccagtataacttggcctcgaaaaaaggtaggtaaccatattatattcatgttgttctcaaagtttgatttattcacatcgaaggagcagccaaggcatgattatggcatttctgattctaatggtactgtgcttgttgtcaattaagattttatttggctaataaaaaaataagtgtatatgcaggtgatttgccaactccaactattcaggtggtactgcccttctctgcagtgacggaggatgaatttcagaagcagttgactcaggacaggttgtgtctcattattaatttaaatcgatctcacctcaacatcataacatcatgtaacttgcagtctgcaccctcgactaattcagacaaacctatcaagcctgatagactttttgattcccaaggatcaatccttttttggctaaattagcacaatagttggttcaagctgggtgccaacaacaatgcttaggaatatacacatctattgatcccttatgtgcaaagttgctctaatggcctcctatgtggatgtactgttgcccagtgatttgctaaagcactttctcctgttttgcacagcgaagtgagtgcttcagcttcagagccatgttcaaagagcttgtgtgttgaaagattgagcaaacgtgaagtgcagaaaaagcattaagaatttttggagtctaaaagaggaaattgtattcattttgtgtgaattgctgtaagttttttttctctgatttactttatgatgcaacatatctctggtgacactatcttctttaaacattttaaatttccctttgccgcaaaacatcacctttgtgaccatgtttttctgtacggtcaatctttttggctacacgactcagctttggcgagaggccgcatgggataaaccaatgtttctatctaaagtgttctttcaaaatcgtttttgtactgaataaaaaatgaagcttaatggatctgaagctatgtacaggaatcagaagggctatttagcagcaactgcagagtaacaacagatgattgtgcctcttctatttgtgctatttaaaaaacacttttttaacaaatttcatattgtccttttgtatagtcagccagatgcagcgtgttgcatgggacatggagcatgcatgttaccatatgcagttcaaggcatgggattagtgagctttaattgggtatcctgctaagattcatttctgaaaaaacatacaagaatgtcgttttcaatcatgctaactgtaatttttttaacaattgggttaagaccaaaataaaatgatataagcctctatttcttctatcagagatctattacaatttttttgggggacaataacgaataaaacaaactggtgaacaattttctttcccttaaatttgtacaaaatttgttgtgtctttgctgattagctgcaattgtgtgaacctggtggctaacgaggaatgatatggtgtttagagataacattgcttactcccttctaatttaactttttcaaattatttctcaactgatgtagtggaaacctctccttccccaaggagaagcagatggaggctctggtggcacgtctgaaggggcaatagcaaggctgcgaccaagatcaagagttggatgatgtttttcctaccaaaaaaagtttgaagtccgtgttaaagtaagagttgtcaatttctgctatgggagttcttacccctttttgtttagtttgtctatcctttaagtgaccctagctggtcgggatgtgtgaccatgtgagacttcccttttgctctgagctcatgtaaaccttgtaatcccagcgaacctgtcgttgtggctttcaatataagctacggggtaggtctgaggaccttcttgaaaaaacatttattcctatgttgaatgaattgtctagaattagatccacaatcttggacacaaggtttgctgctttgcttctcccgtagtaatttacatggtgcacagcttggcactccaggagtacacataacacatgctttttactagggtctatgatactctttttttacctttagaatttgtatggagtgctctatataaaaaaggtacatttattattctattttttttattgtacataataccaaaacatgccttacatgtgcacgataactagtaatctacaatgacacggtccatccatgtttgtttagaatttcttaaattgcacaaataaaattcaaaaaaaaatttgtagcttttcagataatttaattaaaattccggtttgcatcatctgcggatgaacaaagccacaagacttgttgcaaattttccacatcaaacagaatgagaaatgggagacaaaaaactagagctgtctaaggaatagactgttccaatctgtttgtacgatattgctaaaatcttcttcatctatgcgtgtctgaatggctcgatggtggtcatttacaaagtgctactaccttatcccgacagaaatctctggcagctcccttggtatctagttagaaaagagatgtagtacctagctagttagaactttctgtttttttttaatgtggtggcaaaaggacaaatccttgataaattgtacttccactattcacaaatgatcagcatatatggtttgtgtatcgataccatcacacttacacatgtcacttaaattgacatcgattaacatgcaacaccatttcttgtgtcctatatatatgcttcaagggcaatatgcgccaatgatattgcttgcatgcatgcagtcatgcaccacaattacaattagttagtacattgaacaatacatgcaactgattattttatactgcacaggaaaacaaaaagtcacatgtaggaagtaccaaatatactgatcatttctgaataacactgaaaaatttatatgatgataatttgtgaatgaagtgagtccatatcaatcttggcaaatttcccctccctctaataacacgaatattttggtgtatatctcaatgtataccaggtaagacataaatgacaaaattaagttcatttacaatcctaaatatttgttttaaaaaaatgtaataacactaaaattaactctaaaccagacaatattcaacttttaagtttcaatatcgtgcatttttcaactttggcttgaatttagattagttttagatgacatggggaatttttgtagggctgtttttttaattattataaatatagttatttacttcaaaaggactttaaaaactagaacttattttcaagagtatttttaacgtaaagatattaataagctctaataattggcccacagaagatactagtactgaaatatgaacaaaattccgctcaaagaaaacaatattttaggtgaaaactatattccacgacgcaccaaatttatctaggttttcacgaagtgagcgtatcttaactggttaggtttcttgtggtgaaactagctcaccagagttaaaatttagatttaacacgggtgctcgtatttatggctaattgttctttcagtaataggcgacaatgaggcgccggttcgtggtgactttgttaatctcaagatatgctaatccaatcttccagaagtgcttagaggtaggttatacgcgcgtgctcataggggtgagtgtacgcgcattgtggatgtctgcgtttgtattatatttctaaaaagaaaagaatttctcaatcgttcaatgcgcaaaccgtgatgattagacaagcttaaaattaccctatttgacgtttgaagcatagctgcacagagaaatagacctcgtttgacagccatttttgctgctacagattacagccgttttaaactactgcagccgcagctgctgccaaaaaaatctcttccaaacacacccatagatgaatatccatttatctttcccttttcgtacgcttggacattgccatttgccctacataaacacaccactcgtacagtgtacttgattgagttgacagtcatactctactacaacggatgaacatgtggaaatgaagacacaaatccactccctacttgctttcactgtcaagtgggccccgcacgacagtggcgagcgaaacgggagcgtgctttttccatcgtgattccttcaccgtaacgggatcatcggtagtaaggtcttaccgtgcagccaccgccaggtgggccccccgacccgccggcgccgcccactcccgtctcgtctcaaaccccacctcccctagtcccctttcccgacaatggcagcggtgagccgctgaccttgcctctccggcgaccacgatccgccgccgccggccggcgagatggcgccgtggtgccccgccgactcgaccaagccggtcttcgtcgggatctacggcgccgtcatcggcgggttcgccgtctccgcgctcttcttcctcctctcctccttctcctcgctcgccgcgcccccgctccccatccctcccgcgtccgccgccgccgccaacctctcgggcgcagtctccggtgtggcgcagccggagaccatgtacaatcggcccatctggaagcccccgccgcggagggagcggatgcccgcgccgcgcgcgttccgcctcacccgcgagatggtgggcgcccgcgcccgcggcggcgccattgtcgtcaccttcggcaaccacgccttcctcgacttcatcctcacctgggtgcgccacctcacggacctcggcgtcgacagcctcctcgtcggcgccatggacaccaagctgctccgggagctctacctcaggggcgtccccgtcttcgacatgggcagcaggatggccaccgaggacgccgtctggggctcgcccaccttccacaagatgggcagggagaaggtgctgctcatcaacgcgctcctgcccttcggctacgagctgctcatgtgcgacacggacatggtgtggctcaagaacccgctgccctacctcgcccgctaccctgacgcggatctcctcacgtccagcgaccaggtcattcccacggtcaccgatgacagcctggagaactggagggaaggtgaattatctacactttgcaataatgcaccttatctaagtcatatgttgtgacgagatagatggtgtgatgcattctctatttttcgatatttcccagtgctaatctatctacaataatcattgccctgctgtaagatcaggaaatcagaactgcacaatactgagatgaattttcttgaccttttgatactaaattctgaaagtttggaattaattttagttcaacttatgagaatagaactaatttttaaatatttacagtggaatgactctggaattggacttctgttggtgaagacaattgctgtagaatatagcttccaatatgtatcagcaatagcaaatcctagagaattagaacctgatgtgaactaatgttcttgttactgtatttttctgatgttttaaaaaatctgctccaatattttctgtttgcctgtataatattttttttccctgtttacctgtataataagattttttgttctgtttaccatcaattgcagttactatttgaacctaacatattgccttccccccccctttcttatgcacagttactggtgcatacaatatcggtattttccattggcgacccactgaaccagctaagaggctggcaaaagattggaaagacttactcttatctgatgatacgttgtgggaccagaatgcttttaatgaccttatacacaaaaaatttggatacccggttgttggagaagatgaacttgtatattcttatgatgggaaactgaagcttggagtcctaccagcaagtatattctgtagtggtcatacatattttgtgcaggtagttgctcttatttgtttgaaattggcaaattaaatatcttgcatgtcaaaatttttctttggtgagtaaattttcagttagttagcaattgcattttttatctttgttgtcctgcatatgtttggttcttgttcttttgtttcacacactttgtgcatcttgtttatactgtccctttcgtctaaaattctctgtaattttcttgggttgtttatacctgaaatgtatttttttcttgagttgccagggcatgtatcagcagcttcggctagaaccatatgctgtgcatactactttccagtatgcaggtactgtgggaaagcgtcatagattgcgtgaagcaatgcttttctttgatcagccatcatactatgactcaccaggtatgtttattctctgaccctatcatgacggaacttctttgggacagaggttcatgacttcatgtttaaagatcatgatgtgttctagtgtacaaatgccttctgattttatgtttgaagaccatgatgtaccctagtgttaaaatgtttcgtctgtatgggttatctcagaattaccaatggagcactgttaaacaaaccatgtaggctgtagccatatatgatccaagaatgaaaagatggtcacatgaaattattttcatgcatataacattattcggatttgaatcctacaatctttacttactactttttttcatcatgtccataatttacctggtattatgatgcaggaggtttcctatcatttagacccaacattcctaaaagcttgctgttagatggcgctcatactgttaaatctcattttgcattggtcaattaccaggtatctgcagctacacatatatttctgcaaatttgtggctgcacttctgttattgatggttattccttttctttttcctgattagtcatgtgcttgaaaattttcagttgaagcaaataagaactgcactcgctattgcttccctattaaagaggaccctggtcagtggaatttctattctttttctagtttgatttgaactccatgatggtagtgtgaatactacacacttactattcgtgattgtgaggtagtggacatgcagatcattaagtgtaaacatttagttgagattgatttaacctgcaattcgatttcttgaatgtgatctctttccataaactttctatatgttaaaaggttgaaatgattattaatatgttcttatcttttagatgttaattttgtctttactgatgatgtgtgcaccatcttaatttgatacaaaatttacaacttgcaaaagtgcatttatccttaaatgagtaagctgcagctaattagtgagtattgaggtgttgagtagtaatgtatggtaggtgcttcatgcttgcttttttgaggataagtttttatcttagataacttctggaggtgtttgagagcagaattacgctgttcgatgtattgtgctcaaacttgtggacacccaatttctgactactgtttgtacttttaggtaatgcctccattatggtgcaggcttgataggatgtggtttggacatcctggagttttggaaggaacaatgaccagacaacctttcctctgtccaatggatcatgtttttgaggtgattacactgggaatttttttcatttctgttatcataacattatttactatttttcatattatatgacatactattagttggttagagaaatagtttccttagttgtatgaatcatattttgtaggaaattcatcacattttttttttcaaaagtatatatggttagtgaagttaaagtaaattatataactgggatttcatgttatatgtgtcagcataccttagatttttggaaattctctgtagttttagaattttagatgtcattttttttagatgtatccaggtggcaggtggctgaagcttgccatgctttttattgtccaagctttggtggtttggagtttagaccagaccacagtgctatgtactgaaaacttcttttcaacatattattgctgatctggttactgtactgatatgcgttattcattattttgcaaccaccctcagaatgtggcaatgtgcagataaaaattgacatatcgggccattaatatttttcataaatatagcaaaagtaccaccggattaccatcacaggaataacaaatgatgtgtggtcaacttatggttttttgtgggtaaaatgagcatggatactgtgggaaatttgcatagggaagttgaaaaggacaaatatgtgaacaaagctttggtgaaatgctagatatttataagcagatagaatagtgttaatgatggcgtttcataccaactggtcagcaacacaaataaagttgtcttgtattttgcactacataataaacaggccagagaagtccacaggtggatccagtatgaagctaacattcctactacgatgatttaattctacaggtacatgttatgctaaaggacttacctaaggaggagtttggcccacacattgattttagagaatactcgtttcttgagaatccatcattgcctaaacaggtaatgttattattgtacttgttttaacaattcactatgaatatttggtagtaagaaaggtgggtttgccttctaataattattgttttgcatcttgcataggtcaaagaatcatttcttgaggttgagctctgcaatgagcatagcaccagatgctcaacaactaatagaaccaataaaggcgcgcctgttctcttaccaaggaatagcacagaacaaacggtaaatggcattgtttgcacattatgcatgcctaatttatctctcatgtggtcatgcatacaaatatacaacatttagattagaggatacttatttgtcacaacatgagggaactatactagtacccagattataggatttttagaaaaaggaaactcaagctaaagtgagaactggagcaaaaggcatatcatgcaaactcagaattaatgctgtaattttgaagttcgcaaacatgaacattttatttgagacaagactccaattttattaagaaatatgtgtgcgacaagccaacaagtcaccagacaagaggtatcatgccttgatcagctgcaattgctgctgcagctgctgcagccgcagtagttgaaagccgctgcagcaatcacatccgaacacacccgtcattaaaaatcactaaacataaaggtatatcgagacatatacacacctcagataagaggaaacggcataccctgtggaacatagagtaggattcctatactcctagtagcagccattgcctattgcaaggtctgctttatcttttggtatcttatggaaaaatcatattctgaagttgctatttttttttcagcttttggatatattcaaaccatataaggatatcaaaatcttacagttctcatctatggttaacgccttcggaggtttttctgatgcagtaagcttccagtcttcaacaattttgtgctagttctgaataaaaggatgcatagtaactttattgtttaaaccaggctgtggacacgaaatttcggaatcgagtaaagagatatgtgggcctatggtgctgtgtgcagctccgtgaaatagggcacatatattatgacatgtactgggatgagaaaccaggctggaagccccttcctccacagaccaaggtggaggaccatccaccttggttggaggtacaggaatgaggctaactacaatcacggatgttattttttgattcaaaggcaagatagattccttactacagattaactcctattatcatagcagtcactacctgttggaaatccaattgattcttcttgactgcttactgtgaaggaaatagaaatcaaatggcaatcagttttgtagctctgatctttgataggctgattcacttatggtcgatcagtgatcctttgctctgttcttacttcacacagatctctgataaaccgtggtccattcatcttgtgaagataatgttgtagataatgactttgactcagaactgttgcgctatgttcatagttcatacagacattagcttcaaaggagaagatagcttttttatgcaaaatgcctgaattgattgtttgacagttatctggctggtacagaaaaggagtaaacatgcatcattattggctgtgtacttagttagcataaaagggtattttcgttcctaactctccatactttcttgtgtgaaagttaattatttatgcgaactaatcagtagtattcagaagttccatatgtggaacacaagctgatttggagagggagaagggaccatacgtgctcccgattgccgatctatggctcagatccttcagtagttggtccctcccatcccacaaggctacttatcattttcttatctcccaagaccaagggggaaaaaaagaaaaggatcacaggcgacgggttaattgcaatgggcatagattaatctctgcctccaaatcacgagtaatcgagtggataactggatgcttcatcgcggctacattttcatctactttctcattttaaccaatcgtaacatttttcaattaaatttcatcaacttccttaatacttgtgttcaatcctaaaattctttatattttgaaatcatccatgtgctccagccttcaagcctccactctaaatggagtaggaaaacacctactacttgccacgcgttcccacgtgttcctcattgaagcttctccgctggaaggaaggggtagtggtgttgccgagccgtccttcaagtcgagctcgtggccatcagatcacctgaatccggttttccttcttttacttcccttcatctcgcactcacttgacctcgagcttcccatgattcttctttccccaccacggcgagatggctagaagaaaacaataggtcgcagtctttccttctccctgaatgccttggttgtgagaggatctgtccttcttgaaaatttgtggttttcatggggatctttgcctcttttgtgcttttccaatttgctcgccatggggattacaatcgctattggtttgccgcgaggcaggccaaagattggggtttttaaggggtttttggatttgttcatgtgtttgctgcgaggtaggccaaagattgggttttttaaagagttttttttgaatctgttcatgtgtttatgcttcaacttttgtcttttattggctttgtttattgttcttgtcttgtggtgtggtgtatccgatttgcttcattggttgtattcaagctatgaaactctaattttgggaagttcttttataagattgattattgaattattgtgttgttatcacttaatgaacacatcttgctttcctgtctccgattcagagaatgcaaaggaaacgcttcatgtggggataacgtgtgaggaaaaaacaccttgcaagtgttgggacaaacgaagggagcaaaagaggattgagacggacataagcatattagaacgatcggaaagttaccagattaagtagttaagataagcattggtcccgctattttcttttctatttttgccactttgttgacatggcactactattgcccttcttctctgactcgcttccccaacccatttccctctctataccaggatgagaaggtaggagatgaatcaatgatgatgaggggtggtgacaggccgatcatagtgggtgcgtacgctagatccatgcgacaatggaggaggtgcttgccaccttcaagcccatgccgtcactcctacacaccaccacccttaccatccttcgggtttgtgatatgagtaggggtggcccgaccttacagtgagctaaagataactattatttgagagagagaagttgatgaccaaactataatcgtactagatgttagatgttgtattgcgctttagtgactaatacatctctctatgggttgttgattttacaaaaacagatataccttgcaggggcaggcctacaacaattcaagggtattcaaattaaatacccaagaattttggcaaaaaaatagatatatatatactatatattttatatgtatattaaaaaatttaaagaaaagacatcaaacaacccatcaagcaaagaaaccatcctttttaggccgtgtcctccccttctttgttggcccattagcacaattgattcactccattttacccaaccaaaaattctatatacatgaacttatgctcaattttgtgttatatatgtcttattagtttgtgatattatataggcaaaatttgctaaaggatactcaaaaaacgtgtaattagctatgacatcgtaaaaacgtgacgcggctgatagacactacaaaaattgcgtaattagctgtaggacaccggatacaatattttataattttcgagtcaaaagaggtgagaaattttttaaaatgacaagattgcccctggcacctcacctctcctctccagctcgctcacgtacagcatggagcgcggcgggtgcgcgtccagccaggcgcggtccggaccgtataggcacacgaaatggcggtactgttccgccgccgtcctcaccgtggtgagcttgtgcagcggcccgacggcgaaggttgacttggacagcttggcctcgatcttgcccagctctgacgcctcgaaggcgttgaacatgttgaccacgaccccagacgccgaatctcgcatcgtgtcggcctgggtgctggcggcggcgggggcggggtagaggagcgtttagttgatggactgcgcgccagtgtggggccacgcgtcgacgcgcggccgcagcgcggagatgaaggacgcgtgcgccgccgtgccgcggttcgcggacgtgccggtgcggctgctcactaaccggcgcaggtgcgcgacctggacgggctgggcctcgacgccgacgcactccggctgccggcccacctcttcagcgttttcgatggccacggcaacgccgaggtaagcatgtgcttggaacgatccgaaacgtccggattggtcactggtggcgcagccaacctcaggattaatttgactgattccgtggcattgtgttgctgtgcaggtggtgaactactgccgtgaaaggatccacgtcgtgttgagcgaggagctgaggatacagatggtgccgcacggatgtaaccggagcgccgccgccagcgcccaggccgcgccgccgtcaccgacgaataggtggctcgggctgatggtgtctctgaagtagggtgtcaggaagtaggagaacttggagttgagctggctgtcgagctcgatgatgccggaggcgccgttgagcgctcccggcgcgagatcctcgtctggctaacgcagccgaaggcgagggtcaccgtcgtccccgacgacgggaacgtgaacgcgtcagtgcccagaacgctgagctctacgccggcgccgtaggttgccacgaccacgcacacgtcgtcgctgccgcgcgcgcaccttgccttctctggcgcgacgccgcacagggcgccgtcgtcgcacggcaccgcccggacggtgcgcgacagggaggagttgtagtaggggaggtaacgagggaagcagccaccggtggcgggaaggcggcaggcggagcactgcgtctagatgaggtcgctgccggtgtcgacgatggcctccgccggctgcggcgggtcgccgatgctgtagttggcgatgtactgcgttttgtcgtccatgcggatcaggtctcacacacggagcggctcgagctctggcaccgcctcatccagctgctctcctgcaggacgcaaggctaggcggaggcaaggcggaggcggtcgcgcgcgaggcggcggcggcgcttcgtgacaacggcggtagcggcaagctggcgctgtgggagcaggaggcgcccgcggtcgagaggcagcggcggcgctccgtgacaggcgagcgagctggagaggagaggtgaggtgccaggggcaatctcgccattttgaaaaatttcttacctcttttgactcggaaattataaaatattgcctccggtgtcctacagctaattacataatttttgtagtgtctatcagccgcgtcacgtttttgcgatgtctcacagccaattacacgttttttgagtgtcctgtaataaattttgcctattatataagccaattattaggatttttgagtgtagaaatatttccccctctttattttgaatacccaaccttaaaattctgggcccgcccctgataccttgttcctacaaaaaaatcgaaaaacaagcaagaacaagataaacacagtctaaattgcaaataggaattaaagctcatgacgaataaaacactcccaaaggtggtttcagaaatcgagtaactagatgatctggccaaaacacacaattacaaagaaagtagtaatgactaaactataatctaaacaaaacccgagaaaccctgaaagggtatctagctatttaaggaggtgtgaggactaccaacgagtccctagggccatacttcaccgggttaggcacactcctctggggtttcagacgaagtcataagcccgtagacccatgattggtggtacaacactttgtttcctccattacggttgagttatatgaaatttggttctaaggtggtccattgaaaagaggactccaacagatttgcatcaagtactcaaggacctaaaatagagcttgtatgtggtcattcaaagtcacaattgtcttttgtaggtcgatctagatttcataacatggcctgcttgaactctttctttgcttcagccatggatgacgtggtggcaccaaggaagacttgtataaggccgtcacttggtccccaaatcaacatttttttattttccatgcatgcttttgcacttcctttcttttcctttaatcccacttatgaaattgaaaacacacaaaaactcaagttgtagtatccttttcaaatatatggaaattaaacctaaccaaaaaaattattacctttggtatggaatcagtgagtagcccaacagctgttggtgcaagtgagatgcaggaggacgccgggtgggaagtgagcaaacagacgataccgatgggaggtggaaggaggcagccggcgatgagtgggaggttggagcaaggggcaccgggagggaggcaagaggcggcatgcgccagtgcggaccagctgcaatagagggcttgctatgaggagagattatatgaatatgtgctgagcacagctagcggaggactgcgacgatgagcaattcgtggcttgcgagctgagtcatgagaagtagaagcattgcttggcagcgtgccacgtgcgattaagggatcaatcgaaggcctagggttttcttgatacttgtatggttactcctccactgcacgggccttggtgggtttcttttggagtgaactattaactatttagagcacatttcacaattttcgggggcccacaggtgaaactttcaaccttccctcatccccccttggatttagggccccgcctcgacaaactatgggtgaggaatttgtatggcaaatagtaaaaaaaaatcctaatagagacatggaaagtactacacatctcacgtgcaactcaatacctctccaagaagaatgtgattgcaatttgcataacattaactccattagagatgaacattttgaatcgtgatatggtgtatcattagttcatcttttaggctagttctgacataaactcaaagctaatataatcctggctagtatccttgatgtggatggaggaggtctgttgttcacgtctttgtgatgagagagatccatcatccgtgtcgttatcctccaggtagatgttgtagattgataaaaagatcccattcgaggtagagaaaaggaaaatgctttttttggaccaacaaaagcatttgagccatcgatgaagaaaggatagcgcggaagtacaatgcaaatgcacacgtgacacatccatgtcctacacacacccatgtggttgtgtcctaacacttgtctaaaaaagattagcggctaagtcacataatcgattagaaattaatgatagagaaaaactaatctgaattatctcctgaacttttactcttgtagtgtaatttacctattgaattacaacaacacatatttttttactccttatattttactccatatccatgttcttaccccaaccgttgttggatcttgaattttccatcacggggctacccccttaaaataataaggtggcggagggccgtggatagggatggcaattgtgcccgtttgcccgtttacctgcgggtaaaatccctattagggttgggtttgttctccattttatacccatgggtatcttattgggtcaaaagctatgcccgatgggtaaatgggcatgggtataggtaatcactacccatgcccgctttgcccgtttatccgcgaaatctaacttacatgtaggctaggagcaaaatccactagaatacataagccacgttctttcttttctacggtttcccttttatttcccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgtccgtgggcataaggcgcccgcgggcaatgggcatgggcaaccatccttacccgtcatgtagtaatgggtatacccacgggcacaaataatctcacaggcatgggtatggataggcacttcccgtgcccgtcgcgcccgattgccatccctaaccgtggagaatggcaagactagttgttggctcttgtagcaatcagagccaactcgcagaggactcagcgcgggtgacggtgaactcactgtggaggtagcatgggcggcttcaagctcacagtggaggccgcacgaccgatgacaagctccatgaccttacaccactagcctccgctagctccgtcgccacgcatcacctcttgtaccttggtgtcgcgctcctccactagctccgccaccatgagtcacattcactaactccacacgatcgcgtgtcctcctccccacccaccctcaacctcatcatcgcttgcctagcttgcgttccttggtgtgcaaccaccatcgagatcaagagagagagagagagagagagagaagaagaagaagaagaagaagaagaagaagaagaagaaggtcgatggtgaataggatggcaacaaactagccattgctgatctttgtgtcgaggaggccggatcgccgttggagggggagagagatggggaggaagaaggtgatgacaagtgggtgctataaatttattattattatttgactgggaattgccacattggtgccatgtgtgctaacttggaccaaaaccataaaaaaataatgctcaaggggttaaatcgtttggtgccaaaaattagagaatgatgtctgatattgaatgtagttcatggggtaaatcaaactaatgcaacaatttaatggggtaattcgaactttcactaccacaaaaaagatttttatgaacccccgtatttttaccaacgggctagaaaggcattcgtttgcaaaaatatgtaagaggtgtccggtcaaggctcacttacaaaaaatgattttcatatacggtcatcttaacaggtccgcttgtaaaagtaggcgtatttttacggcttgcttttacaagtgacactcttaagacaaccacatgtgaaaaatcatattttttaaacctaagaggcccacttaggaaatacaggaccacaacctgcccgcccgtgactacataagataaccctcaccccgtcctctcttatcccctcagttctctctccctcctcactttagtctactcaccttctctctttcgatgatggcgtcagagattggcggcgatggtagaggtaggtagctatggcattagtggtgcctctccctccgatgacaacaggagggaaaaatctgtcgaggagggccccgaccacagcgatctgtctcctgctagcccagaggtggcggatctagtgcggcctctcccccttccttgtcgttctggcgatggcggttatagggaaggtgaatccgtcgtggtggtggcaaaaggggaggtgcgatgactgcattggcaaagggagacgacacgggcctcttcagagccgcctcccggccatctcatcgcctcccagtggaggtggtggtggcagatccacctccacacctcccattgccatgcgtgtcgtcgcctcacgggggaggtggaggtggcggactggcggctccatgcggtggtggaggcagcagccggatcactacgcatggatttgtttcaagttcatgtttgtttgtgattctagttcaagttcatgttctggatgtagatgactgtatctgtgatgaagtttatgttttgttctggttctgtgtgtgatgattatcatgtggatgtggattttgactagagagctagggttatagggagcggcaaggattaggtgattttattttgagtaaattttactttgggtcgccttttatttgtttcagtttggaccattctttaataaaatattttcaatttgaaccgggtaaatttacctttgtggcactttgggccaccctcaactattttatctatctgcatcaacttgttatatgccaaagcaatagtctaagtatagctgtgggagttcatcgacaaacagaaggcgacgtactcgacatcgttcatatgcgagaagatagtcgagatggtccaaagtaaaggtaagattatccggtcccaagtgaaactatttgttagatggtggtaaaaaggaacgtcagtaataaaaaaggtaatccaaagtaaaattcactcttttatttttttcataaaaatcattaccctagtcagtcgtcttaaatagtcacctgcgaaaattgatttttcgtatgcggtcgtcatgcccacccgtgataatcatcattttcacgtaaagctactcccaggcggctggtgaatgcacctgacataattcattttaaccgtttgaaaaaattacttctgtagtgtaagtgtttatcctcagtaatacgatacaacaatgtggatgcttgattttctccaagtatacacgggattagtaatgatcgatcagttgatcacccttaccttaccttaaatggtaacctgccgtttggacaaataaatggacggggacaaatcgatcggttcttaattagcgagattaattgttagcgacagaccgatcagttgcttgcttcgctgccgagaatctgtcacgcatgcagacgcgtgctgctgttggagggagcggccagaggaattgatggctgcccctgtcgtttgccgcctgttggctacctgttcccaaattagttgtccaaccaccatttaaatttcacttatctccctaaagtactgcttgtcttactcactccgtctaattttatagagaaaatctataaaatactattgacaagcattctaattccagaaatatcatcgacaaagacaacttcctaaaaataccattgcacgaacctctttctcccaaaaatactatcacaccataagtattgttaactcatctccattaagttatatgaaaagacaatcttaccctaggcatccatttgcacacacatcatcattctatattatttgctcacacaatattattttgcattcatgcatattttttctgtccacaactaaattcacagacatcgttattttgttatcaatcaaattatttcagaattaaattcacaaaataatttcacacattttgccatcgcaattccttcagaaattttgctatcaataatcaggaaacagaaggacaactgaatcaacctactatccacgcacaaagttcatctcttgcagatttcaaattcatcaaaagaagcaaaaacaaatttaccctcctcgccggcaccaatggggctttgctcatctacggcccccgcgctgcaggctgcgaccgtcgcaccgccgtgaaccacgtcgacgtgccctgcagcgccgccgccacgggcctcctcgccgctccctgccgcgccagcgccacgggcctcctcgccgcgccctgggcctcctcgccgcaccgccgtccttggcctcctctctgcgacgccgccctgtgctcccctgccgcgccgcccccgtggaccgccggcatagcggtgccaccgccgtggaccactgccgagccgccgtcgctgagcagccgccgggcctcctcgccggatcgggatttcccctccttgccggcaaagtcttcaaatgaaatcgaacaaaaggggaaaaattcaaatcagagagttgcaccacctgctaggactgcagcctcctcggcgacctcagtgacctcagcgactttagctgtgggcctctcctccccctcgctagcgcctacggcccccgcgccacatcctgtgaccttcgcgccgccttggacctcgtcgccgtggacctcctcgcagcgccctgccccgccaccgccctgctcctccttgccgcgtcctgccgcgtcgccgccctgctcctcctcgccgcaccctgccacgccaccatcgccgtggaccttctcgcggcgccctgccgtgccgctgccctagtcttcctcgccgtgccctaccgcgccgcacccgtggaccgctagcatagagatgccacgggcaccgccaccaacccgccctcgccgagacgccgccggggattgggatcggcagaacgctggatcaggggattgggatcggtagcggtagggttaggttataattttttttctttgacagtgaactgggtatattttgcaccgagggcaaaatggtcattattaaaaaaaaataacggttctaacggtttggagttgacggtgatggcatttttgggagaaagaggcttgtgcaatggcatttctagtaagttggctttgtagatggcatttttgggattagggtgcttgtcgatgtcattttatggattttctcaattataaacgtagttatgagtttccgtgtccaactttaattgtttgttttatttgaaatttttttatgattagtatttttactattgttagatgataaaacattaataatcctttatgcatgaattatgttttgttacttttttcaaaaaaaatatcaaataagacagacgattaaagttagacacggaaactcatggctgcgcttaaaataacacgaatggagtattaatcacgtcccatttagatttcttcctattttactctcaatcacctttttattcttaatcataacttatttgataacaatattatattatagtcttttagtttaaacctagtatatgccaaacaacataaacaataagtaatttagtacagaggtaatgagtagttagtatattttagtaggaatggtgtattacttccttcgttaaaatgaataaatatagataaaatatgggggtgtttagatctaggggggtaaggttttggcgtgtcacatcggatattatatagggtgtcgcatggggtattcagacactaataaaaaaactaattacagaatccgtcagtaaaccacgagaagaatttattaagactaattaatccgttattagcaaatgtttactataacaccacattgtcaaatcatggagcaattaggcttaaaatattcgtctcgcaaattagccgcaatctgtgtaattagttattttttagcctatatttaatacttcatgcatgtgttcaaacgttcgatgtgacatggtgtaaatttttcgtgtgggaactaaacatggcctatgatacaagctttagaattggccatgtttattaataaagcaggtagaattaaatggaaagatgttgtaattggtggaaaagtgaagatgggtggaaaaagtgaatggtggagggttgtggttggttaagaaaagagtgttggtggaaagttattatattttggaacaaattctgagtattagaagttactatattttgagacggagagagtatattttagtgctattaatttaaataggaggtcatatcttatattatatttgtttatttttgagatggagggagtattctcttgcagacattattggtgatcatatccttggaacagaagacactactacaaatccggtttttccatacggtcgaatcccggttttcgcaggtggtagggcgatccgtatgcacaaatggtttgcaaaaataactatttttacgtgagggtggtggaattaaatttgaaaatatactatcatttttttttcttaaaaatattcggggttcaaattttttcacaaatataccgccggtatatacgcgagaatgacgtggcgtgatgatgtcgtgcggtcttgcacaaccaaagagcgaggtcatttttgaaaattaattagtgtttattaattggtaataattagtgattaatcatcctaattattaattaattgctaattaggataattaagcactaaataagtcatcaaatgacaagacatcgggtctcgcttgttgtcgtacaacggtctcgctctttggttgtgtgagaccgcgcgcgcgagagcgagcggactcgcgctgttgccgcacaacatcgtcagtatcgtcacgctacatcattcttgcgtatctgttgagcgataccaacggtatactgccaaaaaatttaaaccccgaatatttttaagaaaaaacaaataaacaatatattttcaaatttaatttacggtggtgcatccgcaagaaaaaaatcaaaaaaaaaaccaaaaatcaaaaatcacgtcctcgtcatcatcgtgggggcgtaggaggctaggggccgccaggtctgcccgctcctatagccgttgtcgcctcgccagagacatagccgaatcaaccgccccacgcctccccaccgcctaatcagctgacgccgtgcctccctaccacccgatccgccgccgccgtgcctccctaccaccagatctaccgctgctgaacggggggacggccgccgcgcctgatgtgaccatggctactacggatacaaccgttgctcatattatggatgagcagcacgatattaagttcaagtcctccaagtattggaatccgatttcggccacttgctacactgctgatttcaaatggccgccgaatctgcatacgacctcggtttttggctcgtgagtatttgatggaaagctctcggagtcctctttccaacggatccagcctcatccccgaattccatctcctttggccgcaattgcagaaacaaggtgctgcgtcacctatcatgggcctttgggcttgtaacttcgtttgggaccccggcccaagtggggcccatgtggggtgcgccccaagctggtggagcacgaccctaggaccctcttggtcgttctcccacatccttaaatagctaggtaccctttcagggtttcttgggttttatttagatgaaagtttagccattgcaacttccttgcagcgtgcgtgtcggctagaccgtccgtctgcttgtatttgaaaccccaacttatcgtgtgtgtgagattgcttttatcttgttattgcttgtttcttcgatttgcttgcaggaatagggttgatctgcaccggcaagatcaacaacccacggagaggtgtatcaatcgctaaggcgcaacacaacgtctagtacggttgtaggtggatcgtcaacgtttctttcaaatcgtagttatcatcaactcaccgaaagatcgggccaaacaactgccttgagtgtcgaaaggaactcagggtccattaggtggtataagagctttcgttgctcggtgagtttttatctacctataaccagaaaatagccagacaaaaaaaaattgtatcatttacctagccatattgtgccattgcattgttcttttcagtctttgctttgttgaattttgtgttgcattgtcacgacgtgttgctggtcttagcgtctagttcgtttagagtttcacgttctggtcaagttttgtaccacagtcgtcgcaaccaccgtgtctctgttgtcgtcgggacctacgaaaacagaatcggctcgctgccatggttctattttgtagtttttagaagtttttatcggtcatttttggagttgcatctaggttttgcttgagtttttggtttgcccatgaatagataggccgtgctgtttccagcgctgagaagaggaagaagaatttctaaatatgtttttggaagtgtgagtttaatctagaaggaaatagtagattagattgattgaaaatcagtttcccttttcctctcaccaaatccgaactctagtggtgccgtatccatccactcgtcgcccactaccaccgtgaggagaggtttttacctgtatgccactaaaatatgacccttgcctctgtgccactaaaaagttcgagcctccctctatgctatcgtcgaactttatcgcgccctccacaccattctgtcgctattctgttagggttcatccgtttggcagctctgacatgtgggcccgggcagaaaaaatgtccctattgccctttctttcagtttcttcctctcgctccttccccctttctcccacgcgcgagcgcacataagcggcgacggccgggcacggcggcgcctggtgcatggcgcggtggagacggccggtgcgccgacgcgggcggtgtctgattgcagtggcatgggtcgggggacgaccggggagcaccgtcgatggagcgctaggcaggaggcggtcgggcgctggatggggaggcagccgacggtgtcgctggctcgactcggcggagacgtcggcgccggtggaagagaaggccgtcgtgcaccccgacgtggccgtggaggcggttcgacgcggcggcggggggacgacactagcgggggacggccagtcgtcatctccgggtccggcagctcgggtatcggcgtcgtcgacacctcaaaccccagcggctcctcttcccagtccacccctttcccggcggtggcgtcctcgtccgtgctcctacaagcgccgatgcgtgtgggacgagacgccgcctctacgcggctgctgcgcacggtgatgagcgcctctccggtggggccttggagcgcgagctcgccggcggaggcggctccccctccgtggccgtggcgaccaggaagggcggggtggcgtggcgaggccggcgaccggcgctgtgcggcggctgggcgcaggttcgacggtggcggccgacggccgcgagggggcgtccccggactcgaggacctcgctcccgacggccacgatggagatggtcggtggcaaagagaggctagagagagcgccacagagagaggccaggagagatgtcggcggcgagcgaggggatgtcgccgttggccacgccggcgagggaggcggcgaagaggagggcgaacgccggggtgccgacggccatgtggcggcgcaggtcccaccccctggcggcgagcgaggcgacgaggagcgtggagacagcgagcccccggtggtaggcgaagtgggagacggagcgcttggagaggaggcgcgcgtacggaggaagtcgatggtcatcgccgtcgttgcgtccgccgctgctgccatctccaacccttcctttcaagtctaagggcaaataagtcatttggctgtgccgttaccaccgttagaacaaaaaaaacggatggaatggtgtggagggcgcgataaacttcgacgatggcatagagggaggctcgaactttttagtggcacagaggcaggggtcatcttttttaatggcacacaggtaaaaacctcccgtgaggaggctagtccgactctctccctctcccttttcggtttcaatacatattgtgaattgctagacactttggtgaaaatttttggagtgtcggattggagatccgtttaaaaaaatggaacctacgggacgagagcattccatttttgtataattttaattttttggtttgcacttttgtatttcagtccctgtaatttttgtatttacatttgagtccttgtaatcttgctttcaggcccttgagtcatttttgctaaaaaaaagtgagaaaaggcagaaaggtgcttacaaaattgaaaaaaaaccgcacaaaaaaatggcaaaaaaggtgcataaaaaagaaaagaaaagggcgcaccaaaaaaaagaaaagaaaggaaaggaaaagaaagaaaaaaaagaaagaagaaagaaagaaaagagaaaatattgttatgtttgagctgaacttcatatatcagagttgtgcgtgagttgtgagttatccctagtgctatcttgtggtatcgtttgtgtctaggctcgcgtctctaatacattctagcctaggaccaacacaatacttgactttgaactatcattcaactttgcattctctaatttgtgcaattgctatcatttgctacatatttaagcctacccaaagctccacagatttgattgcagccgtacaacaagtgtttgccaaggcatcgatacatccaatctccattggggtgcttggttgagtcagtgtatgccaccattccgcttgcattggtaagatcttgtaagagcttggttaaaagcttgagtgtgtgtgtgatatttgagctactactacctagtagttaataggaacgtgcatatttttgtgtatgtttcttgttttctattaacaatggcagggatacacaagatcgttggatatgaccttgctcgacaccaacattttcatcgagacatgaggaatgatcaacatgaccattatgaggtaagtgatgttctagctaagatcaaatctgcactaccttattttgaaggaaattatgatcctcgtgcttacattgattgggagctagtggttgatagagaatttaagaagcatgacttgtctgagaaacatatggttatgtgtgcctctaatgttctaattaaaaatgcttcttctgattggaaacatctttgtaggcataataaagtacctcaatcttggaaagacctgaacgacatttgagagatgtttatgttcccatgtattatgctgacattctgttcaacaaactacaatgtttaaaacaagatactaaaagtgttactttatactataatgatatgcatgcttgtttattacgttgtggtttagatgaatgcgaagaagctacagaattgaggtttttacgtgggcttaacaaagaaattcaggacattctttattgtcaaagatatacatctctttctcatttgttataacttgcttgcaatgctgaaagtaaaatagaggaggacatgaagaagcaacttgctatgtttttgccttctattactaaccatttgcaggaagtagataatcatgaaaaggaggagagagacatgaaaaagccgccagtcctattattcacactcaaagtcgaggcacctccatcatctgaagagggcatcaaaggtaaagtaaatggtgctgaaattaatcaaggtgaatgtgttgttaatgaagtaaatttttccacttttcatgctaaagtagagcaaccgttagtggaaccaaatgctgaaattcctttatcataagttaatttacttgttgttccttgtgataaagaagagttgtgtgataatgcttcacttatatcaatgccacaactagttaatgaacatgctattcctaatgttaattctgctgattttaagtatgttgttcacattgctcatgaagttcaggaacgtcaattgataacttctttaaatactttgggctatgttaactttgataatttttgtgagctcgataatttgaaagagaaattatttgctaaatctgatttgccatgtccaaccaatgctatttttcatatctttggcgaatataataatagaaaaatatatttggtgcatagagtttatatatgttcggatttagaacctcctctacatgtggataaaacttgcaagctaaagatacatgttatttctaatcatattacttccaatctctcttgttttgattggatgaaacatgttgttttaaatcgaccacgcgttgagcatcatatggaaaaaccgaggacggttttccgtaaagaaggggaggatgatgtgaccatggctactacggatacaaccgttgctcacatcatggatgaacatcacgatatcaagttcaagtcctccaagtgctggaatccgattcggcctacttctacactgctgatttcaaatggccgccgaatctgcatacaacctcggttttcggcccgtgagtatttgatggaaagctctcggagtcctcttttcaacggatccaacctcatccccgaattccatctcctttggccgcaattgcagaaacaaggtgctgcatcacctatcatgggcctttgggcttgtaacttcgtttgggaccccggcccaagtggggcccatgtggggtgcgccccaagctggtagagcacgacgttaggaccctcttggtcattctctcacatccttaaatacctaggtaccctttcagggtttcttgggttttatttagatgaaagtttagccattgctacttccttgcagtgcgtgtgtcagctagaccgtccgtctgcttgtattcgaaaccccaacttatcgtgtgtctgagattgcttttatcttgttcttgcttgtttcttcgatttgcttgcaggaatatggttgatctacaccggcaagatcaacaacccacggagaggtgtatcgatcactaaggcgcaacacgtctagtacggttgtagttggatcgtcaacgtttcttccaaatcgtagttatcaccaactcaccgaaagaccggaccaaacaactgccttgagtgtcgaaaggaactcaggatgcatcagcgcctccccatcgccggatcagccaccatagcacaggcagagggcggccaccgtcagatccgcacaatcgtgtgcctcctccgtcttgctccgctgcccgagtccctccaccgccgttaggaggaaagagaggggagagaagtgggggagaggaggaggaagccgtcgccgtcgcccttgcccttgccccccgccggagcctgctacgtgctaccgagagtaaggagaggggagaggggagaggaggtggggagagtagtgggggatatgagtgggagaaccgggagaggagaggagtggagtggagtgagggtgatgggggtgggtaaaggagtgggaatctttcggggtatttttgcatgcatgtgagttaagaacaccgcatgcgaaaatacccttatttcccttattttggtgcggatatttctaagcggttcatctagaaaaatttatttttatatatatgttttaaagagctgtatggaaaaatgaggatcgatctttacagacacggacatttatgtttcgtccgcaatatattgagatgctcgtgtagaattttttttaagcagtgagaatatcttagtgggaagacggtaaagtaggcctcgaaccactctctctctctctctccatgcatacggaggagtaatttctctctgtgctattgatgatatggggatcgagttaagaatatgctgacacgtctgatatacctgtcaggccattactaggatagggcacaccactttgtcaggcccaaaccgaatgtgctgctgcatgctatactatctgcactggatatatatctgcatgcatctctgccgccaatccatcataaagtaggagtatatacctgtatacagtatatcatcatcagagagagtagtagtagtgttatgcatgcatgggatcgatgaattaactgctacagttaccggctgcagcagatgagctgagctgaactgtgctaggctagccatgcacagatgcactcccctattaaattaccaatcactctattccactctatatattcgtccacgaatagaaaagattatacgaagccttttaaaatataaaggcctcaaaggttatccataagtttattataagtcataacaatttattagcagccaaaaataatttttgtaaagttttgtgtatgtgttcttagcgatttaaaagccaatgctataaaataaactatgctaaaaaatattttaaaatcaacttcaaaattaagtttcaaaatttaaattttgactttgactttggtgttttaggcaaccgatcgatggagctcaaacattttagaccgtctataaatatggttagaaaatgcttatattttagagcgaatgaagtatgttgttaaaatatatagcttaaggggttgaggtgaaattattttggtacttctaaaaaccttttatttaattaaaaatcacgattacccatgtaagtgagcaatttaatacaatgaggaattggaaaagtaatactctaaataagatctgttatatttaatttgtagacgagttctaaattaaaatcaaaatctctatagcttgtactcgtgtatggagcactaagcaatgtattactactatctagaggtagagggtgcatgcctgctagagctagctagcgaggttgcatgcgtaggattcccgtgacctggtctggagcgattgttgctaattatcagctagcgcgtcgatcgatcgcctatggatggatggatggatatcgatcgatcacaggaggcacttggttagattgctattagatggatggcatatgttggggggaggacggagcgaggaggggttggttggactggacaaccgatcgatcgacgcgtacagctcacacccacaggaaaccaaactcgtactgtacttgctacagctatatctcctgccattgcatgcgtcagatcgacttgctacttgcttctctccatcaaccatatgatatgagagagagagagagagagagagagagagagagagagattggggagagttaattactcagtttatcactagtactccaataagcatatcgatatgcaactggtgattaattcactgtacgaatattgttgtgcgacaagattaaggtatgtttgaggagattttaattttgagaagtaactagtaggaatccttggtgataatgtgaataagttgagaaaacatgccaacttcttgcttcaactccctctgtctcaaaatatagtcacaacaactgttagcattaggctaatctaatactaggttactatatatattttgggagacggagagagtacaactgtggcttcttagaatctagatgaaaaattaagatggattgtttgaacgagtttttattctggaaaaagctactaaacaagcccaaggagcaaggtttcttcgactaggtcaagtagttgggcttcatttgtgattgttgaactatggtgtcaggtttctttaggtgcaggatattcgatcgttccattatcttaaaaaatacagttattgtgttatgctgaatcgtcgtgttttttgtttttgtaatttgttttaaattagcaaatatattgtttcactccgaaaagttgattttcgtagaacaatcatggcgatttataatgttagacaaaatatgatacccaatataatcgttctgtcccacccagtggcaaggccaagaaatttaacatggcaaatcgaactgtgtgctaagtgtttaccgatgatcctgggcagccacccaggtcatcgggcggtggatagcgttattgcttgcaagttagattaagagatcaactcatcaaagaaaaaatgctgaaaacagttgcatgaaacgagattatttattatacaatgtacttcaacaatgtcaattaagcaaactattagcatttaattacaaaaaaacaaaatactacataaatcatactataacactttaatccatcattgatgtttagcttgcttacatgtaaattaaaaaaaaaaagtaaagtaaaaaggtaggaacaacctaggtggaacaaaatggatccacatgcatgggatttcacaacaaagctagcatggacgcaacaaaagtgaaaaagaaacagaactaagaaaacaaagaccatgacatgatacacggactttgatgtcagaatgttatgacaaatactataccacatatagtaataatataatcagttaattgattaatatctcaacccagttagctagacacaataactagttaaattactagtaatgaattagccctgcagctaagctcaattccttcggaatcagctgttaatttgaacccatccacacctccatcgccggcctagggcagcatcgcgaacgtcgagatgtcgccccacgccgggatcgcgctgccgcagttggaggtggcgttatcatcgccgccgctactccggccgccgctgttgaggttactgctggtggtggcggccacggcggcagtggcaggcggcggtggggaagggagcccgtaggagcagctgtccatgaaccacgacgtcgccgacggcatggccgcctccatgctgggaacactaccagccatgtgcatgaaggcgccaccgcctcctccggcagcatgccctgacgctgtggcttgggcgccgttgccgccaccgtcgttggcctgggcggcggcggcggcggcggaggcggagcccggcgggccgaggaacatggtggcgagcctctgctgctgcagcttccagtgcaggtcctggttgatgaagctgagcgactcgatggacgacgcgatggtgctgctcaccgcgccgtggccgccgccgccgttcaccgcgttgccgccggcaatgtcccccgagggccactccccgaacggcacgtactgatgatgcccgacgccgccgccggcgggggattggagccgcggcagcggcagcatcccgacggcgccgccctgctggaagtcggccaccgcggcggcggcgccaccgagcggcgacgtcgacgacgacatcatcatcgttgttccaccgccaagaaaccccagcctggcagcagccgccgcagcggggtcggccgctgcaccgccgataccctccaccgtcggcaggttgagcgagaggcgcgatgccgccgccgcggagcgggatcgcttgttcttgcggcagccgccgccgactgggacgttgcggagcgcgccgcccttggtccagtacctccggcacgtcttgcagaagtggcgcggctggctgaggctgtagttgttgtagtagcagaacttggtgttcggcgagtcgcaccgcgggcaccgcaacccctgctcctgcggcggcggcggcgggagcggctgctgctgctgctgctgcgccggtggcggcggcggcggcgtcgtcgtccccccacctccagctccctttcgcggcaccaccgcgtcgtccccggccgccggcgccatggcacaccgtacaacaacaacaactgtagctagctagctagctggctagctgcagggggtctaagctggctagctccgtgatggcgcgctagctctaggttggtctgggtgtgattaggtggacagggaggggtggccgtgacgccgcgtgcatataagaagaagaggagggagatcgatggtggaggagggtttcgtgcgggggagggaagaggaattgaatggcgtctcatgtgtgtgtgagggagaggaggaggatcatgcgctggggctcggatcggctgcatgcatgggattaatgggaggtaaaaaagcgacgtctcggattgccgcctgtgattgccatcaaagtgctcagctcagcaccacacctcacctctcatctcgtctcatctcagcgtctcagcccagccagcctaccagctagcccgggtaataatcacctgtgattaatcaatgttgctgcatgccttctccctagcgtagctagctctcgattgattaatcgatcgatcgatgggcccctgttcactgtgcaccctagtacaagctgtctgccgccgcctgccggcgtgtcagagtattgtctgcggcgacgaacagtacggaggcggtagccgtcctggatgttttacactttcgtccttttcaaaaacttgtttaacaaataaacccctaaaaaaacttacaccgtactagaaatggttctttttggacgtcatagtcattggcgccgtggtccaataggacggtgacatcatctcttgcaccgtccccctgccatcgtggctggccggcgctgacgtggcaggggaagcgcgccaatgataattttcttttattttattttatactttttcacatttaggagcacacaagaaccaaacatagaaaaattaaactcaaacgaatgaaatgtgacctgtagaatttttcaaagctctatcaaaaaacttctcgccttgaaaacacaatcttgcaagcagaatttcgagattctaatttcaccaaacccgggcgaaatgggggagaatcagatgtaactttttatgtagatatttgtaaatatataatttgcctttttctgtatttgttttaagaaaggtcactcgaatgtaacaaaaaaactcaacaaacactaacaaagcaatgctagtaaaaaaatgctaaagggtttataggattaaggaaatgtaatctaatattgttttggtaactttctgactataggaaaaataaaaacactgaaaacagaaagtctcttaccgataaatcttgcgtggatttgagaagagggagagagagagagcaagagcagcggcgctcgggctcgcgtagggagggcgcgggggatgggtgtgaccctcggggggagcgcaccaaggaaaaaaaagatagcattgtgggtggggggtagcatcattggcacgctcccccttccacgccagcgctggtccgccacagtggcagggagacggcgccagatatgctagccccatcctagtcccattggaccatgatgtcactgactttggcaccctaaaaatgaccatttctgggataagtttttccagaggcctatttgtgaaataagtttttaaaaaggaccaaattgtaaaagattcgggaagcatacaaaaataagggaatggattctaaactctcgagggaatatctctctgcatgtcatttaaatagttatgaaaaaaaatttaagaagatgtgttacatgtaatatatcaccacaaacatacaagtccaacttctacatgtcacaacaaaaaataaataaatttgatttttaattttttttttcattgcaatatgtagaagtttaatttgaacatgcagtttgtggagtcgatctagtaatatatcacatgttaatacatattcttaatatttttttaatttttttcataactatttgagtgacatggagacaacaagaggatatcccctcgaaagtttagaattgttttctctaaagataatactacatccatatcggaatataagtgtttttgacggtgatatatatggtcttcgaaataatactttgactgaaaaatatttataaaataagttatttcaaataaatggagtaacatattataatagtttgtttagtgataaatacatcaacatcattctcatagatcaatcttttttatgtttccctattaatagttaaagtgaaaaatgtttgacttaaaattattctaaaaatttttatattttgaaacggagggagtatcttagtattactaatcgaagcatgtacagattcataatactagtatacatgttttacatattatattttaggtaaggcagtatatactatcactggtggagaaaccgtctttggtcggtcgcccgaaatccacaatagtctcggttccactaaaaaccgggactaaaaatgatctttagtcccggttggtggctacagcggatatatttgatctttagtcccggttggtgttaccaaccgggactaaaaatgatctttagtcccggttctaaatctgtcaggccttgtcagccccccgagatctttagtcccggttggtaacaccaaccgggactaaagatagggatcttgttaccaaccgggactaaagatcaacataagctttactcccggttggagttaccaaccgggactaaagatgtatttttagtcccggttggtaataccaaccgggagtaaagattcccatgctatccccgcctttaagt

SEQ ID NO: 80477 - DNA, 19396 bp, Oryza sativa
ttaggggcttacgaaatttcgatgttaacaacttcataaaattaacattgccaaactgttttggtctcattcgcataaactagacaagttcgtgtactgaaacgaatattttacaattttatatactaaattgcattcaccttacaagattgtgtatcaccgatgcaaatatgcaatttactctttacttaaagtttacagcttttctagaagaacctgtttgctgctcaccacagtaaatgctatccattttcagcacttcttcattctcacgaacgtgccttctgtcttcaccggccatcattgttgagataggtgaggtcctcatatctaccccctccgtcccaaaaagaatccaattctagctacgaacctagacataggttcgtagctaggatttgcttttttctgggacggagtagtactcattccacttgtcccattcttgttgtccgccaccacgctgtgttgtcgccacataaatgaccaggttatctgttgacatggctgccattgcattgtgatgtaagcgccacctacacattcctgtcctctatggcgtcccgtgtggccagtggcgtgcgagatggtatgccatctcgcccggccgatcagtttctatcgatgtagaccatcgattaccgtgtaccacctcgctggacttggtccacactaaacctctctcttctgcagtcagtggtacattgccagtttacaactgttggtgccataaatcttcctaccactaaaaacaaatgctttgtagagacatttttctagtgctgtagaggcacttttcaaatgcctttacaatactatagagacatttttaaaaatgtctaataagtgtcttatggtgaattcaaatgaagagacattttataaaatatctataatatggtagaggcattttctagagacattaaattatatcacaaatatatgaaaccagtccaaaaaggagaataaaatagtttctttgcttttaacaagtcttaaacttgagatcacttggacaaatcatttttatcttcaatgcactaactaactcaactccatgtcattacttgtatgtttgtgcctttagttaattatatatagtcctttagtacacattatcattgtaacaagtgtctgtacatagtttaaagtgtctcaagaaaatgcctttacatatcaggctattttacagtgccgaaagaatgcctctacaagataaaatctaataagtagagcagaaaacgtctctagagtaaaagtttgtaggcaatttttaaaatgcctctataaaatatctctacactataaaacttctgatcttaaaagtaatttgcaaaatgtctctacaaaagtgctcacataaaaccgctgggtgaaaaatttagaaccgacgccatagataaaccgttatatataccggtggtatatatgaatgtactaactatcattgctgcttcacttttgtggcggagacaatgtaattggcaattatgggcaccggcacacatttgtacttttatctaatagtgcatactccctctgtgccataaagagataactcctagcttcccaatgcgaaattaatgaagaggataaaggaccaaaatacaattattaatagcttttttttagataatggaatagagcatcccggcctttactcaaagagctacagccaattattacaatctcacactcaaaatgagtgaagttcaaagaaacttaaaggatgaaaccaaccatcaagaagaaacaagctaaagactgccaacccaagataaagagtacacaattattgaattatgtttgacaaaaagttgcataactgttgtctcaagaatacggcatgcagcctttaaaagctcactatcttcctcatacttttgtagttgtgcccaagaccggagtcaatgtgttgccctgaaaactacctgcatatattaatagctagtattggtagatatgtaggcaaggggtattgaaggaataaatttttttgatttgcgaatcaacagtgaataagaagatagaagttgatttattttaggacaaagtttgaattctataagttgatttattttggaacggagggactatattcctctattatctactgataagctccctcctactcccacggcacgcatctgactgtgatgtgtattgcacgtgcacaataaccagcactacctttaaccttcagtccttttgaagcaaaatgtgaatccacttattgatatattattctattgtttgtttaattattttgggattgtcctcgacatttgtcttttttagcctgatgccctctgtatagaaaaaaatcgttgcatgtacgcttgaatggaagcggtgtgtgtggcacagatttataattttggagatgatttgaaattagtcaaagcatatctcataaaagtttatttggtgcccttcaagctaacgcatgcagaaatatctccatctctcctctgatactcaaatccatatatgtgcctcaataggattaatcccaaattagctaggagcctcacatgcaactatgtaaccgtactttggtatgagtttgctatctcctaattgcattagctgtgcactcagcacaatacataatttccaaggacaagtttaaactccactattgcggggtacgtaggggttttggagaaccattggcggttgatgataccctcgacactggtttaacaaaatacatactccgatccctctgtccttaaaatgccaaattttatctaatcagaagtggtttttgttagacggattgtgtataattaaattaagtgctatatatgtagtattgtgtaaacaccatcccatattgcacggcaataaaaaaaagctattttaagcagagtatattgtgtgtgaacgcgtcccaaaacacatttttggcagcaacagtaagaaatgtgttttcttgtgctggcaacatttttgtttggcatttaacttttttctagttagaagggaagtttacagctaatatgaatatctcctaattaaagtttacagcctttctggagcaacctgtttccagcacagatatgaacatctacctcgtttctcccggatctacccctactccaatcctcttttcatctccaaatcctctcttttgtctctccttctcttcttgcaggtttcctacttctagacccagggcaccatcagaaggggtacccatggaccatctggtcttccatcttctggtgatggcaaaggcaagggtgtggcaataacaggagctaatccatggtattcgggtgatgactctgatggaagcaacagcattagtgacagcgagagaacagttaccgctgatttcagaatatttgtgtgcatcctggtggttatggtgatcaggaggtggattctcgtaaggctaataaccacgaggcagattcagaaaccgatagcgagagaactgaaggctgctagctttgggatgatcgcaaatagttttagtaattctctccatttctctcctatgtggactctgagttgcacccaggaaaaaggtagaaaaatgtagtgtttcaacctgaggttcatgaatttctatcatatcctgattttttttgtctccatgatctttttatggttcatcaaaaatatcagatatcgcaatccattagttttgatgagaatatcacaaacggtgcttcatctcagttaacttttaaatccagctcaatctgattgttttgcgtaggtttatgttcctgattacgataaatagtgctgtaacatatataacaaatttcaacagattttgaagtactggaacacaatcacctggaaaaacaacaactgtaatatattaatttcgacttcactttttctctataactaacacaatatgattgcgctccatgggattttttacttcccttgttatttctgttaaacagtcctgcaatacaacatatattccaacatcttttctgaaattggtattctttattatagatgcaaatttgaataaagatacaattcttatagtttctagaaaaatgtatgcaatccggtgagcagcacagtgatttttgagccatatgtgtgtgtgtgtgtgtgtttgtgtgtttcctatcacatgatcgaattagtttaaatcgttcacgagaccttgtattgtcgtactgttcaagattctcaccatggttatatactttcagaggattctaagcggtgacaatcttgtctagagtggtcaacgacaagatgcagactctgggttgtttctgtggtcctcaggaaaaacacaagtgaaaaagaaaaacacaagtgaaaaacaataaggatattcctgaatcatggaaggttcatccaagaaaagatgaggttgatccaactggatgggacatcgagaatcatcttcgaaatgatcagaagaccaaagataaggttagtgaattaatattatatgttgatcagttatatttgtttcataaattttcatgattaattaaaagagttaaatgtgttctttctcaaatttatgagtgtatcacaaacgaagttttttttttaaatgttttgttttacttcgttagggtagatagttttggggaaagataaccagccctgtcatcaatataacaataatatgtagggatttttaatcttagcaggttcaacgtttctgaaagtaccggtgattgtacacatgaaatagtaatcttggagattggctgaaaatgttaaatgcacaaatgtttttgacataaagatgtgttatatgttaaccctaaaagaatgatgcatgatcgaaaaatgagctatatatctatcatttatttctttgtgtaaacccaaacatgtgttactcttttaaaatttatactttgtataactacagtataaaacctgacacatggaacaattgaaatccaacaaacagatttagtgtttaaacagtactgttggttgggagtactacccacatttagtcattcattaaatctgaatattaagtctcatatcgtctagcaaaaatacttctcatgctacaattaaataatggtaataaaacaatttgcattcttagaatatatctggtgggatatgtcacatctggccaatatgtaacatggaaccattggaatgcatagttctttatctagtaatgacatatggcaggattggagtggtttgtaaagttacattcctttttaaaaacatattcttgtttatataacatgataatttgtgtgcagtcaaagtaatatgtacaaaaccaaactattttatgatagctacctttagtacaaatggcattcagaaaatatatttgacttttatttttcaaatataatcactattagaacacagtatgttgcatataaataatatatcttcttgctaattcattaatctaacttatcagttctaacaatgaattgcgagaacatatcaaaaattaatttggatcaaagcctgtatactgtgaatccttgcacctttgggtggctaactagggtcatacacgtgatgcagtattgggatatattgagtttttccctcccatatccccttccaaccaaagaaaaaagaaagaaaatgcatgttggttatttctaaattatacatatactaaatttattttgttgttcatatgttacatgaaattaatttttttctcacatagcagtattaccgccacaaggattacaatcataaatttcgctcaaagcctgaagttcaatattttctagatactggaaaggttatgattccataaagttccaggcattctacagaaggtgccatgctacaacagtgtttcgaacattgtattctgcataattttcccgttccaaatttgatactgattcccatacgttgtttctgtacagtgatcagttgatgcacgtgttcctagcaggggtaagatttcataaaactgtactgcagcttggaatatttaactccataggaatacattttcattcttacagatcattgaatttcgcggatatgaattgtgttttagatgaattatatatgggaagacctgcacgacgattaaagtatttgattaaactgaatcagtacaactgacagaaacaataaatagaaaaaatatataacaccattcattaatatatatgtatagctatatctaattttttagataatggaatatcattgcggccttttctcatatatatatataatggaatatatatccatacaaggtattttagattattttcatcttgtatatattgtcaaacatttcttaactgctatagaaaaatattatgttactcactgaatcgaactgctgtatatgacatatggacacaggccgcgggtgccacgcccatacaacgtacatgctgctgttctcgtctactacatgacgctcgggtgtacgaggtgttccagaactatatggtcagctacctgctcgacgtacgggcggtgagtacatcatagtcgtacggaaggctacaccacctgcgcaggtggtgcagccgcgacaccaacgccaccaggtacatgctggtgacgtagttctacaccctgtcctcgcactacctgcagcctagtggcgctcgacacgaagatgatggaacgatccctcgtgatccctcgttgagctaccgaggtaagtatctgcgggcgtcaaaggtgtacaacaaagaacggagcttcaaagccatagagatggccggcgtgatcgggctattcgccatagacgacagatgcctcatgctctgtgtctagctctggcacggctcctgaaggtgacgctgtgggagctggccaggcagatccctccctttgccccctgccgctccttcccaccatgagccgccgctgctccctccctccacgagctagtgccaccgcaagagagagagaggcaggatgcaagagatgaatggatagggttaatatgaatggataggattagatgaggatagggttgcttcgagggtattctaatcgttatgaaaagttattatatttctttttttgaaaagtaaggtaaaaaaagtagggtaaattagtagttaggcttcgaaacagagtcaaataaggaattgtctcatatatgtggtatctttccatataaggcgacaagatacaactcaacacaacgcatgcatgcttttcagatcatgtttgaattgcatactttattaacagtgcaaactctactgtgccaccaactctcacgtgggagttgcagagcacggtaaaaaaaaatcacacaagtacttgtaccagtactagtaccagtactagtactacttcactgtgctacccactccactcacttttcttcaccctgaagacgaattttcccccaatcttttccccaagaaacgaagaagccgcagcagcgatgacctcatggtggtcttggcgcagcctcttctcctcattgggcaatggagggggcagcaatgccgatgcttcctccggatccggcacctcctcccccccacccccggtcccttatcctcaacaagcagcagcaggggcgcctcgctggcgaagcaattgcacgatgaagccttgggaggaagggccggccgaagcccaagccaaaccctcgcaatcgcagccacagcccgcgccccgcaagaatcgtccttcaccccgaaaggccatgcccaaggcgtccaaggcgaaggcgcagctgcacctcggcgacgtcgagccaaagaaaagctagccccgaccccgtcttagaagcacaataacaagagaaagcgggtggcgagattcgagcggtcatggtccagggctaacgggatcaggattctagaggacatggccaaccatgccaacacccatcgcggcgctctgccggataccagcgatctctttgccgcctttgccaacagcctcgacaaaagagatgccgaccaggccaagctcactgacaaagtccacaagttcaagagatgatatgacactgcacgcctgcagcaatgcagctcgactgacgacaatgatatgcatcgattgttagatcatggagcagcactaggtgcacctgatcggcacaaaagtggttgcacatgagcctggaggcagcgtcgccaccgggggtggcggtggagcttctgcaacgtgaatcaagttatttctctacaccctgccatggcgatggcagccaccttttcttcctccttcagaacacgaggaaaatgcagtttagctagcaatcttatataatccactgtctcccagcattgcaacaatcgcatgaagaaataatctagttttctttttgaatgtactatatagccattggaagggtgtttttactatacctcccactagtgggtgtactagtgtagtaagaataaatcccaccgttgattttggtattaaggtggaaggataattaagtaattatacttctatgatacgctgatgcttgccagctgcctagcccaaaatagatcaatacttagctcatgaagcagaagcatggccactgtatcgcacctagccagcgtccgccatcgatcgttgcacttcccttcttcgcatgaacacggggatgggcacacggcggctccgcccctcccaactgtgctgccaacaactagcacccatccttgcgcagagcgactgttataaaaccagccctgcaatcaacatcggtagttaaacgcggaagaaacatcataggagatccaaacacgatgacgtcaccaaggcacgatatttgataacggagttcagccgaggcctacatctctggggtactgattacaggtgctcttccaccatccagcatattacagtgtatcagaaagttacaatgagccgtgccgctgccactagccgagagagagggagagagagatagacgggatatgagagatgaatggatagggttaatctgaaaggataggattagatgtggatagggtttcttcgagggtattctgatcatttggaaaagttattatattttatttcttttttaaaagcagggtcaaataagcaaactaaaaaggtagggtcagattagtagttaggttaggcatcgtaacagagtcaaataagaaattctcccatatagatggtatcttttcacaaaggacggcaagatatagaacatgcatgttttcaaatcatgtttgaattgcatactttattgatagtgcaaactctactgtgccaccaactctcatgtgggagctgtagagcacggtgaaaaaaatcacacaagtactactgctacttcactgtgccacccactccactcacttttcttcaccctaaagacgaatttcccccaatcttttccccaagaagctgagatgccgcagcggtgatgagctcatggtggtcttggcacagcatcttctcctccttgggcaacggaggaggcagcaatgctgacgcttcatctggatccggcacctcctcctccctcctgtccctcatgctcaacaagaagcagcaggggcacctcaccgttgaagccgaagcctcaggagggatagccggccgaagccgaatcccaagccaaaccctcgcaatcgtagccatagctcgcaccctgcaataatcgtccttcaccccaaaaggccacgcccaaggcgcccaaggtgaaggagcaattccagcttggcgacggtgagcctaagaagaagccaacctcaaccccatctcagaagcgcaacaacaagagaaagcgggtgacagcattcgagcgcttgtggtctagggccggcgagctcaggattctaagggccatggccagccacaccaacacgcatcgcagcactctgccggatacctgcgatctttttgccacccttgccagcaacttcaatagaagagacgctcttgcggacaaagtccagaagctcaagagaggtatgacaatgcacgcctacaacagcactgccctactaacgacgatggtgtgcgtcgattgttggatcgcggagcagcacctggtggacctgatcaacacgatggtggtatcaccgcatgctacacctgagcctggaggaagcatcacccccgacggtggtggtggggaggcataatgtctccttgtttttgtcactggagctggaatccatgagcttttccaacgtgcatcaagttatttctctacaccctgcgatggtgatggcagccaccttttcttcctccttcagatcacaaggaaaatgcagtttaactagcaatcacatataatacaccgtcacctaggattgcaacaatcgcatgaagaaataatctggttttctttttgaacgtactatatagccaatggaacggtgtttttgttgtacctcccaccggtggatgtactagcgtagtaagaataaatcccaccattgatttcggtattaaggtggaaggacaattaagtaattatatttgtatgataggctgatgcttgccagccgcctagccaaatagcgttcaacccttagctgacgaagcagaaggatggtcgtcgtatcgctcctggccatcgtctgccatcgaccgtcgcacttctcttcttcacatgagcacggggactggcacatggcgactccgcccctcccaatagcgctcccaacaaccgacgccgatccttgtgcgaagcgactgttataaaaccaaccccgaaatcaacgtcgatagctgagcgcagaagaaacgtcataggagatccaaacatgaagatatcactgaggcacgatatttgataccggagttcagtcgaggcctacatctccagggcactgattacaggcgttccaccccgatccagcattttacagcgtatcagagttacaacgtgctggcgccgccgccgccacttgccgagagagagagagacgggatacgagagatgaatggatatggttaatctgaatggatagaattagatgcggatagggttgctttgaggcattctgatcattatgaaaagtttttatatttcatttctttttgaaaagcagggttaaataagcaaacaaaaaaaagggtcagattagtagttaatttaggcttcgaaacatagtgaaattaggaattctcccatatatatggtatctttccataaagggaagcaagatacaactcaaaacaaaacatacatgtttttcacatcatgtttgaattgcatactttattaatagtgcaaactctactatgccaccaactctcaagtgggagctgcagagcacggtaaaaataaatcacacgagtacttgtactactactagtactactttaatgtgccacccactccactcacttttcttcaccatgaagacgaatttcccccaatcttttcaccaagaagcggagaagccgcagctgcaatgagctcatggtggtcatggcgccgcctcttctccttgttggataatggagggggcagcaaagccgacgcttcctcctgatctggcacctcctcctgccctcccatcccccaagctcaacaagcagcagcaagggcgcgtcactgccgaatcgctcacactcgtggtgtactagtatagcaagaataaacccaccgttgattttggtggccatttgagtcatttatttaattaaggtggaaggataattaagtagttatggttctatgataggttgatgcttgccagccgcctagcccaatatcgttcaatccttagctcacaaaccagaaggatggtcgccgtatcgctcttgcctaccgtccgccatcgactatcgctcttcccttcttccatgaacacggggacgggtacacggtgactccgtccctcccaactccgctgcaaacaatcggcgcccatccttgcgcaaagcggctgttataaaagcagccccaaaatcgacatcggtagctaaacacgaaagaaacgtcgtaggtgatgccaacatgatgatgataccgggtactatatttgctaacggagttcagccgaggcctacatctctggtgcactgactacagacgctcctccatgatccagcatattacagcatatcaaagttacaatgactcatgactggacgccgccggcaaccgctccttctcgctatgctaaatcgccatgtggtcatagcaggtccacccctctatttaagagagatactaggatagagacagactcttactctattcctaacatctaatacaactccaagtcctatactgcaaccgacaacatacacatattcgacacaaactccaacaaactccaccttggcacaaactttgtgtatataaactttagacatataaattttgttgatatatatttgaaacaaattggaaaaagattagagaaataacataacatatatgtgggatgagagacccatacgataaacgggccaagccaatgaaagattggactcatttttgccaaaaaaaaaacgaaaacaacactcttcataggaaaaaggaataaattcactctaggtccattaatttgtcgctgaatctgaaatctatacctaaatcgacataccatgtataccctatgttccaacttgcaataccatgtcaactttcagtctagaagtattgtggccggtttgaactgacgtagcaagtgggccccacatgtccgttccaattcttctgtctcctttctctctcctctcgtatccttcacatggcaatggtgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgcccctagaggggctccctgccctccttatataggttggggggcaaggttataagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggtttcgataattgtagtcaaccaagcgacttaatattaatatgtagcatatgcggtgtgaatccctgaataatatgatccaagtgatacaccgactgctttgtaaaatatgatgagtgtaacctaaagttggctacattattgaaaattcacatagcaaaacagctataaagaagcttgtatgttgtgaataaataaatttccaaagtattggacatacgccatgcgcacactgctttaacagacgtgctttaatccctaaaagacacatggtttcaccacacctggaaacatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaacatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtgatagtaaaaacagtgacaccaatcaaaggtaatgaagttgcataaccatggaggcgaagaaaccagtcggcaacagtcaggtcagctagcagtgaaggtgtaggcgcccaacaacaacgaaagaacagtcggtggtgacaaaagcaaaccgacgatgaagacgtagacgcgcatcaacggtgacagcgaaatccaccaatcatgaagatgaagaaaataatcggcggcgacaaacgcatccgacggtaatgatgattagcggcaatagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatattcgaagttgttgaagtagaatgtctgttccgaagcgaagatgaagataatgactcctggagttgactcattggctgattaattgatttcttcagcttgacataaaatttatcaaattttgagccttgtatttgtgtagcccccgactctttgattagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagtaaaacttgcgaagtagcagcaatagagtttgccagtgccgaagataataaagatgaagttgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtaactgtataaaccagacgtagaggtgagagcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagctgcggatgcggcggccggtcggtgaagacgtagacgcccaacaacggcagcataataagtctgccgtgcaggcggaagcaccaatcggtagcggcgaaggcaagccggtcggtgaagacgcgccccagccgtgcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcgacggcgacggaggcaggccggcggtgaagtcgtagacgcccaacagcggcggcataataggccagccgtgtaggcggaaacaccagtcggcggcgacggaggcaggccggcggtgaagtcgtagacgcccaacggcggcggcatataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgcccctagaggggctccctgccctccttatataggttggggggcaaggttataagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaaatggccgccggcggagaggggtggttgccggcctccttcccttctcctctctctcccttgatgcaaccggtggctggcagaagaggaaaaaaaccatcttcttcatcgccgaccttccctcctccttcctcgagctcctccgccttcctcttcctccacggcgtagcttgttgaagctctccacagcagctccctatctagggctggagatgctgacggcgttcgtcagctcaggcgtctcgagctcctcgccatcatccacgtcatgcgcgagcgtgttgagtacctgtgctctctcatcctctccaacaaagtcgaggacctcgccatacggtgtgtcgacaagcataacatgtgcagaagattggataggattgcaatctgtaagtaaatcataaatcatgctctttcttcactggacattttaatttttttagactaaatccttcaatatcaatattgagcaaa

SEQ ID NO: 80478 - DNA, 4797 bp, Oryza sativa
cccacaaaacatcagtcccaaaaggaaagaaaaaagacccgacaccctgaaccgaactaaaagctgaaaattaaaatccgaccacgtgcagtgcgaccaatcgcttaataaatagtacctctctccctctaatataagggatattcattattttcttataatgtttgactacttatcttatccagaaaatttgtgcaaatataaaaacgaaaaattgtgcttaaagtactttagataataaagcaagttacaaataaaataaataataattctaaattgtttttaataagaccaatggtcaaacggtataagtaaaatgtcaaaattccttatattaagagaaacagagggagtactgtttcgaagctctccgcgctcccaaattcggtgcatacgcaggataaatcgttcatcctcggaacgtgcagcgcgccgacgccgtctcggccttcatccgttcatcgtcccctctcctcactcccgttagcgccgccgtcttcttcaggagcaagcgagatagaaaggtagagaaagagagctcagaggtgctcctcgctagcgactcccctcacctttcgactccaggtgacgtcgccgccttgggttcgcgtccaacgccagcctggctccctctgccgtccatctccagtatcctgtttttccatggaaaccctagaaaatctatttcctccgtttcataatgtaagtcattctagaattttccacattcacattaatgttaatgaatctagatatatatatatatatatatatatatatatatatatatatatatatatatgtctagattcattaacatcgatataaatgtggaaaatgctagaatgacttacattgtggaatgaaaggagtatgttcgatatgtattctgaatgcagagaaatattgttttgttcatgatttgtactgtgaagtataaaatggtatgaattatctgtaaacccttacataatacactactgtcaagatgttgtattttttttttctaaatcttccaggttatcaagcactactgcatcgtagcagcgccataggtaggaggtcgtatggctggggatcgtctcgaccttccgtttctccacatgtgcaacaagacgtcgatgaactatagcggcaaaaaagaaaatcagaggcagcagcgatcggcgaggcgtcgaggtactgtagcggcaacgtatccacggcaagaaaaaaagatcgatcaactgaactaggcccacatgcctacgtggccaacaatcatataatattaggatttttattttttatatatcactgaaattatatatcactgaaaatcggtctgttatcttatatgccacttaaaattggctcttcctctatatgcgattggcttaaatttgtgcaccctctcactctcgactgttgactgcgtgttgactgactagggtcaagtcacatgtctttttttttcttgcataaatgaccaaaataacctttggttcaaaatcatgtgactgcaaacattcatatattcaatagtatgataaatagtgaagatctagtggcataaagggaagagccaattttgagtggcatacaagggaaccaactaattttcagtggtatataagaaattctcaactttttattagcataataatttttgggacggttttagtccaagatttttgggaactaatttttaatcttctcttggagatgctggcactatgccactgtctaccaaaacccccgaaaaaatgaggattgagattggttttgggcaggaataagttcacttcgactccattaggtagtacttgaatctgattcatatccttaaaccacgatactagatatcttgacccccccaactattaaaaccgatacaatttgactgcttcggtggttttggaggggcggtttcgctgacgtgacgcttacgtggcagggttgacctagtttttgtttcacatggcattgacgtggcacttatgtggcatttaattaaaaaaatatgtgtgggacctactagtcattcacacaaaaaaaattttgcgacacactgacatatgggggcccacatatcatcctctctctttctttcctctcctcttcttattcctctacggcctggcaggcaagcgagggcggcgaccgtagcggcgatggcgaagaaagcatcagagacgcggttgacgaggcggagacggcggcgagcggtagagacacgtgcgtggcatctccgaaatgagaacggcggcggatgaggcggcggcgacaacctcgtgaaaactcggcggccaagaactcgccgcgggtgatcctcctcacggagccactcacctcaccgatctccgactgatccgccgcataggcgtcgcccgcgcacgcctctccaccaccaccgcctcttccttctcaaacctcccgccgcgcgcctcctcgtattttaggatcgtcgtctggtcttgctgtgcgagcggtggcacctcggcgcgtctttcgtcggcagcgagaagagctaaaagagagaggagatgggcaagtgtcggcctccatgagggagtccggaaggcgaaggggcgagccaacctcaccgtcgacgccaaggacaagctcctcctccagctgcagaggcgagacgccgagagggcgaagacctcctcagccgcaccacccacaggacgtgtcgtcgttgctccagaagtccggccaaggtgaagagaaaatgggagagagaaagagagaagcgagagcgggaggaggaagaaggatggagatagagaggataatagtgggctccacacttttttattgtgtgaatgactaatgggtcccacaaaatttttaattataatgccatgtaagcgtcatgtcagcgaaaccgctctccaaaaccgttgaaagagtcaaattattccggtttcaatagttaggggtcgtgatatatggtattatggtttagggataggaatcagatttggacactaattattaagggagtcaaagtgaacttattccttttgggcatccgttggtggcgctcgtacagattctctaataaaccaaggaggaggaggctagtggaagtcaaccctccgctggacagaagagggcatgccgaaaacgaggtgccgtgaagaagatagagagtcggcacatcataactgaagtgccacgtcagatgtagccaggaattacgtacgacacagctgttgggttgtaagggataacgtgcctattagcaaagtgtactagcgcagaacaagggcacgcagggattatgacgctttgtcgtggattcagagaaagagatgctgtggaccacaatgctcgagacattcacgctccctgcgggtacggagaacatagtgaaacagtggactcttagcaaaatggcagaacagttctagagcttcaagggagatctctaccataaatacatcctaaaggggcagacaccgaacttcaacatattctcgaagctaagggatcattgggatgagtttgttgcttacaagacagggaaacaagggcaagcgctgatggaccgaaacaaagaaaatgccgctaagaagaagtaccatcaccacctgggtcaggcggctatagcgtcgcaatgccgaagtgggaggagatggaagccggcttgattgagaggggtatcgaactggccacttctaaatggcccgatcgatcaaagttatggttctatgctcacggtggaaagctcaaacctgttgatggctccctggtgttcagcaatcagatacgtgaggctgccagtcgactaacggacgcagtggaagcctcttctcagggcacattccgacccgacagagagaaggatgagctgacactcgccctacagactctcgagcatccaggacgaacacgagggaaaggcgtggttccttggaagattggattcatggaggacatccatacgtacaggagtcggatgaggagcaagagaaatactgaggcaaaaattgcagatcttgagtacaaggtatcgaactacgagcttagcatgcaagaggaggtggcaagaaaggtggatgaacgcatggccgcatatcggagccaggatccccagccatacattcctcctatcatggtcagcccctcaggcaatcgtagtagctgtgcctcaacggggcaggtaggatcacagagcatggacgccatgcaaactcaggacgaaaccacctgccccattgatgaaatcacgtagcggacaccatgtgagctgtatattcccttcaagaacttatcaatcaaggtatgctcatagttttatgatttttgacatgtacattccgcaagttgctacttaggttgattactaatagaagataacctctcatcacgtgaaggtggcgtcgggaatggccatcccaacggacccttcagggacttaacactgcaggccgattccaccaagatactcgagggtcgaagttgagctggtggaagccgcgtacgaggacctcaagttggactaccttgaaggagacggtgatatgcatctacgagacacaagccaaaccattatactatggcgcaagtgctacatcatccttcttgggaaacaagcgacgtctcctgcaccatctccttcggctctgccatctcctccgcctcctccgcctcgtgcaccgtctcctcctcaggctcctgcaccgtctcctttggctcgtgcaccgtgtcctctggcaccttccaagtcaaggtctcgccaagctccaccgcctgcctgcacaacggcaacgcagaaggcgaaagttgatgccgccgaaaacaagg

SEQ ID NO: 80479 - DNA, 4277 bp, Oryza sativa
cgaactcggtaaaccgcttgtcaagcctgagcagctaaagtccctactgacacatatgtaccgattccatgaacagtaaatggaaatgattgccaacggtagagaggtgatcggaacgaggatcagaacgtccaacttcctgcaaggagaagatgttctctggatcccgttcgacatctctcttctaagcgcatggattttgtaagtattgttgagttagatttattacactccttaattagctctttgtatatatgtacaccataataattcattttctcattgtagaattgagattcaaagggcccgatggcggggggatttcgatactggattcatcgaccctcggaaagttaacatcgaaatgatcatgtatccgaaaaacacagaggacactcttgtccatctcctgaaggagcagcatttcaagacattcatactactgccgtacaacacagagttagtttttactatcttccgaacaaatttcgttcccgtacatacatgtatagtttcatatatcatctcacgcaaattgcatattccaccgggtccttttacttttcgacttggaggctagcagagtcaatgtctatgactcaatgaataaagatgagtctacttttgaccaagtttttgaacttatagacaggtgatatcatctgttccactgttattacgaattttgctattgctactatggggatctcgaatagtaattaatcatagcttgaaactccatgtagggcttaggatcagttccgtcaattggtctgcggttcttggaaagaaaaacttagccggaggttcaattttccagtgagtacatgctccaaaattatatcgaatctctaattcaaatataagtgtttattaaatctctcgtcgtttgctatgtatattgtgcaaagcagagccagggaactaacttgtgcggctactacgtatgcgagtatgcccactgcctttcaacccaaatctacaccacaagagagcccgatgtacgtataaaccattcaaaatttcattgcgtactatcgatttcttgtttattaattaatttcatacattcataggttattcacatgagagacaacctaacacacaaggaatttatcgcggctgttcaagaacaactgatgggattcatcaatgaacaagtccttgatcccgagggtgaattctactacgacagatcagcaattcataagatcattccttcttcttctgagataacaccgatgtcgaagccgtagctagagcacgtaatgaattgtaatacatgtctatatttatatatgtacacatttactttagcgtaaatatatattttggtcatatatgcacattgtcgacgtttgatgtcgcgattccggtatttgcatagtatggggatcgttggtactaggatatatgcgagattgtagtaaaagagatggagacgcggatttttatacaagttcaggcccctgaattgtcaagtaataaccctacatcctgttggccaaagccggtcgttgctcctattcatcataatcacaccagtataatatttggggtagcctatctaactgtagtcgatatggcggtctgaaggtctgactcgtagtcgacaacagggtagccttcctcctcgaatccgcatccggcgagattagagacagcgctatatctctcctgacggtatccgtaggcaccgtaggggactagccgtgcctatctctgaagtcgatatccggcgtcttgtcttggcgtatgttggcttgtatgttgtggcttctgttgttccgtgtctcctctcctcctagggggtcttgtatttatactcataggtgtccccttgtccaagtagaactagggaaaccaatatggatacaatccgagtagtccttgtcgtttccatgtagaactctggttgtcttcccttatccggaactcctcctatatccgcaggttgtttccgtataggacatggtatgtggtgggtcctaccgagatttagtcaacaactattaggtatgtggtatccaaaaccctgatagtagcccccgacttcaatgcaaatgaacaaattcatattctcaaccgcagaccttggagtaactgttatcgagctcacgtgaccattctcggtgagttcagagataacgttagacttcccttatcagcctcatgtgggcacctatagggtttgtttgagtcaatctccgatgtcaaccaagaaagtacagagcatacaactaagtctcccgtcttgctgtaatcgagaatttggattgaagtcaagaaattttatctcggcgggtacaccatctcttcattccgtattccttgtcgagacccaccaaccgttctcgagtgatcgagaaagcgcagaatctgcgacggagccttgtcaacatttgtcgtactcgccttagccgatcttggtatagaaccatagagacatggagtcttcgataatgccaaatagaattttcctgaaatcaatactcagaaaagaatattagatagaaatagcccccgagtgaacgctcaaagggtgacatgttataatatgtatggaaaactgaaaataaattaaatttacaaaccaatgttttgtatatgagcgtcttctcttttaccgacttcgatcagtcagtttgttgagtcatacactctccctagcccccggccttgtcgtcggagaatcgttctcggaggataaggctcttggacccttgacctgccttggttgaaaaaagcactgaccctagcccccagccgtgaaggtggaaaactcaatttccgattacatggcttggttaatacacacggcgagaactattacatgaccaggtcttacatggtcgtttgtctctacctggcgcgccactgtcgatgggagatacccgtagaccggatatagagggtattagggtacgctggtacgaggatctacgtagtacgacatcaagcaaataggaaacaaggattatactggttcaggccccttgataggtaatagccctaatccagttgatattagattatatagtgaaaaccacagattataaagggaatagcagaactctatgataccgacgagaccgcagtcgagttggttcgattagatcaccccgatgactaggctcctgaaggctccgactttgtaggctgtggtggttgtgttggcggtgagattcgatgccttagatcctcccggggggtccctcttataccgcaggtcagttggtctccaagtagaactcggagacatcggaccctacacgatacagtgacgacccagttctatccgagtaggactccttccatctgtggactccatgatgaatttccttaacatgtacagagaacgtccgtatacgcgcaggtataccataccagtacatgacgtatatccaaggatagagggtataccttatccgtaaccctgacacacataaaatgttaagtgctttaaattatacgtgtctaatacatatatgtgtattttgtacatatacatatgcatttgcatatatattttttttgaaacataagacggtaggagatctaccggatatattagaagagaattgaccctgtttataaggaaaatagggcccgaaaaccgtacagctgcacagtttgctaaagggaaactggcaaaaccttacacaaaagacacaaaaaacctgtgacaaaacgactagacccacagaagtgatccagagaagagcaaggccttcaaggcgtagcctccaaggaggtgaacaatgacagaagccgctgccaacgcccgcccaaaactggactgggttttcacccgaagtggagagagtccacaaggcaacacctccaatgaggaaacgacacccataggcatcgatgtcaccgatcctagaagaccaggcagggctgtcgcccaagactccctcaagaagtacaggacctctaagaagctagagcaagagtgttgagtgttatcgttgcctagctcatcggctgaacccgatgacagctccaactccactttaacacaaaaactctaacaccgtagggggtaagcacatcgctccacactcggcacaactacaggtttacatagccacagggcacgtgaagcatcggcgaggcccaagcgcccttactaccaacagactagaccaccaacacggacgaaaaaaactcaaccaccaaaagactccacggccggtctgggagcaggcgaccaagagaagggaggagcatcaaggaggggaggaggcctggccggtctgaaggtgaaactg

SEQ ID NO: 80480 - DNA, 1905 bp, Oryza sativa
ctgcttgtgccgagacggtagaaagaggaagaaagagtagggaaggaaggagataacatggtggctgccagcgactggagcggtcggagtcgccgacgcgaccccccggcaggacccaatcccaccgactgacggagacagccggcgcagctgtaggcaggccatgcgccgccccggacgccgacctgccgcgagcgccagccaccgccggccaccccgcgggccgccaccaccacgctgccccgcgccgcaacaacctccgccgcctaatcgcctccacatcgtgcctcccgacgtcgccgtcgtaggtccggtgacggcggggccagatctgccgccgcccagcctgggagaccccgtcgtcgccgacgaacaccgccccccccccccccccccgcccgcgcgcagaggagaggcgtcaccgcgagaaggtcccaccgcaaccgtcctagctcgtcagccagttttgccggcggcaaggtgaggtagagggggagaaggaaggcggcggtggcggctagtgtttcgccccccgtgtcacctgcgcgggggcgacgagcttcctccgaaaatttcagtatatatcctatttgcatatatagatatatatgtatatatatgtatatatatatatatatatatgtatatatatgtatatatatatatatatatatatatatatgaaaatgaatctgtacacccaggtgtttgtactcccgctctaatccaccgtccatcaaaggtaagcaccgatcattccatcccaccctcctaccaggtctttatattaaacccgtttgatccttttctttttgaaaagaaattctattaattctgaattatcccggccggttatgcatatatatatgtttgcataagaaaagaacggtttgttttttttcttgggccaccgtacgtttcacatcaaggcccatagaagagtccatctccaccttgaccagccactacacagtccacctctctcttccacttgaccgaggccgttcccaccctccaccgtaccgatctctccacctccccctcctccgtaccgatctctccacctccggaccgagtatcgagtgttttccctatatcatatatttgttgtatcggatttgagatgtttttataaaaactgaacctacatgatatgagcaatccttttttgaggtgatccaatattagttttgttctttgcatttgagtccctgtaatattcatatttacatttgagtccttgttcgaggttagtggttcagttcttgttgaaaaaaaaagtaaaaaaataaaaaagaaagaaaaggcagaaaggtgcaaagaaaaagaaagaaaaaaaaagccgcacctaaaaagaaaagaaaaaaaattgcagaaacgtgcttaaagaaaagccgcaccaagaaagaaaaaaaaccattcatcctttgagtatgttttcagagtgcagagttgtgcattgattcatatctagtccttagtgttgtcgggtgcttgcttgagcaagagttgagtctagactaggccaacacattgactagtactttgaactattattcaactttgcattttctgattagcacatttgcgttcctttgctactatatattgtgccttccaagctacacatatatacttctggtcagcaccgctttgatccttgcaatcgccacatcatgtccttcatggtgtcacgaaccaaccaccgattgtaccgtccttagcattgctggtaagatacttgtaagagcttggtaaggtgctccatttggctaagttgttgaggggcaccactacaccgcgtagcagattattagggataacctttattgtttgctgttgtttttgtgtttgcaatgacaggtatgagtggcgctcaaaatcagcgataccaacaaggtgcac

SEQ ID NO: 80481 - DNA, 43254 bp, Oryza sativa
attgctgcttacgccgagtaacacagcaaactcgagtccaagtgcaggtgcattcatttactcatctaccaaagagaagatcaagcgagaaagaagcaacacttggttcctggtcggtgcggcattccgtcgagcagatagcgagctttagttgcttaccagataacaacagctgctgcggccgtggggatcccctgcagccctgctccggcgatcgccgcagcagcagggcgggcgggatgatgcagcgcgctccaagcctccagctgccaatttcctcctcgtcctcgaggaggaggaagaggaagtggaagtggagccgacgatgaggaaagcggcagattcccctcccctgcaaggaaggattagcaaggggcaggaggagacgtggagggaaagtggaagccacgtggacgcggtgcgggcccacgtggctcgccagctcacgacgcgtatcggctacgccaccacacgcttcgatcctcgccgtcgatctgttcgagcaacgaacggcgatgggcgcatccccgcttgaacccggggcggcgcgtcgccgccccgccgcccgccgccgcgacgacgcggcgatgcgccacccagtgcatgtcgccggggctcctggtggctcgcgcgcgcggcccgatgcgccgccgagacctgcggggccggccacccggtgcgccgcggcgagaccggcttctagccccgcccgacgccgcgacgccacgcgccgctccaccgcgcggggccggcccaatgcgccgcgagaccggctgctagacaccgcccgacgcctcgacgcgacgcgccgctccaccgcggggccacgcccgacgctcagcctcgccgccggccgcccatcccggccaggccaggcccttccgcgccgacgagtcaagaggaagatttggggatttgggggagagagtaacggtggtggtggtgatggtatcggccgaatgttgatgggcctgtagcttgctaacttgggtttcaccggcccattcggctcaaccctggcaaattctaagtttctacttggatgagaaagctttatctctctgataataatcataatcataaaatcatgcgatttcaacgccaaaccaacatcgaacgaaaaaaacgccggaacctacactgccgagtcagattcaacattttacgtggactaattgatccccttacataggaatatttgaaaagacactcgaatgtaacatttcaaaagaacaatgcaaacattatctgaaaaaaaaaagaacaatgaagttagacgaggggaggcgaggtcgaagctgaggaagatcggtgctcgacaggccacggatactacaaacagcaatatagcatgtcaagcaagaccagttaagacaaaatcaaggggtttgcacccaagcaaccttcacaggacggtgaaaggaatcagcatttttcctaaaccaattgttttgctcttacaagatgtacggcctgatggttacataatctattcccagaatgttacacgacgcacaacaaaaaagaatgccgaaggaagcgatactctaaggaatggcaggatctgacgaaaactgcagtacagagttaaggtgcaacaagttttcaccccgggtctataagagacccaatttgaagatgtcgccaggaatctctcccacggctttcaaaatttcggtgtcagctctccaagttggatagctcatttcaagataggatgcaattacatcagatgatgtgcatgcctgtaatatctattgatgtactttgcctgcaatacagtagatacaggagttaaagccaagacaactatatgcataatcaactgttccaagatacacctgagctgcaatgtcacatacctttacgttgcttacatcaggggtgtctggagtttttacaggataaaatttgtaaaatttgatattttcaaatgcctctttgaccttagggtccatatcatcaatagctttctttcttgcttccttagcctgcataagatttggagaaacagttagtacttgaatgcattaaagtatctggtgaaggcaattaacatttcgtttgactatgacctgttttagctctcttttcctttctctaaccctctcctttatgaattcctgttaaaagaaatgtgtcagcagttaggaaggagtactcagtgaggtaattattatagactgactattcttctgacagcttaagcaaaaaattaagatgcaccttaaatttttctttctcatcctctggtagcacctcatctttaactttctcatcagcaaagtcctgcattgcaacagaatgactcaatgcaggtgcctttcataggaagcatcaagcaaaacaaccaaattagtacaaacctcgtaatcatccatctcccagtcgaagtcacatactatctgcaataagcagtacaatgtgaatacaaaataatttgatgactgctacgttatcaacattggaggcatctaggtgaacataagcaatacaagtaaatctaataaatatcaacattggaggcatctacgtgaacataataacttcagtgtttatatcagctaagaaccaagtgactcaggctacattatcgcttcagaacaatgaaatgtttgtatcaatagcaggaaataaacactgcaactaagcttccatccagtgactcaatagtgatcctgtttggttcgaggaatgaaatgggtttgtccatcacctcattcctcaaaagcaaatgctaagctattggatgaggaatggagccattcctcagattttgtgggatgatcctatgatggatcgtcctgtccaagatggttttcatgtggtgattcctcaaaccaaaacaacctgtaagtgaccagcctgaaagatcaagactgacatgattgcacaactgcctaccggtcaaacttgagtgtaggtggcatgaaaacaccacatgtacacctatgcaattatgctgacagactaagcaatgccataacgccagcccagcaagcagcaattattcgatttagagggaaacaatcagtacgtctatgcaacagcaattaagagggaatttataagcatgtggcagcagttaggaaataatcatcctggagcagcaatcgtagaggaaaacaatcagcacacagaagcaattaaagatgaaaatagtccgcatgcagaggcaactagaagcacacataaataaaccaaaataggaaatattttttcagattaatgaagcataaagaagtacacatctcctgactcaacagacacaagacaccaaacttcagaagcatccaactgaaaatagtgagggtgacaacaatacaacattgcaggagtgctagtgcgagaaatgacagcagcaaaagtcacgatttcatagaagtaggcaaggggaaccagcagcatgtgggttggttttgacctcacaagctaaggcaaatgaagcaccacagacaaaagaacacaaattcataactggcaatcatgacatggatgcaagcagcctagagatgcatacaaataagagaagatcaattcttagctgcaggaaacagtgaaacacgataaattttatcttctcacataggccaggtgcccaggttaacaatgcagtttatagcagtggagaagatacagctgcatctgggctcttccctaaaatgactagctgacttaatgaatcccaaatataggcctaattaagatcacaatccaagaaatttattttagttttgcccattacacataatattttaggtttgcactaataagatacctccataaaataaactaatagcttatgttgaggaaaatttattaggcaatactggaataacaaaaaacactaagagaagattaccgggggttctaggggatatatgatgttgacaactgtatcatcttcgtcttcgggagggttcagtggcatataatctgcaacaacattaaacgagattcatttgcagactacatcactctcagccattttcataaaacactctgcatcatataagtgtaacaatgtaaataaaatgatctgatcaaccagttgagcatgattgttgaccttgcgccatgctcacacactttataacaagacttacacagtgtgcctatgtttgtgccacaattgctaacattaaaggaacaaacaacactgaaaactggctcactacagacaatgttacatagctggaaagaagtgccttcctaagttaacacaggatatgtaaatggcatcaaattattatattaaaattaagtactaaccatccaacgcaggcaaataagccagctaaaaagcttatcaaagtcaaaaggcatggcagcaatagcatgtaaatatatctagcgttcacccattccaatgaaattaacaaattgtcatacagaaacagaatggaaatgaattaaagaatgactagtaaaaagcttcttatcccatggcatactgacattgcaaccatttaactaagacatcatcgatgtcttgcaggatattttgcaattggactggaccaagccaaggaaccacactcaagttaacaggcactcaaagaatcctatgaaaacagatatttgtacacacaaaacaggccaacagaaataatcccaagtcagcttacatggcatgcagtagtcaaacaatttgactctctcagttttgaggtgcctcagcgcagacctgcaaaacatacaaatgaggatactctagaattagtcagaaaaaaatctagggaaagatgttaacagtgaatttatgttgcatgcttctggatgataacgttccaacaaacaaacaaaaataaaatagaaccagaaatgccataaagcattaatcgcgagtaaggagggaaaaagcatgaattactaacctccgctgggtgcagccaagagtaaatatttttgttttcaaactgtcaatcctactaagcctgtagaccaacaaaaaagaatgagtaaaacacaaagctgcatatgatgattggtaaaaacagaagccattaatgagggagcaaggtaaggatacaggttctcaaaagaaatggtaagaaatattgttcagaattaatagtatgggagtaccgatcctccagcggaacataaggcacccaggccatcttcatggccttcattggcactatctcttcattttccctttggacagaatttatgccaattttgtctgagggaggaaaagggcagtcaacctgcagcacagaaaaggtagcaagtgctaaatgagattcaacatgaggcaagtaaatagtaaaatcagtaatatataaacaagtcaactgccaatgacgttgtaaccataaagtatccaaacaatgttttccaaattgcactgtatactcaattttaaagaggttagggttaaagagcaaacaaacaaattccagagtaaaatagtgtgataaaaaaaaaagggggcattgggtaggccattactgcagtgttctaggctatgctgtgctgccctgcccagccctgcggcacagcgtatttggctgctgcaggaagcagccgcttactgctggcaggctgcagcacctgtagctgctggctggctagctgcagctagctcttccaaacagcgccaaggaaattagtcccattggcttttatgaaactaaggtgactatgtttgtactggcatctttcaaaaatgacagaggtaggaagtacaaacatagtcaccttagtaaaatcaacttgttagcgatggtgcataaacgggataagatgttgagttggcataagcatgagataaatgttcagatttaagagtatttgctaaagtggactgtttcctcatgcaaatttccatatcaagagaatggaagcgaacttacagcaacaactataggaataagcactatctttgattcaccattaacctccaatagttgagctgcatgtcagcaaaaacaatttaatcagataaactgtatcgatgattattaaacaatctggcacatcccaagaacaaatgaaaatatcagagacaagaaaacatttttccacgacaacacccaacatatctaaagtgcacatggtaaaacaaataaatgctgataccaatcaacttaggaaaggcagtagcaactcgaacattgacatggaaaaacagcataagaaataaatagaagtatggtcctaaaggggacaatttcattgttggaaatgtccagagaatctttcagtaatgacaaaaacatgcaagtgtatatctacaacaatgtgcatctaagttcagagaaatatataattttctcagggtgctactgcagtcataattagtgaatttcaggggaacaaacaaactgatagatttgatatttaggcctgtcaggaacgtcaaaaaagaaaaataacatggttcttgtgggaataactatttctgtgaaattaaaccattcaaaacaggccttcaagttatatgtcataaagtacacaaaaaaacaagctaatataatcagtttagttcagttactaaatgctagcaagccagtaggagaatatatgtatcacgaactggagatttaattttaaaactagcacgagtatgaaaacttacgctccgtgcttccaaacaagtaaactgttttcccataaagctcccctccttcttctagtgctttctgctcaccaacaggaaaccttatgtcatgctgaaagcaagtgtgataataaaaaaagagtagtattggaatactatctgcccatcgtacctccaaattttcaaagttccagttgaactcctttatcttatcaatgttttcccactgcagatgagaggcccggatatggataatagttagcggagcaaatatccatagtacacagttgaaagtatgtcaaaacatgcatcactaattgactcagccataaataaaaaagaaagaaatagataggcccatagaaagtaacaaacctcggtcccaaccggaaatgctgatagccaaagatcctcctgaacacagtaacacaatattagccataaaactataagtaatcattttgcctgtttgcaaagacaaactgattatgctcaaacgttccttttatatccatcaaacacatttccaaacaattaattgccctagaactgcttaaataaacccatgtgagttttcattgttccaataatagctcaaacttcacgataacaaattcaagtaatcgtttcatatagcaaagcacttcacaataaaaaaactattcctaacactgacttagaagaacataaactgtacaattcagtcccacgcagatgtggctcaaactctacaacataacattcaacacaaaaactattcctaatgaaatggggagcccctatagtccagccaaatccagtcacatattaaccattcgtatttcaacatcaaccaccattaccatcatttggactaatccgaccactacgaatctcgccgcagaagcagcaaccaaatacaccacgcggtccacaacgccaaaacgaatccagaccaatcaaaccccccaacctaatcggggcataacgaagcgaagcgaagcacgcatccgagacaggtaatcggggaagcctcctcctcaccagattccgcttctcggggaagtactccgtctccggcttgggcttgggtgacgccttggcacgcttcccccgcccccgcgcggccggcttcttcgcctctgcagcctccggcttgctggagtcctcctccgccaccgccgccgccgccgccgcacgcttcctgcctctcggacgcgccatcttctccctctctctcgattgctagggctagggtttcagcagccgtttcgattggggatcagtatttatgcgttcgaggggtgggggtgtgtgcgatttgggggaatcggcgcgtgaaatcgacgcgatccaaatttgaagcggggttggagaaggggactgcgtggggtgggggcgggggaggaggaaaatggtgggcggcgcgggccgcgtgcgtggctgtcttgagggcttcgaggaccgtccgatccgttttggaagatggttctgagccgtcggatttcagggtaggtgtgatggtccagagagggcgagatggtcgacgaccagtgtgggccccgtggggaagtggaaagcaaaacaaaattgctagtgccatgacatgtgggaccaccaggctcgttcaaaacgtggatgcctccatgggccgtgttgggctgtcgggcctctgcatgaactactgcacattatattatgagagtacctatacatctttcgaaagatttttataatcgtatcacacagatttttaatctttgtattaaaatccgatagatataataaaaagaaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcaaatgagatatagcaaaatcgttatattattacttttgggcttacagtaatacagtactaactactagtagcagtttatatctaaaaggaaaaagtacactttgactccctcaactatcgcctgagtatcattcataacctccaaccacaaaaccgggaatatcgaatcctccaactatcgaaaccggtgcaaacaatgtccctcggtggttttagaggtggttttgtctgacgtgacgcccacgtggcagtcttgaccgattctttgtcctatgtggcgcttacgtggcattagaataaaaacaaaataaaaaaaatatgtgggacccatatatcattcacacaaaaaaaaagtgttgtgggaccactaacatgtgggacccacatgtcatcctccctctccttcctttcttcctctcccctctctctcccttatttctctctcctctcggcctttctcttggccggagcggcggcatggacggcgatggggagcggcagcggcggcggtgggaacggcggcggcggcggtcggaatacgcccagaacctgttccccatgagtccacgacggtagaccacgcatatgcatcgctgggctatataaaggaccttagctagctcaccaactcgaacctggtgttagctttggttagttcgtttcgttcgtgtaggaggagagaatatcttcaagggcttctcgtctcgtctcgtgaaatcctcatggaggtacagtgcagccccatgtttctcttccccatctccatgctggctctccccgccggagcgctcgtcggcgtccccggtgccacgttcgtcgccatggtggcgccgggcggtggtgcttgtgcgatgacgacgaccgcgaggcgcatggtgctggccgcggcgcccagcgtcgcgctgcaccagggcggtggtggggggccggccggcgcatgccttcgccgcggcatcgtctgcttcaaggcgggcgacactccgtcatctggagacgacgaggctaagttatatatccaatccaccggccaccgcgctctttgtctttttcttttgcgcgatcaatgtcatcgacgatgtgtggggtgtgcgttcttggattgttcggcgcctagccaagaatttttctgccttggcgagggcgaaggtggacggctcggggctaaagccggtgcggcggtaggcgaagcggaagaactagagggcgaggtcggcgcagccggcggcggctgccccggagatgacgccatggacgagcggcgcggcgagcatcgaggagagcaggcggatggagttctcgaggcggcaagcctcgtccccaccgcaatcgccgccgctcacgaccaccgccccgtcgctccccaccgccgtcgtcccgaccgctccccgtcgccaccaccaccggctccgccgccgccgctccccaccacctcgtcccgaccaccgccgctgccacttcgtgccacccccgccgccgcgctagccagtcgtcggcgactccgacccccccaccggggcggctcccctctcgtacccctccctccctcccgacggccgcgggctatagccgtcacctccaccgtgcgttccccaccgtcactgccgccaccgccgccgctcctgaagtgagagagataagggagggagagagagggaggatgacatgtgggtcccacatgaatagtgggtcccacttttttttaatgacatatgggtcctacatattttttatttttgtttttattctaatgccacgtaagcgccacgtaggacaaaaactcggtcaagactgccacgtgggcgccacgtcagccaaaaccactgagggacattgtttgcaccgtttttgatagttggaggagtcgatatacccggttttatggtttgaggttatgaatcatactcggacgatagttgagggagtcaaagtatactttttcctatctaaaaatgttgagtaagacttcgggcctattcagattgatggcattttcaaccataccattatttagtaaaattgataattatgtggctatgtttagtttgttaccaaatattggtaatgcatatagaattttggcaacattattaagccaatcctacaaaaaatttggcaatgttgccaattcgccaaaatttggtaaggttcattttagcatcaatccgaatagccacttcatatctacaccattagcagtttaaaagccaatagccaatgctaaaagtgcactatgataaaaagaaccaaaatcaaatcaaaaattaacttttgaaatctaaattttggctaatgagacatggaagcaccaatagatattgaaagaaaaactattgatcggtattattgctgtagttatttgttcctttcgtcgatgaaagtacaaccacccattttccacactttttcatattgacttaagtcagcgaattactcgcggcgaggaggagtttagctttgagagttggaaaggaaatagggcggtgggtaaggcctatttcaaaattttattggtgggtggtactatatgtgtgactgaggtccatcaaaactgtaggtgcattcgtctaaagggtagacccttgaattcactttgcctgctttcggcaattgcattcaactttacctgtctgtggggctttgactatggtgactcctcctttgactctaacatccgctgggtactttactttactttgcaggggaagatcatatagatatcaactcatcgacgaagtcctaggggctccctggccggggaggtaaaggggattgctatcatacatgataagctaaaatcgattatgttttgcttatcatatgatatgatatgagaggctaatattgattatgttttgctaagcatgtctaaagttagagttgttgttgtaatgtacatgcatctggtcatttttatttgatgcaactaaacttaactactcaactcttttgacgtaaggtaaagaataccaggaggaagtatttttgaaacactatctttcaaagcacaatgttgttgcccctcccttggaacattttgaatttaaagatgtgtgcaagctgaaaactaggtggataggaaaatgatattatcacaacaaatcaaaataattgcctgggtaggttagtcacctgaataacttgaagggtgtcaacgtttagctacacattgtccatgttgttctacgggtaccaattggttagtaaaaaaaactttaaataaatgactctaagatgaataaataaataacgtgaacttgcaaccaattatcaaaagtgggagttgggctagtaatcaatactttcactacacgtactttttacaagcataaacaaaaagcgcaaaaataagatatatccaaatttctaaccttcgatccgcaacgaagttttattctaaaaaagcgcggggacttcaacaatgatcctagctacttcaaggcgagcatcttctctcaagcaccatggtttgtatttaggtttagatctagagtcactctatctcgatactattagaagacctcacttttttgggaggaagggtggttggtggaggaccggcgatgagtggcggtgctttgcccatagagtcgagggatggaagcaagggcaacacgagcaagagatctagaaggaggcaggaaacaacaacggatctagtagtggcaaccatcatatacaaggaaggagagcaagacaagctctaggcggcgggttcgggacaaggaagggaatagctagggtttggaagggaagtgattatatatgagttatatgcggcacaagatccattagagccttatttggtgggcctcaatcccagcccattcacaccgcggactaaaaattttagcatccaagtagcccaaatgagatatcataatatttattttgtaaagctagcatttaaaagatgggtacacaagcccgattaaaaaaattagtctactataatgttggggaattggaaggttcaataagaaaaagaaaacttaaacaaagaatactctattggaaggatcaacatccaaataaaatgaaatgaatcattgagtttgcttgaagtgcttctaagagaaaacatggatattagtcgccatataaaggtgtactgtgatccttcacaaacacataactattacaagaaaagccccattggcctctgccttatcatagttggtctaggtcagggtcaatccttgcgcacatgactttcccaacaaagctagaacattgacaaccaatcatcaatttttttactcactaacatgtaaaaatagaatataacacattgataatgttgctaaaagcaatcaacaattaagtatgaggatacatgttaatccacataatctcaaccttagatggaagagcaagagaagaagatagaggaacggggaggggtgtgtggggaaggaggtacttcatctatcgtcgggtggtagcaaaaaaaaagtgagaccctacatcccactttgttgacatgccaatggcaacctacgaggattgttggatccatgctactgccaatgttgaaatatcacaaaactatggtggtttcgggaaagttggactataaaaaatcctatacatagctaatttaataacgtgttattgcactcgatatcttcgactaatttgctatacatatgacgtggatattttttgatctgactaccggtgctactagtattgctctaaacccgcttcacgcagcctttgaattaaaagagtgtacagaacttgggttatgccaataacatgtttttttaacacgcaggagatctgcgtatcattccactaagacatagaagaaaatgtatatggtgttagagaaagactcgacactcgcccactaaggatacaacagaacaccacacaaccaatggaaaaaaaataaactattgcattagcagcacagtcatagtaaagataccacggagcctagcagctcttactagacaccgaagagcgtcctcgttagcgatggtggctcaatgtacattggccaagcatgaggtacgtcgataacatattttaaaactactgtaataagtattggactctatgttatatgaacatggttaatgatggaaaaatttcctatactatttttactagtaatatgcccgtgctaaatgctacggtgcaattcgatttgtctttaataattgttaaaatttcatgttagcggaaatttttttgtatgatatgtgcatttgaactttaattcaattcatgtcgtacattaaatatatttatttaacgtaaaatataataatatgatactgcatgggcacaataaatctttacaagaattaagtatatataatcacttcagtatatagtacgctattatgttaaaaaagtgagttatttcattatttgttgcgggaacaaaataaagcattatttgcgatctggaggaggtgcaggagagaggctgcagtggttggcgatttgacggaggggaaaggaaaccgatcggtgaccgcgtgtgcgattatttgtgatccctaatacattgcaggggaaatctgttctgtgctgcctactcaaaggcagaattttctaagccaatctcattgtcatccaaagtactactgccaatgaactgacaaaagaattgacaaaagaattgatgaaccaaagcagtgacatacttctagacaaacaacttgggcaaactgagagagctcccatggttatagcatatggaaactgatcctacaataaagaaaataatttacactataatataagaaaccaacttttctgctacttgaagtttagaaactgaacttgaggtgatgtgtttagaaactgaacttgaaaccacggttcttgtttgatccacctgaacatctcacggttatccataagtacaaggcaaatatgagtagatggctaattcgctatggagcaaaataatactggaagactggaggttaccttctgttgtttgtatgtaatgaaatatgtgacacagaagacctcaagaaaagtttctatgtacggataagggctatggcttataaacatgttcatgttttttttccggtttgtaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggatagacggcggagatgagacgaacatgggtagatgcatggcaacctacggagtggcggcagttagggttgggagatgccgccgtgatgtggtggtggcggtgcgtgtggcagcgccggttggtagtggccacggaggagatcggcgtggtgtcactggtgttgtcctcgatggtcggtggcggcacggagatgtcgagggtaggcttcagcggcgccggtgtggtcccccgaggtggatgttgccggatgttgtatcaataatccctaatcctatacagcaaaataagaaaatcaggaggaagattacggtggtgcaatgtttcatgaagcttattgcactttgcttaaaaatgaaccatcttggtacagaattagtcaaaagcttactgaagtcataagttcaccttgaccaaatctgtcaagaatccagaaacagttggattgtcctaacatatgcatggagatggtgatttcattaatcaaggaatgaatctctactatactgataattgatatagatggtgcatcatcttaaatattctgtcactgccagtgaaaatcgaattttaaggtttgatttctgaaatgtgtaaaatcttaaataaccagatactatatattgttctttggagatgtttagacatgtgcagacagttatgcgttgttcatagacatggatactttagttatcattatctaaaaacatgaattctttagataccaaagcgatgctttcggtttttttcttttgattgattctggattatattaagaaccgtatgatcaaatcagcggcgactgatggggagagaggaaatatatataatactgcattgtggattaaaaaaaaggggaggaaggatgattactgtaccttaatttcggcgaatcagatcgaggatgtggtgacactgttctgaaagcagagatcggtggttgcacggagacggtcgacgagccggagattgggggcggcacggaggagaccggcgaggcggagttcctggtggagatcgggggcggtgcggaggagaccggcgagaagggcgatgaatggcggagtggcgagtggaggagacaactggcggggtgggagggcgggtacggtgtgcggcgcgcgacggcggagtgggcgatgcggtctggacggcgggtgggggcgcgagcgccgggagatgacgggggcggcgacgtgcataggcgcgatgggcgagagaactggcggaggagatggatttcgcgatcagaaggaaagtgcgactatttccgaggcgcaggggtgtgggaaggcggatgctattctagacgtcagatctcttagggataatctgaaccgttaagtgataaataaaagaataagtgaaagtatttcttgaactataccctaataacttactaatagcacaatctcacaatgattccttttaaaaaaatgcgataagaaaaggacacccctccgcacctcgtcgttctccatccccaaccccgagtgcagacgaaaccagcctgaccgatttcccaaaaaaaaaaaacaaaaaggaaatcagcctgaacgccggcggcgctcccgccgcgctcgagctctgctcctccgatggtgaccagatggagcgagaagggccccggcctcaagatcctgtggatctggaccctgggaaccgctggaagtaagcaatcccgccatattcctcaactctcgtctctccaatcgcacatagtaccacagactgcactctgatctgatgaattttcgtccgcagttatgattaccaatgtcgtccggacgcgcgtcaatgatatgcagaagatcctccaggaggaagacgaagcagcagcagccgccgcccccatggcctccggcgagcgtgtcctgaaagacgatgagtagaacaggtatttttctcccccattggtcgattgaactgtgttgtgtatcattcctgcaccgttaagttcagtattcaagaatcatgttataggatttgcttttctcgtgcggtgattgtgaagctcaactgtgaatctgggttcattcggctcctaattcgcagctgaaaccgaaaaaatactgacataattgattttaagaagttttgcttatgctaatacgggaagagttctgtcaggtcagagctccgattctggacaattacataaaccctgattcctatatggtaaaataatggcattcattttggtaggcactatctagttctgtttcagcagtatactgctataaagtctaaacagaatgaggcattatccagttttgtttcagctgttgtactggactactggtaaaactgcaatgtggaccgatgaaatttctacatatttctctccctctatggctgaatcttcattgacttttttgtgaaacaccaaccattggtcacatattatggcttgtcgttgggaattaccaggggcgtagccagctaggtggcaccgtggtccacggaccacctaaaaaattaaaattatagtatatgtgctagttaatataataaaaattgtatagtggaccacccttttaattgacatattatatatagatggaccacttttactttaaatcctagctacgccactgggaattacaccagggcaatctatctccagagcatttatccatgctgctccatttcattaggctgtataaatggcctttcaaagtgcactctggaatcacctcaaacatgaagagcccttttttctactcttgaagcctgagcaccaatttaacgaggatattttttctgctgcggacaactgttgatagtagatagggagtggggtttaattggatggttgtaagcatgggcgtgcctccaaaatcatggctaaattatcttacatcaccatgtaaatttaagaaaaaaaataaacaactcactagttaagcactattttagccctactcttcaataatttctagctccgccactagttgtaagtaatacctttttttgttaagattgcgtgaagagtagcatgtgaaattgtgaatgggcaaacattttgagagctttcagagtgtttatgtttatgctgtctggtccactgatcctcttcgttttattctttatctactcccacgtagacatgtagttcatccaactcccatcccctgcccaccaggtgctaactcgattggtgcattttcaagttattagttatacaacatgtaactggtaagtctgctacatatagtgtaggtaattctggcaacaatcactttgttgttgcaaaacaatgtacactacctgctttaacatgacagttatcagagtgttttactttgaaactgcacatatggcaagggcagccaacatgctgctcaacagtccacgttcgattctccccgaacgtgctcaccttttttctttcattgacactaagctcctccttagtgcccatgtttttttaatgtgttttacttttatacagccgcagatgtcataggcccatcttttcgatttttttttgtttgggtctgtgtgtgtataactttgattcatacagccaaaaagtgttacttgctgtaagttgtagcttgcatcagcttaggtttgagctgtgtaaggcaaatatattttacctttatgataagtatgttgtcaggtgtaccttttgtctagtgtcactttggccagataagacttaaaagagattttggggcttcaaaacttggggttgatctagtggaattattttatcttttaaatctttttaatttttaattttaaaataaatcctttcaaaaattatttccagaatctgaaccttttagccaaaccagccgcctggcgtggcagttatttggccacgccggtctagctaggcaacgttatttggttacactggctgcaggtggtgtgtcagtgatgtttttctacaccaagcgtgctggcgtgaccaaaagatttagattctggaaataagttttgaaagggttcatttttaaaattaaaaagttcaaaaaataaaattaagaaattgatctagtgttagtttctggatggaatagtatattagtatgggcagtaaatttttgtgcatcttcagcagcttaactgaaactctttttttttctcttcttattttgcagaacgtctctacttatcaaaattccctgaaccccgctgttgtgccaagctgagttaggtattgtttatctggttcgtcttagtggattttactggtaaaacagctacttgcttgagcggaagtatggaattacttgattcaaaatactgggtcgtctaccatctcatttagaactttttagatcttcatacagtgaattttctgttggctagaaagaaggtgatcgaacatcttcaggcatagctataactgagaatcctgagggtgcagcaatgagaacatgcagtgttcctcaaacatccagctggtaaaataacctactgctgcttctgtgtcgattactccctccgtcccataaaaaatcaacctcgtaccggatgtgacacatcctaggactacgaatctggacatatctctatccagattcattatactagaatatgtcacatccggtactagatttgttttttttgggacggagggagtacttctttgcaatatcctaggagtggtacccctccgttcaaaaaaaaaaagacaaaccttgggttttcgtgtccaacggttgactgtctgtcttatatgaattttttttataactaatatttttattgttgttagatgataaaacatgattaatactttatgcgtgacttgtctttttaatttttttaatattttttttcaaataagatgtatggtcaaacgttgtatacggaaactcgggatttgtcttttttttttttttgggacggagggagtaactggcaagtataggcggcaatggcagctatatgacatatcgacaggtcgagcattcagacactcctaggaacacgatgaaatgagaaatactacagtactagttttgaagagaatttgggagaggctatcgcgttgcaagaagggcatgcgtgtcctgtgattgccgtgtacatgaactagtagcttcgaagccttcgatcagcatcttttcctagctcgctcgttcgcgctggcagcgtgccgctgcagcattgcctcttggctctttgagcggtcgaagcgatgggcatgcgggatgtaggatgggccgcttcgtggttctgacagggacgcgcaacggcgggcaaatccggcgtgcgaatggcagggatacgcgcggaccgacgttcgccacctttacccgcgaccaaacgttagttcaagcctttttttttcctctcgatttcaaaaggccagttcatttttctaagggaaattttaaaaaccaccccataaatcacttgaaatttggtattatacctcataggtcattttgttgtaaatactaatcccctatttaattttactgcaaaacccatcccagccaagacgtcgttttacggaatcaacatgtttcataaattatgagctattgatgtggtctttaccaaaattaagtatttctagagtatagtctggacacctttttttttttggaaaaatccacggatagaaatggtcgtactgagtttcgctatatccgtaaaaaagagttcaacacaaacactagtttagcatatggtagctctacatcaatgataacagactgatttcgttaagcatgtgtatactgagcttttttacaataaactagttaggagatgatcatttgcaacaaagtaacttttcggttaggttttacagtttttctaaatgaaacgtgatttggactttcgacttattttgattgcggcaccaccatccaccgaaaagcatccgtcgcacgacttgtggcaggctgccatttaaataggattcgattcgcaactcgtgaagttgagtaatactccctccttccctaaatgattgacgccgttgacttttttaaatatgtttgaccgttcgtcttattcaaaaacttttgtaaaatgtgtaaaactatatgtatacataaaagtatatttaacaataaatcaaatgagaggaaaagaattaacaattatttaaattttttaaataagacgaacgatcaaatatttttaaaaaagtcaacgacgtcaaacattttgggatggaggtagtacttaatatgtcacataaaaaacgagtataggataggaggtgacacactagtactacggttttttttatgggacggagtcaggaggaatatatcgagtgctacggtacaggagcatacttccatgctcccaaacgtatcctgtgcgttgggttttaaatcaagggctcaaagtgagtaggtagtcgatactctctcgtcaatggagatgggcagcctcagccgccggacgccgccgcccgagataaaccgaccaaaataggagtagaagaagaacagcaaaaaaggaaaaaaaatgttgcaggtggaggaggcgctggcggccgtgctgtccgcggcggcggcgagcgcggcggcgcgcgccgccgaggccgtgccgctgcacgacgcgctcgggctcgtcctcgcggaggacgtccgcgcgcccgaccccctccctcccttccgcgcctccatcaaggtcaacaccttcctccccctctcttctgctccccctccttgccgccgcgcctgagggtgcttgggttgaaaccctctgcaggatgggtacgccgtcgtggcctccgacgggcccggggagtacccggtgattacggagtcgagggccggcgacgacgccctcggcgtggtcgtcacccccggcacggtggcgtatgtcacgaccggaggtgaggtggctcgctctgttccttccgatgatgcggcggtgatcggttactgaccgtggtttctcgggcagggccgattccggatggtgctgacgccgtcgtgcaagtggaggacacggagcagctcgccggcgcgccggatgggtcgaagagggttaggatattggtgcggccaactcaggggcaggatatacgcaatgtggtattgctaataggtttcgttgctttgcttaatgcttatccttacttgctttattccctcctacttgcgtttgtgcgacgatttgattgaaacaaaaaagctactatccatgctctgctcttctgctatgtcaattgcatcttaattcagtttaaattgttgatgtatttgagtggatttacttgtttatgtccttcagtggaagcaacattcttgtttgttattattgcgctattagctgtgtactgtagttctcaattactatgtacttctatagttcatgcagagcatttggtacagtattacttcatctggtaactgatgagttagttatttgaataaataatccatagggatgtgacatacaaaaggattcggtagtgctgaagtctagtgagcacataggtcctgcagaaattgggttacttgcaaccgtgggagtgactactgtcaaggtgaataagtctttcagttaccctgtcactgagtgcagaagagaatctcgcacaactgatcattttgagtatgaatctgcaggtatatcgtcgaccaaccattgctgtattttctacaggggatgaattagtggagccagccacagcatctctcagtcgtggtcaggttattcccactatttcacaatgtttgcatccctcacctttatctgcatttcatattcaccgaaatgtgtacttgctttgcagattcgtgattccaaccgggctatgttaattgctgctgctattcagcacaagtgcaaggtagttgacttgggtattgcaaaagacactgaggaaagtcttaaggagcatatggatgcagctctaagttctgatgctgatatcattcttacttctggtggtgtttccatgggcgatagggatcttgtcaaaccttgtttggcaagcatggggaaaattcactttgaaaaggtatcttggaaattcctccaaaattaggcgtgcaccatgcagttgtatggaagtacaaaccaggagttatgatatgcttttcttgtttccagctggataaccaattaaaacagttattgatggaaaattcttttagtctttggcactaatatatttgtacaattccagtaattctaacagtttgctgtgtttgcatgtacagattcggatgaaaccagggaaaccattaacatttgctgagatcgtaacagaagattcatcaaaaccatctaaaaaggttcttgcatttgggttgcctggaaacccagtgagttgtgttgtttgcttcaatctctttgttgttcctgcaatacgttcactctctggctggtcaaatcctcatctaccaaggtagttattgtcatgcataagtggttagcattgttattaagttctttattcccattatatatcattgagcatattgtcttcactgacatgactttctacagagtgcacgcacgtctactgcatcctttaagaggagacccacatcgtcaagagttccatcgtgcagtgatcagatgggtgcctgatgatggatctggtagacctgggtaagagctatattttaatatgatgccttatatttggcaatactgtaggtgataccggctgatgaaattggtcttggcagatatgttgctgaaagcacgggccaacaagctagtagccgcctcctaagtatgaaatctgcgaatgctttactggaagtaccattagtggggcagatgttggaggctggaacatctatgcaagctatacttatttctgatatgaccagttcaccttttgacaagctacccactgcttcaaatccgttgccatctcatttatttccttctgcaaaaagtgtttccacagatttgtctcaggttccagcctcacagaatactgaagttaaagtagcaattctgacagtgagcgacactgtttcattgggtgcaggccctgacaggaggtatttcattaagcgcctttttcctcgtgattgttgctgaaaagctgctgtacttttgcttgtgattgggttccagattgaatcagaaaagataatgaaccaatataaagtcttaccttttgaagtgcacgcatcctgatacacctctttgtgttgagttgcaaaggggtcacaccatgatgcaaaactaaagagtcgaattactgttttttcttcacataagatggtgatgcatctcagtaagggctccacatttcacaaggctgttattttttccatcggaacagtggatcaaccaaaagctttaattccttatgctgtcagcttagcatttttataaaacacatgtgactactttttcatgaatacttaaatcactgttgtttcttctctgtaatacaatatcatctgtagtgggccaagggcaatatctgtagtgaattcttcatcagagaaattgggtggagcgactgttgttgctactgctgttgttccagacgatgtggaaaaaatcaagaacattttggtgaagtggagtgacattgatcgtgtcagcctcatcttgacactaggtgaaaatgttttcattctttaagttagcaaattgcacaatccttatttttacagtgagatgagcatcaacttactttttataatggatatgcaggtggtactggtttcacacctagagatgtcacaccagaggcaacaaaatctgtcatagagaaagaagcacctggcctcacatatgtcatgcttcaggaaagtttgaaggtgatgactgacatttttctatatccccttgttctttggtttaacatggaaatccattatcatcaactttttctagagataagagataacaactaaccatgcatatgacactagggctaaactttagtggcatttcatttcaatagattttagtaccctaactttcctttaatctgagctattgaacttatctgtggtacaggtgacaccattcgcaatgctatctagagccactgcggggatcagaggatcaacacttgtacacaccatagctcaaacttggcaatttctcacctcactctgaaacgttcacatgtttatcaaacctgttgatatatcttttcagatcatcaacatgcccgggaacccgaacgccgttgcggagtgcatggaggcgcttcttccagcactgaaacacgccctgaagcagataaagggtgataagagggagaagcacccgcgccatgtccctcacgctgaagctgcgcctgtggaccagtgggatcggagtttccgagccgcgtcgtccggcaggggatgctcgtgcgagccatgatcggggccgatgagaatttggtcctcgcgggctatcggcgttcacttcgtcagcttgtcagttccttcgttagcccagccgcgttcagctcggagctaagcagtgacgattttggttctgctcactgttttgttttcacttcacccgaaccttacgaacaccagtgtgacaaataaagtggttacagtatatttgatcttgtaacttcggcccgtttagttaccaaaaactttttgcaaaagcattacattgaatttttgaacacaagcattaaatatagataaaaagaaaaattaattgcagataaaaagaaaaattaattgcacagttagcatataaatcgcgagacgaatcttttgagtctaattagtccatgactagctataagtgctatagtaacccaaatgtgttaatgatagcttaattaggcttaaaagattcgtctcgcggtttcaaggtgagttatgaaattagttttttcattcgtgtctgaaaacctttacgatatcaggtcaaacgtccgatataacatattttcatttcaccaactaaacaggcccttcaaacttttgtatacacggcacctgattttacagcgtcatagggtgggttctattgtggcgagttacttaaatttttttagtacagttcagctgcctaccacgctcgaatcataatgaagaacaacaatggagtagcggtaagcaagatggataggcgagccaaatagaataatacgaacaatctgcgtttcaagaaaaaaacataacagtaatcttcaaaactacaaaaataatcgcaagccagtacacacctactgggcgttggcgttgccaattttccacaatcaagatggaatacatgaaatcgaaaggtggtacatgtcatatttgcgtgggtcgctaggcctacaaaataattaagtacattgctctctgctaggctgctagcacagaagatttaatatcctctgtatgggcaaacctccagcttatctacactggtgatccgcgggcatcttgctaccgtgggaatgcgttgttcaatgaatcagtagaagatgcagcgatatgccacacatcgcctcacaaggatgtcgaggcatcttgaaatcaaaagtatcttctatcttcttttgactggagttctggatctggaacgcttcttcctgaaatgattagacacagatttaaagacaccaccaatataacacaaagtaacacagttactacacaagtggcatagggcagacagggttccagatttataggagttcacgcatttgcttcagtgtctaggattggaggcaggccagcatatcagctctgtcccaataaaacctgaattggtggcctctctgttttcagtggttttttaacattagtaatattactagggttgtttgctttggacgaatggatgctgaattgggcatctgccgatcctaactgcgaactttgatgtctagtttggtttgactttgggcaatgtagtgggttgatacaccaatatttttatcactcaaagcacaagcgtagtacaaaataaagtgacagttgttccaccaaaatcatcgaatgatccatgaagaaccaacctgtcctattcctaaaaccaagcagcccataagtgttatgcatgacaaatatattctagttctaggaaaaattttgtaccaagggtcttcaatttctcaagctgagatggaagtccatgcaataacaacttatgtaaatttgaatttaaaacacaaaggtttcatgtaaacccagaacacattttttaatcgggtacatgttcttaagacacctaaaggttgacttctattttctcaaactcgttaatatatttttctgcatctaatcaaattcctataatcagctacagtaagatcgaccatattactgaagctgagaactcctgaaaaattcatgtggaaataccacctggagtaacataatgataaaggaagaactgattaatctcttacctttccgcagatgaataaggcgaatgcctgcggtgagaatgcttgctatgtggagaccgcgaaactcgtctagagatgaaacataactaaatgggtaagtgaaaggataagagatatatgaacctgatgtttcttcactcagaagatacctgcacactcatatcaaattcacaaggcatagaataaaagcattcctatacaagacttaccatagcagatatgcgaaagcagtgtccttgaggcactgcctcaaagaacatgaatccagacagatagtacaaaatagttcaaccaatacatcccctcccccccaccccaacacacacacaaaaacaaaaatctcttatcctcgcatggggagaaaggatggaaatcatagaaaaaccatggcatgactagccgtattcatgatttaaaaaacatcaaatgctaagcaatttgtggcttccagataaccagaacagagtaagtatgtcagccacattattgatgccaaacataaaaacaacttttaggattaactaatgatgccagccataaaacaataccatctacaaacatgttgaagctaactgctaattcgcacatttttaacagcattaatctacattataaatatgctgtaaacatatagttacctgttcctagattttgggggtgagggggacatgctgcttttacatgaatgaagttttctgtaacagaaaaaaaaagtaatggacaaattaccacgcagggataacaattaatacaatacacattatgagaatttaagaatggcatatacctccttttcgaattatcagaaggctcatcacttgagacactctctcgatgtgaagaactctccttcttggtccgacttctcgcacttggtgatcttgaccttctactgctatgactacttgagccctttgtagtttgcctcgacctatcctccttttcatgtttccctttctctcttctatctgcagaatccctgcttttctctcttacgtccttttgataatcttttctctctccttttgcatcatcctgcttagagtttcctctggaacggggttcccttgtatcagctccatgtctcacactcctgtcagatcctttttcctccttgaagctaccctttttatcaatatttccatacatgctagatttatcatcatcattatatcttttggaagaagattcggattcttttcttcgaacagcctttggctcctttacaaaatcttcctcattgctgctcttccctaaatgcccttgactgctctccatattgctaaaattttcaacattattgcctgaaggtggaacttttccattttgggaatatccatgtgccttctcatccagggtaggagccacatccttcggctgacttgatattttggcatctgaaggaaattccctactatgtgtgtcatgaacacgtagctcttgtttaagttctgcacttgagttcctatgagacatttcatcattaaatttacgatcttcgcctaatgaagcattttggaccacagaatttctttcattatgatttccatgctgttcaccatcagtggctttttcacctattgattatttactcgagttaatatatttaaatggacaagtaatgctctgcaggtatttattttaagaacttaccttctcctggacgagctgcgccagctttagtttcagacgataagtttgaaactggaaccttatcctcattatcaccctcatcgtcctcatcatctgaatcataactagcaaggccaagaagagcgcctttaggggaacttaacccagtaccatcagaatgatcagctgagctaacattagttggcttagcagggacaacaactttagctgagacctttggttttgattctcccagacaggccccttcacactagaaactctagtgggctcatttgctacaatgtagaagaaattatcagaaatgcagaatgtctatttaaatttacaatttagcacatcactcacgttcagctgatggatcatcttcattcaatacttttgtcgcgatctcatcaaaaagatcatcagtaacctggaaagtgacaagaggatcaaaaactaaagaaatgacaggaccttgtcagacctagcaaagtaacttccagttccatgttaaaaacaagacctttaagagaacttcagttaatacacgcttaatttcctggttcattgctgccatccgggctgcttcaatttcgtcctgcaaataattttagtccagtaaaattattacaaataaaggcggctatactagactataaaatagataaaagaaaatagaaggggataaaaccagcacattgttcaaatacgttgtctaattatccacctaaaaaagaactaaaggtagctttcctttaaaatggagttgctgtaagtgcaaatagcttctcagtagctagcatatggccccaacatttctatatgctccaaaaggccatgaatcttttttttttaacaaattagtgaattatcttgtgaccaaaatgaagtcatataagtagtttttagtaatagaatagcaaactgcacctcatcttcttcatcatcatcagtagatttagctgaatctacgcttctgctgtcagcctgatcagaacttttaagtgttttttcagcatcttcagatcccttggagtggaactctgttgagtgttgcaccgaagcactcactgatgtagatttcttcttcaaaagttcttcgcgaagccagttaggcactggaggctggccataatagagcgcgggaatcagtcaaagtacttaggcacatgagcagacacacgcaggaatctcaaaaataagggtggaagaaaaaaggaagagaagaacaaaacttactttctttgatctttctgtgacattaaaaggagtgtttgcatccacagggaatgcttctgtcacattaccaactccaaatgctgcaggtggaatatagcttgaaccagaaactgctccaaagagtggtgcagcatgaactgaagggtccatctgtaaggtaaaagttaattatcatatctatggtgcagaggaatcatatggagtaataaaataatagaattgaacctgtgctgcttgtggtggtactgaagcttgaggaaaaagtactgtagtagatggaatccatgattgcgctggtgctgaatgtgcatcatgatcagatgctgctattggagctgctggaatattagaattgaaatttgctgttctgtgcactgccatatcaggagctttcctactattaaattctaaaggttgatcactgggatcaactgcaatcttggaagactgcccatcatgcccaaaatgaggttgttccagtgagggagcaatatgcatactggaaggcgcttgtggaaatccgtcttgcattgctgaggcagttggaggtagctgagtctgcgagcttggatattgaatcatagcattcccaacacctgttattacattgcatagtcagcattaagcctggataaaaaatgcaggttaccccatccaaacactgagttatatacattgagcacagccagccagtaattagcttttctaaaatgtgatttccatctaatttccaggactggcagcaagagaaatgaagattttcagtgcttcaaagtaaaaagggctcaaccaaacattcaattacattcatgatatatcagaggtaattattgaatccatgataaaatggcatagtcactgagaaagtgattctgagtagatatctgcgtattcctccttttgaaggtggtgaaacccaccaagcaatcgcctcaaatataggaagagtggagcatacacaaacaataacgctagctcaaatgtttttagaaggtaacgtgtgtcatatgctcttttttcttaaataaatagctctgtagacttgcaagtctttccatatttgaatctgaaggtattaccaggagggaccagccttaatatgattcaggctacacagtaagttatattgccaagcaagcatacctggagtagaaggataattataagatacctcctgctcataggcggatggaaatgaaccaaagttctttgctggtggcgccaatggacctccatctgcaatattatcttcagctccactctggaactgacatatccatatataacatatattgagcaatagtaataagatatggtacctggcagatagtttgtttccctgtgctgtcctgtcatttgaaatggcaactggtcattacttgactgagggattggcgggcgtaaaggttctgcgggcagaccagctggttgctgatactgatcctggtaaccgtaattatgaacttctggcctatttgcggatatggcatgctgttgaatatgatggttttctgtaacagatttagcagcagcccatgccttcgcctttgtagcccaatcttcctcatttccatgcccttccagatggggagaaaaaacaaattgaaaaggtcaatcctgaaccatcatcagtaactacattcttactgtaagggatttgtctgctccaagaaagcttagtactatcttattatcaattagtaccatcttattatcaaacatatgtaagaattcttttgaagcacagaccataaatacatctaataagcctatgcatttggtgaatcagaaaaggaattatttataagcaaaagttcagaaaaaagggataatgggaaacatgtgcatcatacacgctagttctcatgtaaatttactaatacatactgggaatgggcagaaaatagctccagatggcatagtggatacttgtttgatcaccgctagcgatgagccgatgactactttagtaaaaacttaaaggcaacttacactccccaaaattcttgaaacgcatgtacattcaataaacatttgtccctatgcatagtgttatgagcttaaacattgaaagatgcatgctgcatcataatgatcaaccagtgctgtgcatcagtaacaacacaagtttcattaacatccggttgtcaagcatactggaccaataaaattagatccaaatgaacataaagcttagatctaatgacaaacctgcgtatccatgactttgagcccacgaatgattggcccagccctaggaaataagcaatgtcaactaacaaaacattatttgaattcaacaaaagaacagataagaaaacagggtcatgggaaacattatgtcatttagattggatgttgaagccaactgaatgtaacctcaccaagagcacctaaccaaagctcatgaaggagtggcatcatatctaaagggaaccaaattgttccaaggcactaaggatttgccacaaagaatatgtaccaaaatgaagtaaagaaaatacaacaagtgcaggaggtttattgaatgcattctaaaagatgatttagaccttcaccctagatgatctatccatatgaaagtctccattgtgaataagtgagaactgtacaaggacaacactattcacacaatcatccctcagtgactcatcagaccagtttcacacagtcacaaaaccaccctagagttatagtcacctcaccctaatcaaacaccgtatcacacccttcccagaaaccctacagccaacagcgatcctgaactacaaaccctaacagaaaatttactatagtctccaacggcgactccaaaacgaaacaggatagcccccgacatacctggcccggaggcggcggcgggtagctgggcggcggtggctgggcagcggcgtggtgaggaggccagggattccccgccgcaggaggcggcggctgcatcggcatcggagggagggagggatggtacccatacggcggcggctgctgcggcagcggcggcggagggtggggtggtccccactggtggtgctggggagggaaagggtggttggcgtggggagggtacggcggtggggacggcccggggtaccagtgcgggctcgcgtgggagggaggtggaggctgcggctgcggcggcggcggcggcgggggggcgtcgccggagacggcgaagcggcggtggtgggggtaggcgtccatggaggcggagggacgggaggggaggcggaggagagtcaagagagacacggacacgcgcagcggagctcggcgaggggcttttacccggctcggtttggtcggccttctgtctgagctctgggctcccgtgtctatgggccgcctgcacgtccacgttatcatgttatggacccagtttcacacggaaggcccaagccagaacacataaagtaacttatcttcttgggagtagcaatatttatgacatcatatttttcactagaaaatagtcaaaatattttcactccataattgcattcatgtacattgtaattaccctgtatttatcttgtaacttttatatagctacagtgtaactacaatatataactacaacgtaactataatgtactccctcagtcccataaaaaacgaatcaggaccggatgtgacatattctagtacgataaacctgaacatatgtatgtctagattcgtagtactaggatgtgtcacattcggtcctaggttggttttttgggatggggggagtaactattgtgtgattaaatacttttttaaggacacagggggggaggggggagtaactattgtgtgattagatactagtaattctcatattcaccttccaatgttttctttctcctctccgacttctctgtccctggatgacgtgacatgagtttgttgagcaatgaaaaattaaggagatagattacctgtccatattactacgatatgtcacattcagtactagattgattctttatgagacggaagaagtagacagcagcctggcagtgacatgtatgaataagttggacccgtgtaaaagaagcacgaatctcaacccacatcacagaataaaaaatggttgtttttgacgggaaaaatatgttgacacaatgattgcgaatcctttttttttctagctctataaattggtctctccaaataactccaacacgtcactgtcttttataatctctcacatacaacttaatttggtagagaacactctccatgaagtttattttctcttctaacctccacctctatctagttttcaataatttctcgttgtactgatcaacttctcacagcatgtggggctccggcgtggtgagcaaagttgcccctatgtcttttcttattaggcttgagattttatacaccacttctatagtagcatgtgtttgccgccatggttttaccaccgtaccactatggaattaaagagtacaaaagcataaggtgaaaggagaccgaaatacacacaccttttgtggcaagggataacttcaatcaccaaatggaggcctatggagcgcaagaagttgctgaaagctaatagaggtgggaagttggaagaaactaataaacttgtaaggagtgttctctatcaattaagttgtaggtgggagattggaaagatcagttacttataggggtgtatttggggtgaatagctaattaagcccctcaagtttcaccgaaggctcaatttggtcattcacgtttcattttgttcatatagctcatctaaatatttgttttggcttgacatcatccttgggcccacttaatatgccatatggctatttttaagtcaatatttctattagaaaatgtcccttttgcccttaatttatatacaactatatactagaagggagaaaccaagatgaataaacaacattgcagatatacttcccattatttcaacatgtgcacataaaacataagcaattactatcgtatacacttgctagtacttaatttattttcgttttacataatttactatatattatcaataaaaaaatcaagcatacaatttttctcttatatatgtgaatgatgggggtataagtgtcatttatcaagagagttgttggttcgaggatatttgaactaaaatgaaaacttgaaggactaatatggatagattgaaatatcaaggactaaactgagccttagatgaaacttggaggaccactttggctattcacccatgtatttggatttcccccactaaaaaaaaatcttccagtcttctactagtagagtagataaaaaataataatggaactgtcaagcaattaaacagaactataggttctaaacatcatgaaactgtatgcattacaggagaacattgaagcttttctaccgtcaagtccaggataggttcaatgtttaaagtttcacaaatcacaacacacaaacaggcaataaataaggagtttgcacaaaagccagaagtatctcccacggtcacactactcactagactatttctacaggtgaactgccaagtgcactctctagctagccaacttggcacgttaggaagcagggaagcagatacatcacatgtcttcacattgcaggcaaactcggctggtttccatctaagattagcagtgattccccaagtagcttttgtgcctcctctctcctcctgcgaaacaatagcaagaaaggtataaatctcaggaaagtgattcacgtgctttgtgccaatagggatccaaatcagtgatacataggatgaaaactggagtggttttcaatgaggaatgtaagttgcacaattcgcaaataatataagggttggaggtcaaaattgatctgagcctaaaagtcggcatttgttctaaaacagcatgcatgatcattgaagttcaacagccattcttagttagcagccctattcaaggtttcaagctaaagatacttactgctttatatcttcaattgcttgtttccgacgctgaatttggttctcaagcatgtgaatcagagtggctctggcctacaaagtattttgaaaagggaaatcattttggcgaatatagagacaatcattcatactgtgggataaaaactgagtctcttacttggtgaggtcgtaaggaattaagaaggtggtgcaagttcttgaaaatgagtgaaatatcctctaccctacgagcatactgtgatggtctttccactaaaatatctgctagctccaaaatatggagctgaagctctctgttcagggtccttagctcctttttgaaatctgcagataatcagttattcaaaaagccagctcgttaaatcaaagaatacaaaagttgtttagtgctgaaagtaacaacacaaaccatttgttcagtatggccagaagtgtaggaagcttaccatagaagcccgaataattttaacaagtcacaatgtaactattgaactaaatatgcagtcaggagttgcacataccgatatctgggctcttcggataaagctgacgaacaccttgatcctctaagcttgggagcaccacatctgtctagagagcatataggcaaaggcatagtcagtttaacacatgtaacaacataatataaagaagagtacaataagcaacatactgtgtaggtagcaccgaagagttgatatggtccatcaactggcggtggaggttcaggtgcagatgaaggatccttttcgtaatccttgtatagtcggtaatatggaggaggtggaggatatgctgatgatgtggccatgccaggtacggaaccaactcaacttccaagctgtcacatcacagaatctgagaatcacaacttttgatgtggcctatgtttccttaagctcaataaactgaatctaatttgaaactattgtttacatgtaaaatggaaaccaaatcatcttcacgctagaaaaccagtcccctttcattcagatttatactttgttttaagaatctgtggtcaaatcttctgggtaggtattgcagttgcagttcttgcaacataatacaaacattacatttaagagattataatttgactcactgaatcatcaaaaagcaaaactaatcagttactcccattactaccaatttacagatgcaaattgcaaaccaaaacaaatgcaaggacaactcgcaccgatttgactgattaccacgtgatcacttaccacgatataaaacccagacaagtcgactagtacagtcgcaccaattcaatgttgaacacgcccacgagaccattacccacacttcacaacccccacgcctacccacaggacatcaatcccatagatgaaaggaccatagagatgatgccaaggaagaaggaagcagagggagtggaacagggggaagaagcggagcggatttcgcgcccgaccaccctgggcagctgcccagggtaaatggctcattcgcttgcagcagtgaatgcattgcactgctctgcgtgcgtccgacggttgagcagcaaacgttggcgcaatggcgcgggcagcaggtgtctagcagagtagcagggcgtgcagcaacacaagtacacaacaggcacatggtacatgactctatgcttagactatcttatttgggcgcttggctacttaattagcaggcagatgcaaaggcataccagcaggagcaaaatacttggacaaactgaactggatttttcacctgtgctaacactttgctcaaatttcatactgagaagttgatatgaaagggaccatggcgaatcttgtgtgagtggtctttgcaagcacttgttaagttgtgttcatcggtagacttgcccaggctcagaaaaatttctggccccgccaagcaagcgcctaccggcctgattgagatggctatcgtgttaaagatatcgcggcaataatacgaactaaatttcaacaaaccggcgagagatctgggcattgattcaaccaatcgagatgcaaattggggaaatttagggtgcagaatgaaccagagttagaggtgagaatctatacccggaatgggaaaaacatgaacagttgtttggacgaagcacagatggggatgccaacctcgaggaagggcgcgagagcctccggcgagcggcggcggcggtggcggtggcggagacggagacggagacgagcgaccgaaccgacccgaagccgaaggcgaaccagggttgggttggtggtcatgggccaaaaagcccaactcgatccagtgagcttcatctggaccgtccacttgagatcgaacggtttacgaggcttcaatccgagttcttttccgtttccgtccctctattaaatccttttttcgaagaggcgcacccctaccttccgcctccgcaagaaagaaagaaaaagaggggaagcaaagcgcagaggcggccgtcgcagcagcaacacaagtcaggggaggagagagaggccgcgccgccgcagatctgtggccgcgttagggtttcttcgccggaatcgagcgaggaagtaggagggagaggaggaggaggaggagggcgacgagtaggaggcggcggcggcggagatggacgtggtgaaggcggcgcagctctcggggcggacgctggagaaggtggtggtgcacccgctggtgctgctcagcatcgtcgaccactacaaccgcgtcgcccgcgacacccgcaagcgcgtcgtcggcgtgctcctcggcacctcctcccgcggttccgtcgatgtcaccaactcctacgccggtaaaccttcccccagtactagggtttgcgtgtctcggatcagcccccttctgtttccaagggatctgcgctgctagttcgccttagggttcgcgcaactggtggcggttgtgggtatagttagatctattggcgtgaattgcgttgaacctgcacaattagatctgtggagttctattccagtgacgatttactgtatttatagcatgctatggcacttggttttgcagtgccgtttgaagaggatgacaaggatccgaggatctggttcctcgatcataattaccacgaatcgatgttttccatgttcaagaggatcaacggtatgcagtttgcaagtcttccatttgtttgacctgccctgtgtaactgattgtgttgtactgacgagctgttcttcgtgtagccaaggagcatgttgttggctggtacagcaccggtccaaaactcagggagaacgacttggatatacacgcactattcaataagtatgtgatgtaccgaagctttatatcctgtattgttcatgaagttatattcttgactagatatgttgttttggtgcaagtaatctttattaaattgtctggcacccaagttataaagcactgtagacttttcagcttgctagtataacagaaggaactgttttatatataacctagattcaattgctgtttgacttcctactgttaacatgagagcaagtcgaatgttgtctgtgcataaaactgtggccctactgcactggactgtaagctcctcagaagtgcatagctagtcccgcatcatagataacaccttttatctttcccccctttttttctttcttgctggaaccttatctgctaccctggccgatggaaatttcctgatcagttttggttacgaacataatgaactgatatgaacagcttggtgctaactaaagcatcatcctaactaaaagcagttttgtagttaatttgttccctcaaattaatttatgtgtttggaaagtcattcgcacatattggtggcatgggagtttaataggtgatgttagtatacctgaaacattaccttctgtatctttttattaagtgtgcttgtaatttttgttaatgaaagtggaagtagtttccccccttcaaagtattttttttcctttttgtttttgtccctggatgcttgtgccatatttattttggtgcttacccttcatagtagctaacttagttcttgtgcttctcaattgtagctatgttcctaaccctgtcctggtgattattgatgttcaacccaaggagttaggaatacccaccaaagcatactatgctgtggaggaggttaaagaggttagcatgtgatctaagaagctggaggtttattgtgcttgtccattgtcttgttctgtttcattaatgtacatgttgtcttttacagaatgctactcaaaaaagtcaaaaggtgtttgttcatgttccttcagaaatagctgcccacgaggttgaggaaatcggtatgtctgtctcatctgtttttactaggaaaaagggatgctttatgtattttgcaagttacagataatagttagcttgtttgagcggtaaatatattaagttgttgatgctagtgaggtttcttcaccaagaggaaagaatatttttgtggtgaagtctttttccttcagaaaggattgttgactgatgtatgttcatcctacttataggagttgagcatcttctgagggatgtcaaggacacaacaataagcacgcttgcgacagaggtaatatttcacaagaatatgcattttcagcctacaagttgctttattatgccctaatatatcctttatcattgttgtcattaaaggtaaccagcaagcttgcagccttgaaaggactggacgcaaggctcagggagatccgtgggtacttagatcttgtaattgaagggaagctcccactgaatcatgagattttgtaccacttgcaggttcgccttctactcattgctttctgtatggtattcttaggagttacatatacctccaattctcttgcatttgctatattattgaggtcagcacttgaaagctatctcatgctaccgccgtttggttttatggaatatttgtgcctttgagatatacacctccattattgtggttgttcggaattcagtatcactaaatatcactcccaaatcaaataaaaaaagtgcttaaaagttgcttacaaagtggaatatgctgccactggtaattccctgtgatgctactggtagttttcacaatacattggacgcgagatataagggatcttttggatggccaaatttgttttatgtatgttttttatgatttgttggttttttgtctaatatttttactcagcttgtcactaccttaataagaaaactgtgacacaacatgtctaaaaaaactaatgaaggtcatgacagtttactacatgtaacttgccaaacaaaatttaaatataattcaaagttctgttgctgaaacaattttactgatgcagttaataacctgtttattttttaaaaaaatcacaggatgtgtttaatctgctccccaatctcaatgtaaacgagcttattaaagcctttgcaggtaataacacatgttctcaccaatttactataattgagctgaacctgtcgtctgggtttcttatcttaaaatggttcgatgctaatgttctttcctgcagttaaaacaaacgatatgatgttggtcatatacttgtcttctcttatccggagtgtcatcgcactccataacttgatcaataacaaggtaaattgtttctgtcttatctattgaatatagaagatgcgggagttaggagatacttgtcatttattgtaagacttccttttatttgattccagatgctaaacaaggagcatgagaaagccgaggattcgaagccaaccgccatacctagtgctgctgggagctgaatgtgctttatttgccttagattttggacccagtggaagccaaaagaattgtgacatgttagcatgatggcgtttgaaccaattgtctttgaccttggttttacactttcgatgtttatttcatgtacgataaggtcaacggcaaactttacattctgtgagcttaggtcatactacctcttgagctttcatcttgatcttatatacaatgtttcatggggtgcatcatgttttgtgatgcggattgtcgtacgattaacttctagtaaatgtttacttgacgcaaaaccattagtttgttcggcttgtggcaacattgtaattgatacctaacaagttgctaggacaggttttcttggcgaggcttatcgtatgtgttctctagttggcggctgtcaatggagcgctgatgggtgcacacaggtggttttcgcttcggctcgagttcaaaaactaccctggtgaactaattcaattcatgacgtcaaactaaactgccctggattatctttcatctatttttgcaattttcaaatcgttttcataaaaatggacaaccgttgagtacttgatcagcgaacggttttggaaccttgatgtagcggctgaattggagttgcaggtttttcctaattcctactttgaaacttactgaacctcgttgtaaatctacctcgaaatgaattgcagtcgaacgtttttcccaattcctactttgaaactgttactgttctctgaaaaataaaagcacacggccaaattcgtaaaataaataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataaacccgttccaaactccatcggcacaaggcacaagacaaaattcgtcgaaatcatcctccagattccagaacggtttgcgtggtgtgtgcgtctgctgattacgactcggcgaattcgtaagccgtagcgaatcgaatcgtcgcggtcgcggccatcctctccaacccatcgccgaattcaccatcgcgaggcgcaaacgcagctcgtcccccctatggccttctcctctttctcgtggccgttccgccgccgaggcggcggaggcggaggcggcccgagcaaaccttccgcttcctccgccgccgccgccgccgccgccgcggccgggaacgaggaggaggagctgg

SEQ ID NO: 80482 - DNA, 19964 bp, Oryza sativa
agctgggacccagggtcgggttgccagttcggtctgaatcatcgtaggccttgggttaaggcaggttcgtgtgggttcacggccttgattaataatattgtatagctctaggaccgtgtttacaaaatagctttgagcaactaagtgtcttttagtgtagtttactgcaaaccctaaccccctatattatggctcccttgtactcccttgcatttattctgcacttgtggttttgtcttgttgagtacggtggttgtactcagtcttgctcaatttttcccaaacccagaagaggagcccctggaagataaaggcttttgtgtctagctcgtgcctgccgtcaagcgcctgtggtcgtcgccctagtcttccgctgtttttcgtttgtcttcttgtgtgctgggccttcgctgcccatgtaataaattaactatgtacgcttccgcttgtcaaactctgaattgtatcaacttttggtgtaccttgcctcctgggacaaggaataatgcacacacataaggaacgcccgttgggttatttccggtcgtgacatttgccgatgtacaatagccgatattgttatatcacccttagttgttttataattttatcaatgtttttgtcattgtaaaattaggggggcacatatatatcaaaagcatgttgacagaaaacacgaggcctgggagatctgcttaaatccagtgctggtccaaagctcgccttcgaatgtatgagcgtgccagttgatttgatcctgtaatcaacaagaaatagaagcaaagaaaccgcagttaaatctataaatgatagccgatcggctaggtgccgatgacatatcatttatctttgagccgatgtcatatatgcatcgatcggcagtcattaataaataagaagggactaaatctactcgattggctgtagatattaacaatatataatcattatatcgatatatacttaaatcaagtgattgggatagatcggtcgccatgccgagacagaataaatcacttagatcgaaatatatattaataatgagactatatacgttcatagcataaccgatcagatagatctagcatgtatcggctaatactccgataccactctatattaagatattaaagcgagtagaatatactaaacaaaagcctaatatacttaaatgcagcaagatcttaacgtaaagggcagatttaacatgtcaatcaaacatataggataaaaagtagttaaatcaggtaagatcagctgaaactccgatactaccctaatcagcaaccaagaagcgggctagagattgagattctaatcacgactcataagatcatacttaactgatgcagctataagtatgaaaagaagaacaatgtctagacaatcaagccattggatgtgtcatagagtggtagatatcctatataatctaagtcaacatcggtatttaacctaatcggctgccttctattgacggatgttagccgattgtaggttagatatcgatattgccaaggattatgtaggatatatgataactcgacgaaatacataaacaagattagagtgtcataaagatggaagcactaatcccaagaacgcaagccgccataacaagttttacctcttgttgaagatcgaaaccgatgcagctcaacccgaaagcaagaactcgtcgaaataaaactaaagcaaaaaggtagcgttgcgccgggattgtattgaacgtgtgtgttaaaagtaacataggactcgggtctatttatacccaaaaatcacaagatatgtccataacggacacgactactatctctaagaaactctaagataccataagtctgtacggcagacttttgcccaagcatatctccaaggagattacataaaacatcctaattaatagatacaattgccttctcaggactctatccatgtgcggcaatcacctcgaagcgccttaattcaacccgatatcatacatcaggttgcattgtcaaaatcggctgcatcggcttacctagcccgactcagacccagccgatcctaatcgtagccgatctggactccagccgattcctgctctatttctgaactcgatctccgcctccaactatgcttcgatctaatcttctttcccaatgccgatattacaaaatttcgttgttaacacatgccccccaagtccggaatatttgataatgtttcggatttgctgtaaatcgactctgagcaagtttcgcactttgatgttttccgaccgttactgccgtgctttaaatactaaccattaccctcgagaaatctcacaccgtcctcctccattttcaccgctgaaaccaactttgccctctttctctccagcgatctcaccgacgcacaaggcgatccctaggcaatttcgttcccgaccagatctccgcccgcggcgatgtcgtcttccaccagcccttctactgcaccatcggccgagtacgctgaggtaagtcctcaccagctagatcccttttcctcgcatgaaatcgatttctccttttctcctcatgttttccgcttcccgattcctttggatttgcagcacctttccaacctagtcgcgattcccagcctttcacacaaaaaccactattttcttggcccaatcggcaatctcaaccccactgatttcatcatcggtgaaaccaatcggatcccctttagactagccaaccctaacctgggttactggaagaatacattcaagtcttggccatctctcgaaaaacctactcctgataagagctagaccacctggtaccaacgcgtatcggctagtaagaaagttcactgggatgaaattggaatcggccaagcactcgctttcaccatagccaattctgctaaggatgaacctctgatggctgccgccacctacttctggtccaacgccatcaatgctttcttattcaaccaagggccgatgactccaactttaatcgacatcaccatgattactggattagatgtaacttcatcggctaaacctatgagtatgaacaccaagaaccaatttgacttgaagaccaaaagcataggtggctggtctggctatgtggcggcatatatgggccaagggtctgttacccctcgagagcatgtagctttcttgctgatgtggctggaaaagttcctcttttgtggatccagttgtggccctacaaccaactagcactctgtagctgaagccttagaatcaaagaaagaatttcctttgggcaaaaatccttctgggctatgtgtaccagatgttgaacaatgcatctgctaaaatagccgtcggctcaatagttggagcaggtggaccatggtggctgctgcaaacttggttaaacctgatagtcatgaacattgtcaatcgaccctctgtgacagaagctgaattcccattgccagagccgattgtggaagatgacggagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaattctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcagctataatttacccagctcttattctttccaaaattgcctctgcaggctctagctgatctcttctcttttgacatcagagattaccttgatgaggcagaagaagacacttcaagcaaagcccaagctcccctatccgatgatgtgagaaaaacacttgaagacatcgctcatcggctagaagcctcttctttagacagtttggtagttgactgtgggtcaattaggacgcggctgcatgaagttcaagctctgattcccgaagatctggctgatgtcctaactccagccgcttatctcgagcaacatcagttcaagctggaaaaagccaagctaagactagccgaacgccgtgagcacaaagagattgaggccacaatccaagctaatcggcagcttgtgcatgaaaaaaaaaccaaacttgattagctatctgaaggtccaatcaaatccaatattgatcggctcgaagctcgcaagattgagctcttggcgcaacttgaagaatgcaatgccgagctagatatggaacacaaaaagctagccgatcttccaaaatcaattgaagaacaaaaagcaaggctcaaatcggctatcaaaaatgttgctgacctaaccaagtccctgaaagtcatctctggaactgatgctcaagatgcccatgctattgtagaagtagaacaaattaggcaaagggctattttggctatcctatgatacttgtctcaataacttttgtgtaataggacttagaaattttttgtaatcagctaagatgctctagtactttactgtcttgacaatcctttgtgccgattaatatgactttgaaattcgctcaaaaaatttgcctcaaaaaatttgcattgcattttgataatatcggctcagaaattcccctagggggcatgtttcgagtttgcttataccattaaaccgtatgcgactaataatcaagctgagtatgaggcagtgctcaaagggttgcaattactcaaggaagttgaagccgataccattgaaatcatgggggattctttgctagtaatcagtcaattggcaggagagtatgaatgcaagaatgatacattgatggtttataatgagaagtgccaacaactaatgaaggagtttcggctggttactttaaagcatgtctctcgagaacaaaatattgaagctaatgatttggcccaaggggcatcagggtataagctcatgatcaaagatgttaaggttgaaattgcagcaatgacagccgatgattggaggtatgatgtgcatcagtatttgcataatccgtctcaatcggcttctaggaaattgagatataaggcattaaagtatactctgttggatgatgagctttattatcggacgattgatggagtgttacttaagtgtttgactgccgatcaggctaaagttgcagtcagcgaagttcatgaagaaattttggtactcatcaatcggctcataagatgaagtggttacttcggcgtgcagggtatttttggccaagaatgctggaggattgttacagatattatagggggtgtcaagattgtcagaagtttggggcaattcagcgagctccggcatcgactatgaatcctattcttaagccatggccattcagaggttggggaattgatatgatcggtatgataaacccaccatcgagtaaaggacataagtttatattggtggcgactgattgtttcaccaagtgggtggaggcgattcctttgaagaaagttgattctgtggatgcaattcaattcgttcatgaacatataatctactgatttggtattctacaaactattacaactgatcaggggtcaatcttcgtgtctgacgagtttgttcagtttaccgatagcatgggtatcaaattattgaatttttcaccatattatgcacaagctaatgggcaagccgaggtgtctaataaaagtttgatcaaattgattaagcggacaatttctaattatcctcggcaatggcatactcggttggccgaagcgttgtggtcttataggatggcttgtcatggatcgatccaagtccctccttacaaacttctttatgcgcatgaggctgttttgccatgggaggttagaatcggctctcgaagaacggaattacaaaatgatttaacagcttatgagtattacaaccttatggccgatgagagggaggatctggttcagtgacgattgcgagcccttgcaaaggttaccaaggataaggaacgtattgctcggcattttaataagaaagtggtacctaaagatttttcggaaggagaacttatatggaaattgattttgccgattggtactcgtgatagtaaattcggcaagtggtcgccgaattgggaaggactgttccaaatttataaggttgtgtctaagggagcatatatgttgcatgggtttgatggtgaagtttatgggcgagcgctcaatggcaagtatttgaagaaatattacccaagtgtttgggttaacgcatgatcggctagtattgccgatgcatgacagccgatgtgtttgcatcaccttgagatggccgatatggttatatcgcccttagttgtttttcatagtgtaatcggttgtggtttgccgatgtataatttccgatattgttatatcgcccttagttgttttataattttatccatgcttttgtcattgtaaaattaggggggcacatatatatcaaaatgcaatgcaaattttttgaggcaaaattttttagcgaatttcaaagtcatattaatcggcacaaaggaatttcaggacagtaaagtactagagcatcttagctgattacaaaaaatttctgagtcctattacacaaaagttattgagacaagtatcgctggatagccaaaataggcctttgcctaatttgttctacttctacaatagcttgggcatcttgagcatcagttccagagatgactttcagggacttggttaggtcagcaacatttttgatagccgatttgagccttgctttttgttcttcaattgattttgggagatcggctagatttctgtgttccatatctagctcggcattgcattcttcaagttgcgccaagagctcaatcttgcgagcttcgagccgatcaatattggatttgattggacctccagatagctgatcaagtttggttttttcttcatgcacaagctgccaattcgcttggattatggccttaatctctttgcgctcatggcgttcggctagtcttagcttggctttttccagcttgaactgatgttgctcgagataaacggctggagttaggacatcggccagatcttcgggaatcagagcttgaacttcatgcagccgcgtcctaattgacccacagtcaactaccaaactgtctaaagaagaggcttctagccgatgagcgatgtcttcaagtgtttttctcacatcatcggataggggagcttgggctttgcttgaagtgtcttcttctgcctcatcaaggtaatctctgatgtcaaaagagaagagatcggctagagcctgcagaggcaatttcggaaagaataagagctgggtaaattatagctgatctaattgttgagacaaagggaaacttactgggatagcagaagcagctggttgttcttcctcttcgacgtgatgactccccacagccgatggagtctgattacttgacgattgctgtacaggaggagaaggaggaggaggctgcgaaatagacaagtgttatatagaatcggttgagattgattaagtaaaggaattaaggacatcttactggtggagccgatttaacaattgttgctgctggttttttcttcacagtagttttcttcttctgcaaccacaaagtctatgggtaattagccaaagagagaggtacttacttatgtaaaataaacgggggcagaaggagttggaggcgtttgcttgggtaaagccgatagtgttctttctgtgtcactcattttggctacagcttggtcaacatcttcaccaatttcttcttcatctaaagcttgtttaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggaaagttgaagtcttgggggcatggtagccgataaaagggggagatagtccacctccattcagaattaaacctgaagcatattcaatgttcctgcaactattactttgatgaggaggggaggactctgttgtctgcaaaacaggagcaagagattagtcaagtaatgaatcggctaactagttatgcaatttggtaatgacaaagtttacctggggtatgacgtcagggaatagatctgtcatatacattgaagccgattgataaaatagatgcatcttccatttaccccaccatctgtcaaagtttttgcttctaaatcctgccaactcaatattatcaatactgcccagagggggtcctggtaggttaagtagccgatccatcattagagtggatgtgatttgtcctcggcactgaatcttgtcggcaaagaataagccgattgggagttggcccaatccaagtgggtgataaaactcgtaggagacttggatgtttctcccatggtgaatgccgacagagaagatgcatgggctgattgcagctataagaatttctctggatttttggaatttttcatgattaatgtcttcaaatctaaagtctgatggaagttcaaggtctgctgagtcttcataaggaaaccagattcgtgcatctttcttaaaaccttcgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttttgtcacagagggccgattgacaaccttcatgactatcaggtttaaccaagtttgcagcagccaccatggtccacctgctccaactattgagccgacggctattttagccgatgcattgttcatcatctggtacacatagcccagaaggatttttgcccaaaggaaattctttctttgattctaaggctacagctacagattgctagttggttgtagggccacaactggatccacagaagaggaacttttccagccacatgaacaagaaagctacatgctctcgaggggtaacagacccttggcccatatatgccgccacatagccagaccagccacctatgcttttggtcttgaagtccaattggttcttggtgttcatactcatagggttagccgatgaagttacatctaatccagtaatcatggtgatgtcgattaaagttggagtcaatggcctttggttgaataagaaagcattgatggtgttggaccagaagtaggtggcggcagccatcagaggttcatccttagcagaatttgctatggtgagagcgactgcttggccgattccaattttatcccagtgaactttcttactagccgatacgcgtcggtactaggtggtccagctcttatcaggagtaggtttttcgagagatggccaagacttgaatgtattcttccagtgacccaggttagggttggctagtcgaaaggggatccgattggtttcaccgatgatgaaatcagtggggtcgagattgccgaatgggccaagaaaatagtggtttttgtgtgaaaggctaggaatcgcgactaggttggaaaggtgctgcaaatccaaaggaatcgggatgcggaaaacatgagaagaaaaggagaaatcaatttcatgagaggaaaagggatctagctggtgaggacttacctcagcgtacttgcccgatggtgcattagaagggctggtggaagacgacatcgccccgagcggagatctagtcgggaacgaaatcgcctagggatcgccttgtgcattggggagatcgccggagcgaaagagggcaaagttggtttcagcggtgaaaacggagaaggacggtgtgagatttctcgagggtaatggttagtatttaaagcacggcagtaatggtcggaaaacggcaaagtgcgaaacttgctcagagtcgatttacagcaaatccgaaaaattatcaaatattccggacttggggggcatgtgttaacaaccaaatttggtaatatcggcattgggaaagaagattagatcgaaacaaagtcggaggcggagatcgagttcagaaacagaacaggaatcggctggagtccagatcggctgggtctgagtcgagctaggtaagccaatgcagccgattccgacaatgcatactgatgtatgatatcgggttgaattaaggcgctttaaggtgattgccgcacatggatagagcctgagaaggcaattgtatctattaattaggatgatttatgtaatctccttggagatatgcttgggcaaaagtctgccgcaaagacttatggtatcttagagtttgttagagatagtagttgtatccgttatggacatatcttgtgattttcgggtataaatagacccgaaccctatgtaacttttaacatacacgttcaatacaatctcggcgcatcgccacctttttgctttagttttatttcgacgagttcttgctttctggttgagctgcatcggtttcgatcttcaacaagaggtaaaacttgttatggcggcttgagttctcaggattagtgcttccatctttatgacactctaatcttgtttatgtaattcgtcgagttatcatatatcctacataatccttggcaatatcgatatctaacctacaatcggctaacatccgtcaatagaaggcagccgattaggttaaatactgatgttgacttagattatataggatatctaccactctatgacacatccaacggcttgattgtctagacattgttcttcttttcatacttatagctgcatcagttaagtttgatcttatgagtcgtgattagaatctcaatctctagcccgctccttggttgctgattagggtagtatcggagtttcagccgatcttacctgatttaactactttttatcctatatgcttgattgacatgttaaatctgccctttacgttaagatcttgctgcattttagtatattaggcttttgtttagtatattctacttgctttcatatcttaatatagagtggtatcggagtattagccgatacatgctagatctatctgatcggttatgctatgaacgtatatagactcattattaatatatatttcgatctaagtgatttatattgtctcggcatggcgatcgatctatcccaatcacttgatttaagtatatatcaaaataatgattatatattgttaatatctacagccaatcgagtagatttagtcccttcttatttattaatgactaccgatcgatgcatatatgacatcggctcaaagataaatgatatatcatcggcacctagccaatcggctacatttatagatttaactgcggtttctttgcttctatttcttgttgattacaggatcaaatcaactggcacgctcatacattcgaaggcgagatttggacctgcactagagttaagcagatctcccaggcctcgtgttttctgtcaacacgcttttgatatatatgtgcccccctaattttacaatgacaaaagcattgataaaattataaaacaacgaagggcgatataacaatatcggccattgtacatcggcaaaccacaaccgattacaccatgaaaaacaactatgggcaatataaccatatcggccattgtacatcggcaaaccacaaccgattacaccatgaaaaacaactaagggcgatataaccatatcggccatctcaaggcgatgcaaacacatcggctgtcatgcatcggcaatactagccgatcatgcgttaactcaaacacttgggtaatatttcttcaaatacttgccattgagcgcttgcccatagacttcaccatcaagcccttgcaacatatatgctcccttagacataaccttataactggagttaagcagatctcccaggcctcatgtttttatgtcaacacgcttttggcacgcccagtgggagagattagaagtcagaaccgcaatagcattctctcatcgctaagaaaccaccagcatcgccatcttcggctggcaaaagagggtcctcccaaatctaggatcccgaagcttggtgggtccgaagttcatgaaagcaacatcgtgcccgtcactatagacaaattgacacttgaacaaaagaataatctcgaggcgatgatgcagcaaacacagaaccaattcttgaactcattcatggagacccgccaaggaacaattgtttagaggtataagatgaaattagttgctgatgttcctaggacaagttcttccaaggatggggaggtagaacaggtttcagatgctacagctcaattaggtgataaaagtgctgcagatggctcaggtgataagggtgattgttctcagggagtgaaagatgaggatctcagcccagatggtaacactgcacatatacaatttaacaacttccaagaatcagtctggggtactagtcaataccttgtcaaacatggtgaagtcgatggttgatggctcaatagctgagtatcaggctacaggaccggtttatttgccaggaggtattttcccaaactatcggcccttgatcactaataatcaaccgactgctcaaccgattgctcccaatgtgccatcagctcagccaacagcaccagtatcggctcctgcacctgctggaccatcatcggcaccaggtcaactaatcaatcctcggttgttggtgagagagcagtctcagcatagtggacaaaatgtgaatcggctaactcaagagcaagttgcagctatgtttttaccaactcagcctactgctgacccagttcaacagcagccgattcagcagacgccaccgaggcagcaagttgctcagccgattcagcagcaaggtttcctaaatgcatcggctgggttcaggacgcccgacaatcagccgaggcagcacgctgcaaatcaagttgtcccagagcatttggttcataatgtgcaaccagatcaatcggtgatacctcaagttattcccgaacatttggtgcgcaatatacagccaaactttcagaattatcacgggggcaatttgaattaccagtatcagcctccatcgccgcaagttcagtatcaacaaggaggatcgactcagcctcaattcgcttatcagtacaactcgttcgagcctgtgccacagcaagtgcagggggtgcctcaataggaaccatgggccgatatgattgcagatgtgatgagagagcaatttgggatcaagccaaaagacactggaaacttgtatcggcatcgatatcctgagtggtttgagagggttccattgcctagccggttcaaggttccggatttttcaaaattctcagggcaagacagtgtctcaacctatgaacatgctagccgattcttagctcagtgtggtaaagcatcgactgtcgacgccttgagggttaggttgtctccctagtctttgtctggatcggcttttacttggttttcttctttgccatatggatcaatcaacagttgaccgatttggagaagaattttcatagctatttttatagtggggttcatgagatgaaattgtctgatttaacagcgattaggcaaaggcatgatgagcctgtgcaagactacattcagaggtttagagagatgaggaataagtgctacaacttaagcttgactgatgttagcagatttggctttttagggtatgatagctccaatcagggagaaattctcatcccaggactttgatagtttgtcacatcttgcacaaaaggttacctacatatatggatctgatgatgatgatgatgattccgaggtagcagcagccaagtgggttaggagcaagaaggttataccatgccaatgggtgaagagttctggaaaagaagagaggtatgactttgacatcaccaaggctgataagatctttgatttgttacttcgggaaaaacatattcaacttcctgctggtcatacaattccatcggctgaggagctaggcaagaggagatattgcaagtggcataattctggatctcattctaccaatgattgtaaagtctttagacagcagatccaggcggctattgagggaggcaaaatcaagtttgatgattccaataagccgatgaaggttgatggcaatccttttcctgtcaatatggtacatacagctggtcgaacagccgatggaggaaaagctcgaggttttcaaatgaactcggctatgattatcaataagtatcagaggaaatatgattagcatcaggaaaagtattatgaggaagatgatagcggtcttgatcctcattggggttgtgagttctttagattctgttggaatgaaggtatgaggctgccatccaatgaggattgtcctaggtacagcaatattgcaggaagttcaagccgatcatataataaaggcaattggctaaggcaagcaagggttcctgttcatcaaaggttgggcccagtaaatcaagatcgtgaccaagaggacaatgaaggtaggaagacttaatggtgtccttctggtatttttacaaagaatcagaagagaagggttcaaaggttgaggaacagggaagaggttgagcaagaaatcaaccatcggctgaagaaaacgaagccgcagcaggagtggcgcgttaagaatcaagttcctacagccgatgaagccacagccgatgaagcaaaaagattggctaaagggaatagtgttgtaactgcatcggttaacatggttttcacactgcctgcagaatttggagtcaaacaagccgatgttgatgaggttgaggaagcatcggctaagttggttttatcaccagaacaagcagtttttgagaagccaaaagggacagagaattggtatctcaagccattttatgtaaacggttatgtcaatgggaagccgatgtctaagatgatggtcgatggtggggccgtggtgaatttgatgccttatgccacgtttaggaagctgggcaggaatgctgaggatctcatcaagacaaacatggtgctcaaagactttggtggcaatccatccgaaaccaaaggagttttgaatgtagagctaacagtcggcagcaagactatccctacaacgttttttgtcatcgatgggaagggttcctacagcttgttgcttggaagagattggattcatgccaattgttgtattccttcaaccatgaatcaatgcttgattcaatggcaagtcgacaagatagaaattgtaccagccgacaggtcagttaacgttgccagtgctgatttagctctttgggagatggatggcctagattgcttgtctggaaaggtttgggaaggagattttctaaatgtgtccgattgtgatatacaaccaattgaagatggagagcccaagttattattttgagggcgttgtggagggttcaaacgtctacaccaaggacacagtagatgatctcgatgacaagcaaggacagggtttcatgtcagccgattatttggaagaaattgacataggtccaggtgatcgatcgaggccgacatttatcagtaagaacttatctctagaatttagaaccaagttgatagagctcttgaaggaattcagagattgtgttgattgggagtattatgagatgtcagggctcagccgatcgattgttgaacatcggctacctatcaaaccggggtttaggccgcaccaacaacctccgagaagatgcaaagccgacatgctcgaacctgtcaaggctaagattaaacgtttatatgatgctggtttcattcgtccttgtcgatatgccaagtgggtttctagtataattccagttatcaagaaaaacggcaaagtcagggtgtgtgttgatttcagggatttaaacaaagctaccccaaaggacgagtattcaatgcagtagccgatcagctgggtgatgctgcttcagggcacaagatattgagttttatggatggaaatgcaggatacaatcagatcttcatggctgaagaagatatacataagacagcttttaggtgtcctggtgcaatcgacttgtttgaatgggttacgatgactttcggcttgaaaagtgctggagctacatatcaatgggccatgaattacatataccatgatccgatcggctggttggttgaggtctacattgatgatgtggttgttaagtctaaagagatagaggaccacatagccgatttaaggaaggtttttgagaggactaggaaatatggcttgaagatgaacccaacaaagtgtgctttcggtgtatcggctggccagtttttggaatttcttgttcatgagagggggattgagatacctcaaaggagtgttaatgcgatcaagaaaattcagtctccagaaaatagacggaattgcaggagatgatcggcaagataaattttgttagaaggtttatttctaatttgtctggaaggttagagccttttacaccattgttaagattgaaagccgaccaaaagtttacttgggaggcagtgcaacagaaggctttggatagtattaaggaatatcttagctctcctccagttttgattcctccacaaaagggattaccttttagattatatctatcagctggtgagaagtcaatcggctcagtcttgattcaggagcttgaagggaaagaaagagttgtattttatttaagtcgtcggctcttggatgcagagacgagatattcccctgtggagaagttgtgtttgtgcttgtatttttcctgtacaatgttaaggcattatatattgtccaacgaatgcactgtcatatgcaaagccgatgtcgttaagtacatgttatcggctccgattttaaaaggaaaagttggaaagtggatattttccttaacagaatttgatcgttgatcatcgtgatgattcaatcggctcggttgaggttgtgccatggtctttgttctttgatggatcagtgtgcactcatggttgtggtataggcttggttataatttttcctcggggggcaagttttgagtttgcctatactattaagccttatgcaaccaataatcaagctgagtatgaggcagttctcaaagggttacaattactcaaggaagttgaagccgatactattgaaattatgggggattctttactggtgatcagtcagttggcaggagagtatgagtgcaaaaatgatacattgatagtttatattggtggcaaccgattattttaccaagtgggtagaggcgattcctctaaagaaagttgattctggatatgctatacaatttattcaagagtatataatttatcgatttggtattcctcaaactattacaaccgatcaagggtcaatcttcgtgtccgatgagtttgttcagtttgccggtagcatggggataaaattgttgaattctcaccttattatgcacaagctaatgggcaagccgaggcgtctaacaagagtttgatcaaattgattaagagagagatttccgattatcctcggcagtggcatactcgattggccgaagcattatggtcctattggatggcttgtcatggatcgattcaagtccctccttataaacttgtttatggacatgaggttgttttgccatgagaagttagaatcggctcaagaagaacggagttgcaaaatgatttgacagccgatgagtattataatcttatggccgatgagagggaagacttggttcaatctagattcagagcccttgcaaaagttgctaaggataaggaacgggttgctcgacattacaacaagaaagtggtagccaagtctttttcggaggtagaacttgtatggaaattgattttgccgattggcactcgggatagcaaattcggcaagtagtcgccgaattgggaaggaccgtttcaaatctataaagttgtgtctaaaggaggttatatgttgcaaggactcgatggagaagtttatggacgagcgctcaatggaaaatacttgaagaaatattacccaagtgtttgggttaatgcatgatcggctggtactactgatacataatagccgatgtgtttgcattgccttgggatggccgatatggttatatcgcccttagttattttcctattgtaatcggttgtggtttgccgatgtacaaatggccgatattgttatattgcccttagttcaagatataatttcatcaatgccttcgacattgtaaaattaggggggcacatatatatgcaaaagttgcaaaatttttgagcaaattcttgagcaaaaacatggagttatattaatcggcataaatcaagacaagttaactacaagtgccagagtatcttagccgattacaaaaatttactacatcctattatagaatatcactgagacaagtagcgctagatcgccgatatagctctttgcctaatgtgttctacttcttcaatagcttgggtatcttgagcatcggttccagagatgacttttagggacttggtcatatcagcattgcattcttggagttgtgccaagagctcaatcttacgagcttcaagctgatcaatattagacttgatcgggccctcagatagctgatcaagcttggacttctcttcatgcacgagttgccgattggcctggattgtggcttcaatatccctgcgctcccgacgttcggctaatctcagcttggccttctccagtttgaattgatattgttcaagataagcagctggagtgaggacgtcggcatgttcttccgggatc

SEQ ID NO: 80483 - DNA, 1715 bp, Oryza sativa
aaaaaccagaggacaaaaagaaacgggtgagtgaaaacttgccttgggagatgggagaatgaatacggccgcagtgggcgcggggacgaacctgcgaggaggtcggctaaacgaccaccttgggggagagataaggtttccccggcgtggttcggtctcccccatcttgcggcgccgcttcttctttcgctccccctcgggctgcgacgtcggcacggcaccatccaggcgcctgctgctggcacgcgccgccccgccccctcggggaggagatggggaaggggtaccctcctgcttcctcttcccccgggcgtcggcagggtggctgcaccccgggcccccatcgtggggcccagaagcatgaccccctcccagggtagattgttcccccctgcggctcccgcccgcgccatcgtgacctcgaggagcccgctcctccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgccccgggcgcgccgctggagcggcgcaatctgacgatgaaggtagtcgccgtacaccatggcccctgtgagcccctgggatcgcaggcctgccaggcggtcaagaacggcgtcgtagccgtctcccagatctaccggcgcccgccagctgaaggcctgcgccgggggctggctcggaagtcggaggcgcgcttcgtcggcgaggggagtgtagaaccagtcgctcttccagtcgtcccactttttgcggagggcgcagggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacagaccgctccgggtagtctggcgccgggcgtccctcgcccagcgtgactatctcccggccggtggcagattccggcatgaagcggcgcggcagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctactcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgt

SEQ ID NO: 80484 - DNA, 7593 bp, Oryza sativa
agcatgttctttgttgtttggtaaactatgggtatatgataataatggtttgcataattttgttgctaatacatacacatttagacataatggtcgaaaaatgaaattggaaccataagcttttctgaaattttcaaagatgatcttgaaaggttgaagaatagaatcaatgagactttcagagataccaggaaagatactattgtgatgccttcaactaagtctgagttattacaaaacgaacgtattattgtgcatattgctttggatactaatattttgcaggcatctgagaacaacaaaggtaatgaggaagagaagaaagacgaagaggaaaaaaacctatacatagctccacgcatgcttgaggaatgtttaattgaccaagtgcctacaatttctgaagatgagaaaaaaggtaaagataatggtgctacaagtgctcaaggtatgcatagttataatgtgccaactatgtccactacttgtgctaagttagagcaacccatagtggaaacaattgttgaaatacctttgtcacaaaacaaattgcttgatgtctcttgtgataaagaagagttgtgtgatgctacacttatatccatggcacaactagtgaatgaacatgttagttctatagtagagccacccagtgttgagtttaaacatgttattcacattgctagcgagaatgaatagcttaaattgctatattctttaaatacttggggttctattcaatttgatgatttttgtccactcaactatttagagaagaaattatttgctagatttgaattgccatgcccttctgatgtgatttttcatattattggcaattatgatagtaaaggagaatataatgtgcatcaattatatatttgttcgaatttaactatacttccttttcatgatgaaatgtcttgtctagaggaccgcatgcatataagtaattaactatctagttcctctagttatttaaatgagttacaggttggtttgcaagaaggggagtgttgtagtttttcgactacaaagattttaggatccaatcatatggacatcaagaaatgttcagcacatgatattgtgatagacaaagataagtgcaatactctccatgacaaggtgaaactgaggacggtttctaatcaagaaggggaggatgataaggacacaactagctcggatataactatgaataccttatgtattaatcaaccaaaggtgcatatgttctacattatatttacatgttatatatttgaacaaacgttgctacacaatgagtttcctgtgtttttgtttgcagaggttcttgcttgggcgaagaaaaagagaccgagcgtaacgaattcattgatgatcaaagaagttgattggggaccatatcaaggccttcttcaagtccacttccatctcatcatgtcacttttggtccatagaagacaagagataaagttctacacgttttggattcggattcgggcctcctgacagcatcaatttcaaacagacctagccgctgatctagaaggaatttcggggcccatgagtacttgttggaaagcttatggggtctactttcagattgttttggttccacgtcaaaattcttaccaagctgccgggaatctgcaaaacaagccacgtacctcatctagtccgaatctgatttgggttttgggccttgatattgtgtcgtgggcttagcccaagggggtgtgcgccctagggcaaccctaggacatccctaatcatattaattcagtagccttcatcgtttagagttgggttttgcttagattattctgtcaagaatagtttcgccgctagatcggtttttggaaccccaaattcaagtgcttaatcattcatatgcaatttggttcaatctatcatgttattgcttgtgttcttcgattcgcatgcaagtattagccttctcggtgaggtcaaccgggtttcggcacggttcataaccagaggagacgtggtgctgcgattgcggggcaaagtagcatgtttgttcagaagccggattgagttgtgtcgcgacaccacccaaatcaactgtttatcaatacctatcagaagatcaggacctaactccctcatcagttgcatatgtatatgttttgaaacatatatatatgcataatatattgcaaataaaaaaactggatcaggctgagccatctttagtccctgttggtgttaccaaccggaatcaaagatcgatctttagtcccagatttttcacccgggataaaagatagtgatctttagtcccggttgaaaaaccgggactacaggtgtcgggtcccaaaactaatgacatggatccgacaatgattaatgtatcatgccgtagatcagtaaatatttgatacatataatacagctggttcttcattgcatatgtaaagtttacaatacttgggatttacaaagattgttacttaactaattatacatagggttactattgtacggcggaagtctattgtagtttgactaggaaggaacaaactctaagggttctctaaattatcagggtcgtcgtagtagtacgtagtcataagggtcctcctccggacccagatgtcaaaaagggttaaattgagcaagggtgagtattcacaatactcagcaagatattgtggaaatatgttatgcatggatatagagtggggttcttttcataaagcaaatataggcaatctggtagattaagcaagaatttaacaagacacaattatcaaatttctaacaaaatattgtatgagtccaaatgctcaaaaccgtgagcatggctattcaaatagattcatatatactttactgtagtaaatgtacgctttacccacagcccacgacgtgccgataattatcagcttaagtcatggcccagcattaggttactaacaatagtggcacatgttccatgaactctagtccccatacgctctgaacgtacgttatcagcagtgtgaggagttctggcgttcctggggtatttagagagaactgattgtatgataccatgccatcgcaatcagggtttaaataaatcacgtgatataataattcatcttaaatatttacctgcgcctcggtaaatattaccattgccctgctcggcaaaagtttgcctactgcgcgaggacttaaacaagaactactatatacagaggtaccacattgttaaataacataataactaggtctgttcgcatcctagaaccgtggtcgtactcatttgttcttcacaagtatttcggtagtcttatgtcggttgaaacagtactagccacccggaaatcaaccaattctagcgtactgttccaatctaagtatagagcattataactagattgtaagcaaaataagcataactatattatctgggtttctatggttgaattatgcatataaaagagatatttgaaagaaagtgtataaatataatttattgaaatataggcttaaatgatcaagaggtgaacaataacttgccttgctcgatgtcctgagattgattggtaatattcaaaatctcataagagtcctcaagacctaggggtagccattcaaaaatcaagtttaaaaagaattcaaataaaatccaaaaatgggaacaataaaataaaatgataaaatagcaaaaatagactcagaaggtagagaatgaatttagaggaattttagtccaagtttcactggatttggatctatattttaaaagttatgggcttctaaagtttgagattgaaattaaattgagaaaaagttaaaaactattgtgcatggtcccaccggtcagtctctctctcttcttcttcttcttcctccggccgttctctatttgtggccggcggcactagggttggggattgcggcggcgattggagggggaagtgcttgcgggcggagaggggaggttgctagggttctccggcgacggtgagcggcggcggaggggttaatttactgtgtaagtggcatgacggctagggtggcggcagtatagaagagtcgtaagggcgattgggattgtggaggttaggcatggctcagggagtgtattggaagcatctctagtgtacttagaagggtttagaaagcttaacaactattgacaaggtgtggaaggcatacggccgcgagcgtctccattggcggccgtcgagctcacgtcggatgccgagtaggggttaaattagtgctaaaggaatgcaaaaacggaatctaggggatacgtagatgcttgaaacaaaagagctcactcagttagcttgaaacggtgagatgcggccggaaaaacttcatggcggcaaaaacaaggcacggcggcggtggcggagctcgatcgaatgcgacgaggtgaaagtcattgcagagcttcggcttggtttcggaatgatgaaacacgactagcagaaggtgttcggatggttggttaggactaggtgtggaggagaccgtacactaggtgttcgatcggcggacggcggttgtgggtatggtgtaagggtggaacagggattaggtgtagcatggttgtggtcgatggtgattgatgatgaatgagagagggtctggggtcctatttatagggccttgccgatcggatgagctcaggcgtggtgatcgccgttgatgagctcaaaagccaagcttggcagagatggcaggggttgtgagagggaagggaatgtcaatttgggtggcgggagaggatgtttgaatgtttgacagtggctgcgtggctttaccgggggtgaaaatggttggcggcgtgctagtgccgttccgggctcgacgcacggcggcggcgaggaaggaaacggttggttcaacagcggttggttcgattcatgagagggaaaagttactgccacactttaactcaaacgcgcggcgaaatttggcagtttcatccgtggtagaggcaaaatcgacctcagcgttggaattaggtgggcgcacatgacggcaggcggtggcaaggctgcggcggcggccgtcccagattccatggtgttgacattggtgtggtggcggtgaattagggtgcactggacggttattggcgcgccaaggcgatcggacgcgcgcggttggccttgagaccgacgcgcggcggcccaacacgcgcaacatgggacgctaaagtcgagcggcagagggcagaaaggtgatgcaaagtcacggtttttagagggttgtggtcccctaggatctaatctagacattgcaaaagttgaggtggagattgggctacccgggctgggctagacatttcatcgagcactttgtgtgcgataaaccgtacttttcaggaatttgaatatatttggctaaaaagagaagaatttacctagggtctttgaacaagtttttctaggtttttgaactagggcatggttaggtttcaaaatttgaaagaattttactagagacactagggttttaagttaggacaattattctagggttttagaaataaaataaattggagggcttctaggagtaattcttgaaccaaaattaagaataaaaaggagagctttaaggaagatttgaatgtttaaatcaagattaatataagtcaaaagccagcatgatgtagtcaaattttagtttaaaatttcagtatgttacaacagggggttacaaaccgggactaaaagaaggtttctcaaccagtgaacctacacctaacttacaaaaccaatacaaacgaggcccctcaacagtattatccccgcttttggctgaaatggcacctacgtgattccttttactaggtcttcatcccacgtgacattgacatggtgcttacaagacagtctgataaaaaaaataaaagagcaaaattgaaaactaaaaatttaaaacaaaatatacagcacccacatgtcagtcaaacaaaaaagtaaaaaatagtgggacatgcatgaccctctccacctctatctcctcgccgactggatgggcttcctgaaccgtctccaggctgtcattgcaacggaacatctcaggcggtgcgaggctgccacgggatagaggagcggtgcacggcggctagcgggagaggaccccggggttgtcgctggcagagagcagtgttggcactgcccgagtttgcctcttgaactgtatcttcctcgcgcgtcattggtaggggtggacaaaaagctcgaaactcgtggctcagatcggctcgtagcaagctcggctcggatcgattcgaactcgtagtcttaacgagtcgagtcgagctagccttttagctcgtgagcttaacgagctagctcgtgagctactcgtttagctcgttagtataaaatatcgccacatcttcatgaacttagtgtttgttgactagtgcttagtcttttaattacatcaaaactattcatatttagtgagtactatattagttagtgtttattattatgttaatacataataaaatgttaaatttgaaactattaatatgatattaatgagatatagctcgttaacgagcctaatgagcttaacgagccagctcgcgagccgtgccgagctacccttttagctcgttaacattaacgagccgagccgagctagctcattaagacaacaagctcaaacgagccgagccttaacgagccgagctggctcgttatccagccctagtcattggtgtattcatcgcccatgtcgtcgctgcgagctgtctcctttccctcccagactggctctaccaagctcgccggaatgtgggggagaggagaggcgcagggtggccgcgcaagagaggagtggcgtggtgacgggagagaggagtggcgcagcggcgagggagtggaaagaggagtggccacactcctttccctcctagatcgcctccccctcggcttgcctccccctcggctttggctccacaaagttcgctggacggtgggggagaggagcagcgtgcagtggctggtgggagaggagcggagcgcggtgcggcagcgagacaagagtggcacgccatgtgggagtggtgtggagctatggacagctaatggaaatggatcttcgctggcggccgagttaagagggccaccagcgaagatgtacaccttttcgttggctgcccacttaaacgtccgccagcgaaaatagcgaaaattcgatttttgcaggcggctactatagagcatcgccagcgaaaaatcttgccacactaaaataaggcaacattaaaaagacaacccatggccatcgccacccatcggcaacgggtccagcggcggtgactcttgcaggcggtgactcagtgacggacgagggggctcacgaaggtcgcggcagctgctcgggaaggcgacggcgaggagaacaactccaccgcaggccacaggttggacgccgatgggccgcggggagaacagatccaccgtcgtccgctcgtgggggcacggatccgccgcttctaggcttctccaaccccctcccctcacccaggtttggcaagcggcgggtcaggtcgtggactttggcgagcgacatcatgggccgtggatctggccgctggaggtgcgcgggaga

SEQ ID NO: 80485 - DNA, 2972 bp, Oryza sativa
tggttagggaaacaagctaaaacttgagctcggctcggctcgtttcctggcccgagccagctcaagctggcttgcaagccttcctgttgaaacacctctctatatatattttgtaattattaaaaaaagcaagaacaaatcattaacatgtaaaatttaaataagtttatatattcaagtctacaaaatcttaatgataaatttcaagtggataaataataacgccatataaagtgaaataatcgatataaacacacaatagtctaggctcgcgagccaaaaacaagcggctcgcaagctatatcggcttgactcatttcagcaacgagctgaaaaggaggcttgggcttggctcgtttggcttacgagccgaaccaagcctgagctgagctcacgagtccgagctttttatccaccatcagtcggagctggccttcctcacgcggctctaccacaagcaccttgtcgtcttcgttggctactgtgaggagaatgacaagcagctgctcatctacaagtacatgaagaacggtgtgctcaacatcacttccacgatggcagctcgatgacggcaacttagctccggcaacgcatatgttgatttggacaatgatttgggattgtcattcgggatttgggacaatgatttgggattgcgattcgcgatttggaacaatgcttcagaatttgtgaaactgttttggacctgaattttcaattctttattttttctccacaaacgttttcgatggcgggtctcttaacattgctgccagtgcggccatcttagcttcgctacgaaagaaaacccattttcgctggcggctgtcttagcatggccgattttccatggcggcaggctgtccgactgcacaaatgcattattttcactggcatttggtccccggcggcaccgtcggccgccagcgaaaacccaatttggcttttggcaaaaaatcattttcgtagtagtgcctctcatactcaaattcacatatggcccttaataggattaatcccaaatttgctaccagccgcatgcaactatgtaatcgtagtttgatatgcgttagctatctcctaattgcatttgctggtgcactcagcacaatatataattttcacggactagtttaaattccactgtaccggggtaatggttttggagaaacctgcacgaacaaaatacagacactatagatggacaataacccatgatatagagtctacacgcaagtctatatggttcagacgatatatcgtataatatacaatagtcatatatgttttacacttatgcagatagacttaacatgttcaataaaatattagagaactagcaatgctgggataacggatgaaaccagagtagtcatgggccagagggaggtggtagagcaaggtccacggtgataactagctgaggagagacggcgtgtcttcgtggcacgtcgtgtctaagaatagtggagaggggttttaattggggttaaaaccttagctatatggtcctccataaggccactaggttttagctcctgacataccaatagtgcatattggttctttggctagaccatggtttaaaccacaattttatggtcaacactcatttttgatgttgtccaattaccaggtcaacacggtataacccaatcattgaccgattagacggacaaacaggctaattgacggtttatgccctaaactggacgataacccatggtataatgtctagacacggtctagaccgtctatactatggtctagcgaacacttgatacttcctccatcctttataagaaaccaaattttatctatatatccaagggagtaacaaattaagtggtatatatatatatatatattgtgtgaacacgtcccatattgcattttttgtagcggcaataaaaaaaagtagttttaaacggtatatattgtgtgaacgtgtcccataataagtatatttttggcagcaacaataaactcttgttttcttgagctggatacacccacacgtacgtgtaaagagtttcccactttattatttgacatttagctattttctaattaaagcttttacagcctttctggagcaacctgttcactgctcacaccacagtaaatgctagccattttcagcaccactcttcattgtcaccaacgggcaccttctgtcttcaccacagtaaatatttgccattttctgctcagatatagatatatatgaacgtgcacctacctcgttttctcctggatctaccccaaccttactccaaatcctctcttcttgctccaaatcatctcccttctgtctctccttcccttcttggtttcctgcttctatagacctagctagggcagccatggaggggaaaccatcaggtcttccatcttctactggtggcaaaggcaagggtgtaccagtagtaggagctaacccgtggcattcagatgacggctgtgatggaagcaagagtagcagtgagagagagaactgtcaccgatgattatttcggaatatttgtgcatcctgttcatggtgatcaggaggtggattctcgtaaggctaatcgccatgaagcagatcattcagaaaccgatagcgagagaactggaagtgctggctttgggaagatcgcaaatagtgcaggcaattctcgccatttctcatatgtagattctgggttgagcccagaagaaaaaaagacagaaaagtgaaaggtttcaacctgaggttcgtgaattcctatcatatcctgattttttttgtgtgtccatgatctttttatagttcatcaaacaaaaggaattgcaatgcattagtaatgatgagcatatcaaacaaatggtgctttatctcagttattctcgcaatccagttcaatgtgatctcctgggaaaatttttttttactagaaatgatcatatcagctctggttcagccatagcggcaagcaaaacagaagtaa

SEQ ID NO: 80486 - DNA, 16299 bp, Oryza sativa
aaagatacaattgatgaaatttcaagaaaatcatatgcactcaggtgtagagcagcacagtgatgtttgagccaatatttcctatgacattaattaatttaaaacattcacgaaaccttgtattgaaggacggttgatgactctcacaatcgttatatactttcagaggattctaagtggtggcagcgagatgcagactccaggagcgaatagttatggagcgaatagtggtcaccagcgagatgcagactccgggatgtttttgtcgttctcagagaaaacacaagtgcaaacaaataaggatattcctgaatcatggaaggttcatccgagaaaagatgaggttgatccagatggatgggtcgtcgagatccatctccgaaatgatcaaaagaccaaggacaaggtttgtgaattcatgttatatgttgatcgattatatttgttccacgaattttcatgattgattaaaagagttacatgtattctttcccaattttatgagcatatcatgaaagaagttttttttaatatgtgcttcgttagggtggatatcattgttttggggaaagataaccagccctatcataaatataacaagtagtacatatgattctatatcttcgcagcatcaacatttctgaaagtcttggtgattgtacacatgaaatagaaatcttagagatcggctgaaaaagataaaatgtacaagagttcttgacatgaagatctcctttgggtgttatatgtattatttatttctttgtattaaaccaaacatgtgtacacttttaaaacatttgtactttgtatatctacagtataaaacatgaaacatggaatagttcaaatccaaacaggtttagtagttcattaaatctgaaggttaagttctatcttgtctagcaaaaacacttgttatgctacagttcaatcatggtaattaactacttgcattgatagcatatatctggtgggatatgatcatatctggccaatatattacattgaaccatgggaatgcatagttctttacctagtaatgacttgtggcaggattgagtggtttgtaaaatttcattcctttttaatacatattcttgtttatatgacatgataatttgtgtggagtgaaaaaagagttctatcacttatggagtgttcacaatctgtgttataatactcaatgaaaacataggtgtcattttataaaaagtaatatgtacaaattaaaccaaacaattttatgagatagctacctttagtataattggcatacagaaattatatttgacttttatttttcatataatcactatcaaaacaaagtatgttgcacatcaataatatatcttcttgctaattcattaatctcacttatcagttctaacaatatgaaaagccagaacatcacaaatttaatttggatcaaaacctctatactgtgaatcattaattgcacctagctttgggtgcctagctagggtcatacatgtgatgcaatggcaatataagtttttccctcccatccccttccaatcaaagagaaaagaaaacaaaaaatgcagtttggattttgctgaaatatacttgcttatactaaatttattttgttgttcgtatgttaaatgaaattgacttttttcttacttcgctgtattaccgccacaaggattacaatcataaattttgctcaaagcctgaagttgaattttttctagatactggaaaggttataatccgtaaagttccatgtattctacagaaggtgccctactacaacagagttgatttcaaatactgtattctacttctacataatctctgtttccaaacttgatactgattctcatacattgtgtctgtacagagatctgctgatgcaagtgttcctagcaggggtaagatatcatcaaactgtgcaccttggaattaggaataccattgcatttttactaatcattgtttggcgaatatgagttgtgttttagatgaattatatacgggtagaactgcagtatgattaaaatatatatttgattgaactggatcagtactactgacagaaacaataaatagaaaaaaatacatattacaatatttatttatatatatctacatatgtacaatcatgatattttagattatgttcatcttgctagcttgtatatatttttaaaaatttaagcaattttacagtttttgaggagataccatgaggtaccactttttctattgtaaatttagtacctcttagtacttatgtactatgaggtatcaaattttacactaaatttttttttaacatggtacctcctcaaaaaccgtaaaattgctcaaaaaattttgtcactgctaaggagaaacgttgctcacttaatcggactactatgacatgtgaacacaggtcgcggtcgtggcagacctcgtacaacaaggacgatgaccctaaattcaggtaatgtgcttttgataacagaattttgcattgttgttttttcttaaaatatatttactactcattgttagctctggatagtgaatcagaatgatatattttcattttattccatgaaacttgcgtaacataaaatgtggcccaaagtgaaatttcactcttaaacaaaaacaagatgaaacttttttttaaccagctgcaagtggtcgaacgattacgtgggtccgccggcggatctcacatcactaggatggtttgtatttcctgtgttgagcaatgtctaaaatcgtttaagcctgtgtttggtccacctctgagttgttgcactggcaactaattctgaaaagaccagtgttctacctttgtggcatgtgtgcttctttaattattgatgttttgcgataaagaatcttcttttggccagcaacgatttattatatctatatatattgttatataattgattgctgcactgtttcaattcaaaatattgcaggcctatatagtttgtttcagaaaagatttatattcttgttcaccaattaaatatgtctgtttcttttttacacaggttctggtatgtctgcctctggagggaaaggtccagaatcccccttacaacttccgcatagttttgtgtagtcaatgcgtgtggagattgtggatatcccatatctacacggcagttatagtttagttgggtacagggtaccaaatatagatagaatacctttatgaggattcggttagtttctaaactcgtatatcaaggaaatacccaggatcctagtcggttacgattgtattttatctgtaatcacatattccgttagggatatgtgttgtattttgtaatacggactccttcccctatataaggaggggtccgggtccctctagggacacgatttttctcgcagatcatacaatcaataatacactcggcggaatcatcctcggacaggagtagggtattacttcttgaataagaaggcctgaacctgtataaaattccttgtcttcaaacccatccacttttttagcttgatagccacccccttttagtattgccgaaatcttgtttcgacagttggcgcgccaggtaggggtagcgtcaagtttcttgccgatcagtacgatgggttccgtctccggcatcgacgacttcgtcttccctcccgggcaggcgtttcggttcggcagcctcgacttcatcaccaacgactttggcaagatctctcctcttgactcggatccaaaccagtcgggaaagaaccaggtctcagccccgtttggtattccgaacaaggccgagatctactccaagcttatctcgaccgagtcagcttcaaaccacacgaacgagatcccatctactccgacaccactagatcaagattgacggagcgtggggctcctcaccgggagaccgcgcaggcccccctttgccggttcggccgggggccctgggtgagactctaagctccttgtctgagtgtggaaggttcgcgagagcgaaaatacacgagacacgggcgatgtatacaggttcgggccgctgagtagcgtaataccctactcctgtgtttttggtggatcagtgtatgaagaagctacaaaatgccagcccccgatcgttctaggatcgtttttctccctctttcatccccctctctaagtgggcaaggtcctccttttatatctcaaggggataccacatgcaccatctctccctctctttcttttgcctggggactcatcctctcttccctccaatttgacttctcttcattaacggacggagatttgcatcgctgtcgtccgaatgaccttctgacgggacggcccatacctacctccacttccgccggaggcaggcgcgacgtgggaaaatggctgtctgctgatgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccatgatctgaccggtctgtgactggtcacagaccggataaacgagcgcgctgcactgcgttacatgcggcgtgaggcgctcgtcaaaactgcaataaatgcggttaggtgagccccgccatgctcacctaccccatatacgcggcgcaaaacccacaaggggtcggggcgcctcggccctcggggccgagacgggagcggtccgacccctcggggagacaaagagaagggcggctgtatcaccctcgggcccgacccccccgagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacagtatcccccggcgttatgccagggcgatcgccctcctcgagggaagcggtcgggcgtgacgccacttcctaaggcctggtgacaggtggggaccggtctccacagttgggcagaaacccaacggccacaaatcacgcacatcggcaatggttactcggctgtcaataatgagcggtctcttcaagactgccacattactcgagtaacacgcgaatcgggacgagccgattcgttttgcctggagatatggtgatggcgcttcggtcggcgcgcgcacaagatgttccatctcgactgccacagccgcatatccacctcatacaccgcaaactggcgaatgggattagtggaagcgtgggcgcgggaaacgagggggcaagatagtgggcgcgagaaacgaggagccgggcatagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgttgccgccttcccgcatcgtgagcgagagacaggccgggctgccgcgccgcttcatgccggaatatgccaccggccgagagatagtctcgctgggcgagggatgcctggcgccacgctacccggggcggtccgtcttcttcctcccttttgctatggcagggctggttccgccattttcttctttcttcatggatgttctggagttttacgatctccagatggcgcacctcacccccaacgcggtcatgacattggccatcttcgcacacctgtgcgagatgttcatcggggtgcgcccatcccttcggctgttccggtggttcttcaccgtacagccggtgtcgccgccgtcggtggtcggtggctgctacttccagccacgggggccggtgctgaaccgctacattccctgcgccctccgcaagaagtgggatgactggaagagcgactgtttctacactcccctcgccgacgaagcgcgcctccgacttccgagccagcccccggcgcaggcctccaactggcgggcgccggtagatctgggagatggctatgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggagtcagatgggactgggctcctgaggacttcaagatattggtccaacgggtgctgaatctcagctccgtggaggcatccatcattcctcaaggagtcctccccctctgcagcgctccagaccgtgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgacgcccgggggaagaggaagcagggaggaacccctcccccatctcctccccgagggggcggggtggcgcgggccagcagcaggcgcccggagggggccacgccaacgtcgcagcccgaggggaagcggaagaagaaacggccccgcaagatggggggacagaaccatcccggggaaacctcatttcccctccaaggtggtcgtgtaatcgaccccctcgcaggttcgtcccacgcccatcgtggccgtattcattccctcaatgcgagttttcactcatccatcttgtttgtcttctggtctttcttctatttcagcgagatcccgtcgcgtccctcccgccattccaagtccggccagtctgaggccgaggacccggcgaccacagaggcccggaggcgggaatctgaccggcgagaagccgcagatcgccttcgggaagccgaggaggccgctcaggaggccgctcgggctcgccagaccgaggaaaccattcgggaggaggccggactccgccaggccgagacgacgacatcctccgaggcgacccgtgaaactgaccggcaagaggccacggatcgccttcgagaagccgaggaagctgcccaggtggccgtccgagctcgccaagctgaagaagccgctcgggaagaggccagacttcgccaggccaaggcggcaacgacttccgaggcagtttgcgacgagggcgcgggcgcatcgcttgggcccaatccctcgggcgacgctcaggacaagccaggtccgggggacatccctgagtccggcacgtccctcggcgggccgagccgcgcggcatcctcaccgaggcggctcttccccacgccttctgttgctccactgagtgcagaacccttctgcaggccttggccgtcgcaaacaccacggtgttggacgggttaagtgcccaggtggaggccctacaagcagagcaggcagagatcgacgccgcatgggcgcgtgtcgaagaggggcgacgctcggtggaggccatggtggaagtgggccgcaaggcacaccgccggcacgtctcagagctcgaagcccgtcggaaggtgctggaggagattgccaaggaggtggaggaggagcagggggctgccctcatctccaccactgtgatgaacgaggcgtaggacaccctccgccttcaatacgggagctgggaggcggagctagagaaaaagctcgacgccgcccagggggtccttgacgctgccgctgcccgagaacagcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacattggcggtgctcgaagccgcctgtgccgaagaagagtccgcgctccgcctccgccaggacgcgctcaccgagcgggagcgagctctcgaggaggccgaggccgcggcgcaacggctggcggacagcctgtccctccgcgaggctttgcaagaggaacaggcgcgccgtaatctggaagatgcccgcgccgagagggccgcgctgaatcagcgggccgctgagcttgaggcgcgggagaaggagctggacgcgagggcgcgcagcggcggggcggccgcgggcgaaagcgacttaaccgcccgcctcgcagctgccgaacacaccatcgccgatttgcagggcgcactagactcgtccgccggggaggtcgaggccctccgcttggcaggcgaggtagggcccggcatgcttcgggacgccgtctcccgtctagaccgcgccggccggcaagtgggcctctggggcgggcggactgcgaagtacgccgccaaccagggggcctcgcccagcgcctctcggagatagccgggactctccaacggctccccgaggagctcgagaggacgattaattcatcctcgagggacctcgcccgcagagcggtggagctcgtactggcgagttaccaagccagggatcccgacttctcaccatggacggcgttggacgagttccctcccgggaccgaggatggcgcgtgcgcgcaggtccgggacgccgccgaccatatcgtccacagcttcgagggttcggcccctcggctcgcgttcgccctcaactccaacgaggaggatgatgacggcggagtgggcgacagtggcgacgaggctggcggcccgggtgcatcggagtgagcccccaggcccccgccaatctttaaatagtttcttcttttcttcttccgaggccttcgggcccccttcttgtatagactaatttaatctgcaatcaaataaagaagaaatttttcgtgtcaattctatttgttgtgtgtatgagacaaggatgtttgtgccgcggttcttttgtgtcttggcttgaacaagggctcgtgcccaggtcctagtcctcaaatggctcgggtcggggctagtgcctggggagatccacatgccgagactggccaggccgggagcgtggtgaccgagggttatgggtgacccgattgcgggtttttgccgattcccccccggagttcaccacgccccggggcacggctcggttctgggccccgtttggcgattttagccgacccgagcccccgagggcaggattgaacacgagtgacctatttcaagtcaagatctttcaaaaggaaacaacagcacagatacagcctttaggaaatcgaaaaatgcttttattgaaatacatatataagaatatgcacatgtggtagcccccggccaaccctgcacgcccgaggggggcgcggggttggccccagcctgaaacctgacacccgaccccccttaggggtagaagcgacgaaggtgttcgatgttccacgggttaggcagctctgtgccgtcgctcgtggccagccgaacggagcccggccgggggacaccaatcactcgatacggaccctcccacattggtgagagcttgctcaatccagcacgagtttggacgcggcgtaggacgaggtcgtcgacgcagagtgaccgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcgattcgcccagagcaccgctggcaactcctcgatccacgaatcgccatgcttcttgaggatgttgaaggtcttggttttaaggcctctgaggatttccgcattggcgcgctccacttgaccattgcttctggggtgggcaggtgaggcgaagcagagcttgatgcccatgtcttcgcagtaatcgccgaaaagttcactagtgaattgggtgccgttatccgtaatgatacagttaggcactccaaaccgggctgtgatgcccttaatgaatttaagtgcggagtgcttatcgattttgacgaccggataagcctcgggccacttagtgaacttgtcgatcgcgacatacagatactcgaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgccgaaaggctttgccaaccaaggtgcgcgaggcggagtgggctccgtattcgccttcatggatatcggcaagaagctcgacgccttgttcccgaggaatgcacttcaggaggattccgttagccgcgcgcctatagagggtcccttctaccagcacgtagcgtttggaaatgcgttggacgcgttcactcccttcgcggtcctcgggtagagtcttatctgtgaggtatgcttggatctcagcgatccaagcaatcaatctaagagagctgggagcgctcccctcgggtcccgaggcctggactccgacgggcctcgggggcctgtcaggcgcgtccgtctcccctaaggggtcgggtcgcgctgacggctgggcaagcctttcttcaaaggcgcccggtggggtctgggctcgcgaggaagcgagccgcgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcgacggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagatagggagccgtcgaactgcatcacccagtgggcggtgtgaggcggctgcgaggggcccgagctggcctcggggactgagacaggctcgggagccggggtccactctgccacaaaatcggcgagggcctggctcttgatagcgtggcgtggttcaaagtgcaaatcgaactcagaaagttcaattgcccatttcaccacccgtcctgtaccctctcgattatgcaagatttggccgagggggtaagacgtaaccaccgtgacccgatgcgcctggaaataatggcgtagcttccttgaagccatcagaatagcgtaaagcattttctgggcctgagggtatcgggtcttcgcatcccggagggcctcactaacaaaatagacgggccgctgcacctttcggtggggccgatcctcttcgctaggggccatatccctggggcgctctttgtccaagcggcctcgcggggtgcactcgtcttctgtgccgacgacctcagggtcgaaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagttggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcgcggaatgaggattgtcctcatcgcgctccacaaccaacgccgcactaaccacttgcggggtcgccgctaagtagagtagtaagggttcatttggctccggggcgactagaaccgggggagagctgagatacgccttcaacagagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggggcgcatccgctctatagctcgtatcttctcggggttggcctcgatgcctcgggcagagaccaaaaacccgagaagcttgctcgcaggtacaccgaacacacacttatcggggttcagttttatgcgggcggagcggagattctcaaaagtttccgctagatccgagagtaaggtctcttggttgcgcgtctttacaaccaagtcatcgacataagcctcaacattacgtcctatttggctacccaaagaaattcgagtagtatgttgaaaagtaggaccggcattctttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaatgaccaccgggttcgccagccactccggatggatgacctcgcggatgaatccggcctccagaagtcgcgccacctcctcgcggatgaaggcttgacgttccggggcctggcgccgcactttctgtcggaccggccttgcgcccggccgcacggcgagacggtgctcaatcacctccctggggaccccgggcatatccgccggtctccatgcgaagacgtcagcgtttgcccgcaggaaagagacgagcgcgtcttcctatttgccatccagaagaccaccgatccgtgtggtcttggacgggccgtcgcccagggcaacctccttgaccgggacctcgtcgcatgtgactatccgctgcctcggggcggcgggggcggatgtgccaagcctctcgtcgccaccctcgggcttggacgcggcagcgaggtggtccgcgcgctgctccatacaagcaagcgcgactttgaggtcgccatggacagagatggggccaccggggcctggcatcttcatctggaggtaggcgtagtggaccgccgccatgaacttcaccaacgcgggcctccccaagaccgcgttgtagggcagactgaggtccgccacataaaagttcacccgctccgtgcggaagttggcggatccaccgaaggtgaccgggaggtcgatatgacctagcggccaagtgtgccccggcgtcacaccgataatcggctgggacggtcggagcaccatccctggggccttgatggcgtcaaaggctgcgggggaaaggatgttgagggctgctcctccatcaatgaggacacgccccagcttcacgttgcaaacggtgggggaaaccaccattgcgatctgtcctccccgggcaacgcacggagggtggtcggtctggtcgaaggtgagggcaacctccgaccaccgcgcccggcgcgtcgcctcaagagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctactgggagcgccggcctcgttctttttgtcgcccgcaggcctcccctttcgggtggcccgcgaagcgccctcgacggcgaggacatgaccctcgtcgtcggtatgggctgacctcttcttcctcctcctgtcacgccgccctgtctgagcagcggatccgggggcggtcgaagctgccacaccggaaccgaagaggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaggagtggaccgacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcatggagggctgatccctgcgtccgtgttgaggtgacactccggacgaggaggcgccctccgttgcgtggggagctcgccgaccattacgccggcgctcgatatcgatgcgggcatctggccccccacgctgatcttcctgggtcggaggcgctgatgaaggagtggcggccgaatggcgagcaacagccgccgctcgccgcgccctccgccttgacgacacggagccggtggtagcagcgccagaggtcttggtggtggaggaccgcccaccagcacctaggcgctgccgtgccatcatgaccaagttggccacgtcgtccagccaacgttgggctggagactccgcgtcagggacaatgggagggtgacgtaggagcgcgcccgcagcttggagcgcgccctggggcgtgctgccgtcaccgtagacgaggaggcgacgctccccatctcgccgcccttccccatcacccgtggatgtcgaagtcgcggatccttcgaccctctcgagcgcctcctcccgcctaggactttggcgtggagggggcggtggagtgcgagctcgacggcgtgggtttggctccccgtcatcaccgctaatgctcggagagaggttgtgcgcctttgcttgttcggccattgggctgaacaggaaaagcttggcgcacacgaaagagtgcgagagctcagaagatcactcgcagagccccctacctggcgcgccagatgacggagcgtggggctcctcaccgggagaccgcgcaggcccccctttgccggttcggccgggggccctgggtgagactctaagctccttgtctgagtgtggaaggttcgcgggagcggaaatacacgagacacgggcgatgtatacaggttcgggccgctgagtagcgtaataccctactcctgtgtttttggtggatcagtgtatgaagaagctacaaaatgccagcccccgatcgttctaggatcgtttttctccctctttcatccccctctctaagtgggcaaggtcctccttttatatctcaaggggataccacatgcaccatctctccctctctttcttttgcctggggactcatcctctcttccctccaatttgacttctcttcattaacggacggagatttgcatcgccgtcgtccgaatgaccttctgacgggacggcccatacctacctccacttccgccggaggcaggcgcgacgtgggaaaatggctgtctgctg

SEQ ID NO: 80487 - DNA, 22775 bp, Oryza sativa
atttggctgccgtcttcactacaagggcgtcttctccccgtaggcctaggcggaagtcggcttcaacaccgatcctgcctagctccagggaagtcagtgtcatactccagccactcggcacggcttcgacggatcaattggaaggctacttcagctctcccggcgtcgactcgcgaccaacaaagatcgtggagtacgacgaattcggctaccgctacgacaaccgcgacctcgacaacttcgacgaaagcttggaagacaattacacccctctctacttcggcgtcttcatggccgacaacgagacggaggaacaacgccaagcccaagaagcagaagcaagacgcatacagcgggaggccgagcgacgccgactggaggaggagcgccaagcgcaagagcaagaatggctgcggcgagagcaacaagaacgcgagcgggcagcaaaggaggccgaggaccgacgacaacgagccttggacgcagggcgacgagcgcgagatctcatcgggcagcaagacgttgaggggacagcggtcttccgcaccccttaacagaacgctgtcgctgcgatcacccttctcgacaccctcctcaaggaagacgcactcaatcaagccgatcacgtcgtcaacatcttgaaccagactaagaccatgatcgcctcttcggtcccggttaactccgaaagcgtccgcacgccgactggcagccgggctccccatctccgatctcatgattatctgtcgggtcccaaaactaatgattcggaaaccgacatgtttaactatatcaagccctggatcagtaggttgatacagcttcaacaatctggatcgtctttgcatacgtttagacatagctttgaaggagatattattacataaagtaatatggtatttacgagattgtggctaactattacagcagaagctttaaaatgacctaactctgctgttttactatagacttaaaccatttaaattacctagacttgaagattaagttaaaagggaactaacttatgcgattgaactcctgacttcggcaagaacatcaaatggactctgagaaaggaggttgaagcaagggtgagtacaatgtactcagcaagctattatatcaaataatgaatgcatgaagtagtatttaagtagatctaggtttactggcagaaagctgagaataaagaggaagaaagcctgggatgtctttatgcaacaatatttagtaaaatcttgagttaagtttcgaaccaaataccatatgagtcccgatacttaattccgtgagcacggctattcgaatagtttcatgaatactctactgcagtagatatacgctttacccgtagtccacgacttgccaatattcattagcttagtcatgcccagtattaggttactaacaatagtggcacctgttccatgaactctagtccccatgcgctctgaacataacgttatcagcagcgagaggagttctggcgttcccggggtttttagagagaactggatgagagaccccatgtcatctcaaccaggttttcacaatatacacacacagcgatcgcaatataatcaacatatttacctgcgcctcagtaaatatcacatttgcccttcgcggcataagtttgcctccttcgcgaggacttatataagaaccactgtacagaggtaccacattgttaattaacctaataattaggtctgtccccattctaaaagctgcggtcgtactcgttcgtttgacataagtatttggtggcaattttatcgatcgagacagtactagccacccggaaatcaaccaaatcttacgtattgtcccaatctaagttcattaaattttatgcatattctaactaagcatggctaagcaaaatctagcatatatctggtttgctatatgttcaggttatgcattcaaaatcatgaattactaatgcatagaataaagctatagagtataggataattatgctcaaaggagaggaataataacttgccttgctccaacgcaaataaatccgagataggcaacctgattatccgatgctcgaaataccacaggttgccatccagaataaaatagactctatttaagaagaggaagaaccaaattcaataaaagccataaaatagcaagaaaacgatgaaaagcgagaaaggctgggtttggggtataactatctccttaatgggttattgagatagtattttatgcgtaggctctaatgggttggagattaggttggagaggggatcaagattaggctttggtggaatagtggctagggtttagttgttctcgagtcgatgctgaaatagcatagcatatcggctcgcatttcatgtttaaactatgggtagttggagggtaaatggctgatatggagtttggatggcaggctggcttgggtttcatttgattaagccaatatcgaggtaggatgactatcggctgggatttgcgtgtttgctagtcgtcattagaattgggtagtatgacgactaggtttggtgtctagccgatgtcaacagacaatataacggctagaaggataggaagtttgtgtaggtttagcggggtggaagtgttactcggacaaccgtgagtggcggcggagcggctaggatcacacagagcttaaaagctaactgtgcggcgtgctatggaggtcgagggaaatagtgaagctctgctcgttatacgcattgaggcgtaaggtgtcagaagcaacacttcgaccttaggtttgggttttgtcggactttacaaccaatggttcgacgtcggggtcagaaaaccgtgcgaacgtccccatggaaggtgtaaagttccaaccaatggttgtttagtggctaaacggtattttgaaaataaaagtaaatatttgaaaggtgaatataagtttcaattataagtttaaatcaaatatttattcaaatgatatttgaataaattaaagaaattcaaataaaatcttaaaatagcaaatttggtatcaaaaggtagggtttgaatttagataaatttaggtccaagtttcactggaatcggacctacggtttaggagatatgggtttctaaagtttgggttttgagttaaataaagaaaatgcgaaatagtactgtgcaggggcccacctgtcagtatcttttctttttctttttctccttcttcttcctcccgtatcctctctccttctgcttcttcttccagccgaacacagaggagagggagacgaggggcgccggtgctctagatggcgggggacggagacgttggcggggaaacatgttcccgagcgatgctcacccaaggaggcagtcggctggcaaagggagtgagggaagaggccggaacggcggcggcaagtgcttacctccggccgacatggatggtggtggtgatggcttgattcaaagggggagagaagggggaaaggggcaaaatggattcaccacatcgaggccgagctaatggcgcaaggttttgggatgtagggctgtggaagaggagatcggccggtggcaatggtggtggccggtcatggaggagagagaagaaagagagagatagctcggatggatggaaaaggaggagggtttctctggctatttataggcgaggagaggcggtggagagaggcggttctggagacggtcgacggcttgaccacggcgatgctggcgtgaaggaagaaaagacggcgccgattacttcgtgacgacggagggcgttggcggcggcgtgcgcgtgcacggcatgcgcgcttgcgggaggaggaggggcggctcagctatgggccgacttgggccgcgcgagagagaagaagaattcggctcaaagttaaaaaggaagaagtctaattttcctagagattcaaataatagatttacaggaatttggatggctagattttgaaaaaggatttgaataatttgaatttgaaggaaaattgactgagagagagtttagaaggaaattatatttgaatataatttccaaaagaaatatttctctagttggtttgagtgcaatattttggagagggagtttatttaatgcactcaaatagaaattcaaaatattcaacaccataaataatttggctctagatttgaatatttttgagtatgtggagggaatatggagggagtagagtaaataaatttttagcccaaaatatgtggtatgaaatttagagaattagatatgggctaaataaggttttggatttgggacggagggataaagtctattcacttagcacaagatcaattattcacaatatttgtaacaatattattcttgtgccaaagaggaaatcaagccacagagattaaattggtggctagatcaaaaggagtcctatttggatatttggattgagaatcaaaggatgggtttaagatcaaaggatgggctaacaattaattccaataaaatcggaattgctttggtttaggttctagcacaatataggatggtttcttggaccataattcataatagtaaaaagggtttttcaaactaaatttaaataaaggaaattttaggcgaaagaaggttttagattaaaaccaaattaaggaatatttcgagataaattttaaatgaaaatcacaaaggcttttgaatatcaaagagggattttatgcaggttagctttaggaggtctcggtaattatattttcctaagtttaaagaggtaattaagaacataaaacccggcatgatgcaagattagaaaatagctaattttcagtatgttacattatcaccagccaagcctcagcatcgccggcgcaggatccaatcgcaggagcaggggccacgacgagcgatctgttcactcgcctcccgagcgacacaaggagcgccgagttgaacgtcctcgctccccacttcgccggcgtcctgtcgatcttcgcgatacgatcaaccagcgccgtgcagcacgaggtcaatgccattcaccagatcgctacgacgacgacatggatggagtatctttactaacgacctgcgtcgagtggattggccagccggcctcaagccaactggaatcgagacgtatgacggcaccaccaatccggagtcctggcttaccgtctacggtctcgcaatccgcgcagcaggaggagacagcaaggccatggcaaactacttacctgtggccttagcggattctgcccggtcctggcgccatggattaccccgtggcacgattggatcatggacggaacttcgtgaccacttcatcgccaacttccaaggcacctttgaacgccccggcacacagtttgatctctacaacgtcattcagaagtctggagaatcccttcgagattacatccgacgcttctccgaacaacgcaacaagatctccaacattaccgacgacgtcatcatcgccgctttcaccaaaggaattcatcacgaagaactagtcggcaagttcgggcgcaaacctcccaagacagtcaaacagatgtttgaaaaagccaatgagtatgccaaagacgaaaacgccattgccgcatccaagcagttgggtcctacttggaagccaaagaaagatgcgccgactacgggagagggtggaagtaacaatcacaaggaccgcaagcgtaagcccgaggaacttgttgcgactactacacactcctcccgacaacgttcgcgcgtcaacacttttgacaagatcatgaactcccaatgtccgcatcatcccaactccaaccacacagctaaggattgcttcgtctacaagtagtttgcagagcaatatgccaagaatgcacagaagacctctgacggaggacaaagcacgtcgaaaaagaaggatgatgatgatgatgatgccccgacaggtttttaggatcaccgcaaggagctcaaccacatctttggcggccctctagcttacgagtctaaaagaaagcaaaagctgacagaacgggagatcaacgctgtccagcccgatacgccctagtatcttcggtggtcggagaaaacaatcaagttcgaccgctcggatcatcctgaccgagtggtccacccggggcggtaccccccggtactagacccagtggttcgcaacgtcaagcttcgcagatccctcatcgatggtggcagtgcactgaatatcctcttcgccaagacactggatgacatgcagatccctcgcaccgagttaaagccgagtaacgcgcccttccacggagtcatcccagggttatccgctatgccactcggccagatcactcttccagtcacctttggtactcgggagaatttccgcacagagaacgtctgcttcgatgttgctgatttcgagacagcgtatcacgccatactcgtacacccggcgttagccaagtttatggccatcccgcactacacctacatgatgatgaagatacctggtcctcgaggagtcatatccgtacggagcgacatcaaacaagccgtcacatgtgataaggaaagttgcgagatggccaaaacccgcgagatcgcgatagctcgagaagacatccgactggctacaaccacgtcaagggaaggagaggtgcctactaccaaggtctcaaagagtggaggaagcgaagccaagaccaagaaaatccccctagatccttctgatcctactaaaactgctgtagtaggcgccgagttagattgtaaataggaaagcgcgctcgtcacctttcttcaaaataataaaaatatcttcgcgtggaaaccatccgatatgcctggtattcctagagaggtgattgagcactctttgcatgttaaggaagacgctaaacctatcaaacaacgactccgccgctttgcacaaaacaggaaggacgcgatcaaggaggaattgaccaagctgttagcagcaggcttcatcaaagaagtccttcatcccgactggctggctaacccagtcctagttcgaaagaagaccgggcaatggcgcatgtgtgtcgattacaacgacctcaacaagtcttgccccaaagatcctttcgggttgcctcgcattgaccaggtagtcgactcgaccgccggctgcgagctgctcagtttcttggattgctactcggggtatcatcaaatccgattgaaggaatccgactgcttgaagacttcgttcattacgcccttcggggcctactgctacattaccatgcctttcggactaaagaacgatggagcaacttatcaatgcatgatccagagatgtttctcaactcaaattggtcgcaatgttgaagcctatgtggatgatgtagtcatcaagaccaagcagaaggatgatttgattacggatctggaaaaaaccattgcgagcatccgcgctttcaggatgaaactaaaccctgaaaaatgcaccttcggagtaccgtcagggaagttgcttggatttatggtgtctcacagaggcatacaggtcaacccggagaaagtcaacgccatcctcaacatgaagccgccgagttcccagaaagacgttcaaaagctgactggatgcatggcggcgctcagccggtttgtctcacgactcggcgagcgggggatgcccttcttcaaactgttaaagaaaacagacaatttccagtggggacctgaagcacagaaagcctttgaagatttcaagaaacttcttactactccactagttttggcctcaccacacccacaagaaccgctattactatacgtatcagccacctctcaggttgtgagcacggtcctggttgtcgagcgtgaagaagaaggccatgttcagaaggtccagcgaccgatctacttcgttagcgaggttttggccgactccaagacgagatatcctcaagttcagaagctgttgtacggtgttctaatcaccgtcaggaaattatcccactacttccaaggccactcggtcacggtggttacatcgtttccactcggcgatatcctccataatcgcgaagcaaacgggcgaatcgcaaaatgggccttaggactgatgtccttggatataccgttcaagccgcgaacttcggtcaaatcccaagctttagccgactttgtcgccgagtggaccgagtgccaagaggacacgcccgaggaaaagatggagtattggactatgcactttgacgggtcaaagagactttcaagcactgggccggagttgttttaatttccccaactggagaaagactaagctatgtgctatggatacatttttccgcatctcaaaacgtggcagaatacgaggtgctccttcacggactacggatcgcaatctctttgggaatcaggcgtctgatagttcgcggagattcacagttagttgttaacaaagttatgaaagagtggtcctgcctcgacgacaatatgatcgcttatcgacaagaggtacgaaagttggaggataagttcgatggactcgaactcactcacgttctccggcacaataatgaagcagctgacagactagcgaattttggatccaaacgcgaggcagccccttctgatgtgctcgtcgtacatctttatgagccaaccgtacccaaaagagaaacagatgaagccgcggaaccgactggagagagcctcttatacgatttctgacctcccaagaactccctcaagataaagacgaagccgatttccaggcgcagtaggctttatattattcatgagaccgagctgtacaggaaaagtccatcaggaattctgcaacgctgtgtatccttagaagaagggagacaattgctgaaggacatacattctagtatctgtggcaaccatgttgctgcacgcaccattgtcggcaaggcttaccggcaatgtttgttctggcccactgctgcgtccgatgccaacaagatcgtgcggacatgtgaaggttgtcaatttttcgccagacaaactcatctgccagcccaagggttgcaaaccatcctgctgtcctagccgtttgcggcttggggccttgacatggtcgggccgttcagaaaggcagtcggcggttacacacatctctttgtggctatcgataaattctctaagtggattgaagctaaaccggtcatcacaatcacggcagataaagctagagattttttcatcaacattgtgcatcggtttggggtacctaatcggatcatcactgataatggtactcaattcactggtggagtatttaaagatttttgtgaagacttcggcattaagatttgttatgcctccgtagcgcatcctatgagcaatgggcaagtcgagcgagccaatggcatggtactccaaggaataaaggcacgagtttttgaccgactgaatccttatgccggcaaatgggtggaacaactgccatctgtactttggtccttgcgcaccacccctagtcgggctacgggccagtcgccattcttcctagtttatggagcagaagcaatgttgcctagtgaagtagaatttgaatcattgcgttttcgcaattttcgcgaagagcgctacagggaagaccgagtggatgacctacaccgactggaagaggcccgcgaagcagccttaattcagttggcccgatacttgcaagggttgcgtcgttatcacaatcgtaatgtccgatcgcgagctttcttagtcggcgacctggttttgaggaaaattcaaactacacgagatcggcacaagttatcccctttatgggaagggccatttataatctctgaagtcactcggccaggttcttatcgactcaagcgtgaggacggtacacctatcgacaactcttggaatatcgaacatcttcgtcgtttttatgcttaagtttgcttctgtatctccctgtcttgactgacaacatcaagcttccccttgaagttatcagtcgggggctattataataataatggagtgtgatttttatcaattcaatttgcttacttatttatcattgccttgcttgatttttcgacttagtccatgaggactgaaagttttttaatagcttttgcgggttttaggctcaataaggcttgacaaaggcttttaagaaatcagaagctaagtatgaaacaccaagcacagcataaatttatcaatattgtacaaattgtgcctccatcatcaaacatcaatcagtatcagtcctttcatcatcagagccatcaggactagtcggtcgaagatcggtgtcctggaatctctctactacatcaactgctattttgtcagcggctttctacgcatcgttgataagatcgagagcagcttcttcgctcgtcccgtccgcaaagccatcaacggcatcaatgtcgattttcgggtaaagggatttggtcatcgccaacgctagacttgctcccatacttccggcttctttgatgttcttgaaatatgtatccagagcaactcttagcttatcaaagatctcggaagcgtcgaatgtactcgggccgttgttattaaagaacattgcttgagtgagtggagtagcggcgttagcaacttcatcccgggccccttcaagccttttaattttgccgaccaggacgtcgaattgggcttgcaacttgatcttgcggtctgcatcaaagattcatattaacgagtcaggatacagaaggcaatggcttttggagtatcaattgatggtaccttcaacgtcctttaaagctgagtccctctgactcgccagctctgctttatcgctttccagagtttgaatccgtttctccaattgagatatcttggtggtttgcactacattgaccgattaattgaggttataaagatgatggcacaagttagtcagacagattttgtgtataccatttgacgagccactcagttcgaagttagactcctggagctagccaattcgatctcttagatcgtgctcggttttgttggcaagctcttttgcctcgtgcaattgatctctgacagcttcaagggttccaagatgaggaactagtttctctagggttacggtcttcgcctcattcctaaggtgaatcctctgcaaaacagttttatcagcgctcaagctagatggcaaacaagatggctgaggtcaggcgtcaaggaacttacgtttacaatacgagtcccttggccgagtgcctttttcagtaggcatacctcttcgtcttctttttgccggtttattacaattccttgaggttgcaagtcatcatcccaccacttgaccagaatgggagggcgcgagtcttcagctgcacgtatccggagaacttcctcttcatcaccaatcattggtcctaatgtatccatggataaaggacagaagatcaattaaagttggttggattaacacggtttcaggcaaggtgtttacccgtgatgattcccgggcgaggacgagtcggctcttgtgtcttagcaggagatccaggcctcgggtcgttgctggcatcatgtccgtgagggctatcagcctgagcttcaacttctggaatctcttggcttggccctaggtccgactggtttccagtcgggggctcctgattgactctggcttcagcttcggcaaactggtttccggtcgggggttgattgctggattctacattatcggttgccagctgattgtcactcggatgatcctcagcagtcggcccggtttctttggaagaacttgtttccatattagccggatcagagtcctttccagaaggatctatatcagatggtttcctacaagtttttgttatcagtattatttccatgctggctgcgtatcaatacaaggaagattgttatatgatttgtacttggaagacttcctgatctttggcgtaggatgactagatgttttcttctttggaatagcctgcttcggcagctttctggttgtttctctatctccaggctattagcgttgtcgccttcgtcgtcactcagcactaacttcctcttacgggaatctgactggctggctggattagaggtgttaggctgggcttcggaccggatctttggtcccccgctcccctgaccagtttgacggcgaggtgatcggcgctgagcgattgtgggatctgacttcattagagcaaattcctagacataatatcttccactgtcaattgatttaacaaaaagacaagatcatattttgaggaaggttgaagtgtttgagtacataccggtgggggaggattgaatgcattgtatggcacaactggaagcagatgtgaataactgacgacaatagcatttgagaagatcttgtacattctttccttcatgaccttaaagtcaagagagtctggatcttcatgatttggatcatgtttgccgtcaaactcaaaagccgtgcgggatctctctttgattggagctaatcgacttttgatgaagtgccgagtgatttgttctccatgcaaaccttgttccttcacctttagcatgcgttccatcaattccaccgcctgagcagcttcatctcccataggcaatgaattccatgtgtcctggtaaaccggaggaagacaggagtactcggggagtgcgggttcaggattttgaacgtaaaaccagtttgcgtgccaaccattgtttgaggtcttcaagggcatggagaaatacttttggcttagtgttcctctgagttggaagccagcgcccccaaccacgcatggtttgctcttgttcggttggggcttgaggaagaagattcggcggaataaggcgaaatgaggcctaatgaccaaaaaagcttcgcaggcatgaatgaaattggcaatgtgcactatggagtttggattcaggtgatgcaggctaattccatagaagctcagaattcctcggaaaaatcttgaagttggaagagaaaatccaccataaaagaactgagaaaaaaccacgacctcgtgtgtatcgagggttgggaatgcttcgccgaaggctggtcgccacccgatgatctccttcgccggaagaacgccgtgcgccaccatttccttcagattctcctccgtcacgtcggagggtgcccactgattctcgaaactttctctcttccgccatggatgcgagtcgaatgatctgattcggtctgagaaatagctgaaggggaatggggaatcggtgcggtggacgcgtggagaagattcgtggatttttgagaatggattggggcggattgatgaaccctagcttcgtcggcgtggctttgcactgtagcaaggagtggggaaatggcgagagttttggcgaggaagacaaagcgttgcttggactttggtgttttgttagggtatcgggagtgctaatgggcttggacctgtacagtacttcagcccaatattattagcagcgtggcccgttgtgatccctagggacttaggcgctttttgctttggcaatttgtactcacaatgatgtgacccgatgctgttaaaatcctttttaacgcagttagataattctttggaattaccacgatgcaaataaaaaggtgcccgacagaaaggtgttatactatttttgtaagctttattagcctgcaaaagctgtttgggttgattcgagatgactagtttattaagagtcattctcttagcatgttatatgcttattttgattatggtaagggttgtagcctaggctattaaatttcttaattaccatgatttttatcatatttggtggatcattttaagagtttcttactcagattcttgccaaatatgtctttttgtggaccttttgagtgtttatcactcgggccttttcatatttttattcttgatatattaaagctgaggagcagtcggctgggtattttactaaataccatgcgtgctttgctatatgatgtttggttgtaaaaccactcggttcttgactacatgtttagttttttaactaaccacatagtcgggggctacacctaattaggtgcatctacccgctgcaccatattttattttcgcccttcacagtctttgattttagtgctcggcaggacagagcaggaggaattgaagcactcggattattgctacttcgtcgactgcaaaggtctcaggggctactgtggagattgtggatatcccatatctacacggcagctatagtttagttgggtacagggtaccaaatatagatagaatacctttatgaggattcgggttagtttctaaacttgtatatcaaggaaatacccgggatcctagtcggttacgattgtattttatttgtaatcacatattccgttagggatatgtgttgtattttgtaatacggactccttcccctatataaggtgcggtccgggtccctctagggacacgatttttctcccatatcatacaatcaataatacactcggcggaatcatccctggagaggagtagggtattacttcttgaataagaaggcctgaacctatataaaattccttgtcttcaaacccatccacttttctaacttgatagccacccccttttagtattgccgaaatcttatttcgacaatgcgactactcgaagatgcatctttagaaaagatattgatgtgctccctagatcatgtgtttgggctctatttttttctttaaaaactaattcataatcacaaagtattcatggtattattaagaagttaagatttccttggacattcagtcatttgcttctgtgaacaagtttggtatttcgaggaagaaatacattttttttaatttctcttgtgaaatttatggagttcagtattttgacataattaatatcgtcaaagcagtgttgattctatgggattgatgcatgtgcaaactagtgacaacatatgctttaaggtaggataattaattagcatctaaatgcagggttttgtagcccactacttatacaaaagttaggttttcgttttcatggtccaatttgtcaaaactaacaaattgttcagaaagaattgcttgctataaacactaaattaaactggtcactatggcatgattagggttttgatcgtgttttatttgtcccaaatttgttagtaatggataaaaaatgtaaaactcatttttttacaaataacgattatgtccgaaatattgcttaagtcatccaattaaaggcagcacaaaatgtgcacatattaggggggggggaggaatccaaagccaatatttatggaatatatggcacattcctcccccttttttttaatcaatttatagatgtatagaatatttgccaaccagatcagcacataagaaaaagtatagctcgtatgttctagtacatatgctagaagggccatattatgttttctacagcagtaagcaaatgactaatcctagttatgttgagtggattgatggattcaaaacaaatttgggtagtcaacatgcactgtgtttcatgatctaaatatataaatggaagctacgatactaatatataaacaaaagcaacagttaaaccttgttttcctttcgctgttgaacatgaggaatggacggtgggtatattaatttgtagcatatcttattttttggtgaataggcttagcagtttgaaatttgaattcttcagtatgccttgttgtcagtttcagacaatttctcgctgcaacttgcaactccatacatgcacgcgttatctataactgataagttttttaggaaagcaaaaaactattctgataatcattaattaactcattttaaaaagagctattatactgaagtattctctaggaaaaaaggtaccacatcccatatccaaatttaacacagaatttcacttaaagaaccttggtacatgaactgaaatccatgtgaatcaatttagtttacccagtaggtttggtacatgaactgaaatccgtgtgaatcaatttagtttacccggtaggttttttctttactgaatctaacataacatggtgtcaatctagacatatatgaatatgtgataaacctgtagattacatttcatcaagaaaaacattaaacagtgattaccagtagtgctgaacttccatcccaccaatgtgcatgggaaaataaaactaaataaatctcaccaataatggtataccgagtatagatattattggtggaagaaactctttttcttttgcaactatgctacttgctaaacaaaacaaacctcgtaagcatgaagacatgataattgaacatctaatgtataaagataagagccaattcagatcaatgctaggccattttattggaaattaaatgaaaatgaatgattagttaatcaccaatgctcgacacaatacgatggagcgattgctagtggagctacccaggtatctatggccatcagctgaagtgtacaacaaagaacggagcttaacagtcatggagcacgcgattccggcggtattgggctgttcaccctagacgacagacgcctcatcctccgtttctggctccagcacgccgaggagtggacgcagcacaggaaagtgaagctgagggagctggatatagttggatgtgtctcctcgccttaggccttgtttgttttgtaggggatcggagagcattggaggggattaagagaaaataattcgaaatatgggacttaataggattaatcccgaaaagtgctaggagacgcatgcaactatgtaatcgttaatatgagtttgctctctcctaattgcatttttgtgtgcactcagcacaatatataatttccatggacaagtttaaactgtactgtactggatagtggttttgcagaaactgttggcggttgatgatgtgcttgccggtttaacaaaatatgtactccctccattcttaaaaaaaacctaaatttatctatgtatctgtacatatatgggacatattgcatttttggtagcggcaataaagaaagttgttttaggctgtatgcatgtattgtgtgaacacgtactatacataatatatttttggcagtagcaataaaaaaactgttttcttctactggataccacaccaagtataaagaggttccaactttatacatttgagatttggctctttcctaatagcacggaagtttacagcaaatatcactactgaagaactgatctttgtccgcatgataaaactcgcattagtctcgatttgaataggaactggaactaaagaatatctttaatcctaattgaaaagcccagcaatatttttttatgtttagtcccggctgataacaccaattgagactaaaagatcatttttaatcccggttaataacaccaattgggactaaagatcatatttttaatcccgattggtatcacgaaccgggactaaatatctttttcccacgtcattcgctctctcttccttatctcggcattggtagccgctcgcacgccctatccactcctcctcatcccctcttcatgccaattcttctcctcctccccctcccctctctcctctgatcccctcctccccttcccctctccctctctcatctccatggcgggcggcggtgccctcccctccgctggatccagcggaaggggatgcggcaggtggcggcaagcacacaaggcggcaggtgacgccaggctggtgcccggcggaagtggtggtggccgggtggtggcaggccagaagcagcggcggccgtgcgggccctcctgatttgtttttagattttttttatagatttttttatatttgtggatgatttgtagattgcagatgattttgtggatgggcatgtaatttgtgaatgatttgtggattgtggatgattttgtgtatggacctgtgaattgtggatgattttgttgtgtgtatgatttgtaaggattcggggtgatggcgttggtgatgcaagtagcaaaaaaacaacggaaaaaaagaaagaaaactaaagatggatatccttagttccggattctaggtcccggtttgtaacccaggattaaagataacttctccacagtgtatgcatatgttctaattaaagtttagagtaaattgcatcactggtaacgaacatgacaggtgggtgtaatctagtgcacgaatttatataatgctcgttgtgatgcatgaacttgttttgtgcgtgccgagaaaggcaaaaaggacactatatggctaatcttattgaatcaggggctgattaggatactatgtaaacatatatctaagaaggttgctattagacatacacctcatcaataaaaaatagtatgggatatagtgatcgtagaaaaatatttaaaaaaaatgagcactgatatcagggttaaaaatatatgaaatttatcatttccatgacgaaggataaactagagaccaaatttataaatattgcatgtattatgcatattcactacacatatgcacgtcacatcctaactaatcaacatcaacttcgtaaaattaacattgccaaactattttggtctcattcgcacaaactagacaagttcgtgtactgaaacgaatattttacaagtttatatactaaattacactcacctaacaagattatgtatcaccaatgcaatttactctttactttctaaagtttattgcagaagaacctgttcgctgctcaccgcagtaaaagttactccctccatcacaaaatttaagcattttagcatagtgacaagtcaagcatttttaaatttgaccattaataacaaaaaaaattaaaaaaatcaatcatgtaaaattgatggtactagatttatcattaaacaaactatcataacatataactctttttatttaaacatcttacttttataaatattgttggtcaaagtaacatctcggagaccgtgtcagagtaaaaaaatgcttatattttaggaaggagggagtagccattttcagccattcttcattctcatgaacgcaccttctgtcttcaccggccatggttgttgagataggtgaggtcctcatatctagctcattccacttgtcccattcttgttgtccgccaccacgctgtgttgtcgccacatagatgaccaggttatctgctgacatggccgccattgcattgtgatgtaagcgccacctacacattcatgtcctctatggcatcccatgtgtcctgtgcgatgggatgccatctcggccggccggtcggtttctatcaatgtagaccatcgtttaccatgtgccacctggttggacttggtccacactaaacctctctcttctgcagtcattggtgcatggctagtttacaactgttggcgccataaatcttcttgccactaaaaaatgcttgcagagacatttttctagtactgtagaggtatttttcaaatgcctttacaatattatagaggcattttagaaaatgtctaataagtatcgtatggtgaattgtctctacaaacgaagagacattttataaaatgtctataagatggtagaggcattttctagagacattaaattataccacaaatatatgaaactagtcaaaaaggagaataaaatagtttccttggttttaacaagtcttaaactcaagatctcttggacaaatcatttttatcttcagtgcactaaccaactcaactccatgtcattacttatatgtttgtgcctttagttacttatatttagtcctttagtacacattgtcattctaaaacgtgtctctacatagtttaaaatgtatcaagatgatttattttgggacaaagggagtatattcctctattatctactcccactactggggaaaggctcttcactcccggtttgtaaccctttctactctcgggtttcaaaccgggatacccaatccggaactaaagatgctcatctttagtctcggttaaaataactaggagtaaaaatggatctttagtcccggctgttattaccaaccgggtgtagccaggcgccaggttccttttttcctttttttattgtttttaacatcgaataatgatttcactccatctacaaatcaaccctaaatcaatcaacacatatcacagcacaaaaagatatctccaaatcctcaaatcaatcatcaccaaatacatcacaaattctaaaaaaattacatcataagttctacaaaaaaaatcatcgcaaataaatcacatattcacatcacacaaatacatctcagatccaatcagaaattcttaaaaaaagaaaaaaaaatcaaatatgtctcgatccgcgtcggccgccgccacctgccacgtggcctcgccgccagccgccgcccctccgcgcgaccggccaccgccagtcgccctccgcgcggcctcgccgctgaccgcaggccctctacccgaccgctcctcggtctgaaggggaagttgggagaagaagttgaagagaaggggaggatggataacatagagaagaaaatgaggagaaggagaggataagtataagagatagaagaagatgaggagttgggaggataagtcgtaaggattctatactgcatatggatttttagtcccggttggtaatacaatccgacaatccgggactaaagatataaataatcttttactcccgattgatattaccaaccggtactaaagtggtaatctttagtcccggttggtggcgccgcaaccgggactaaaaattctcggtcccctgacaagccactaacatagaatgaacagggactaaacatcatctttagttccggttggtaacaccaaccgggactaaagatcaagattttttttaaccgggactaaaaatggtttttatcccggtttttattacaactgggactattgtagtttttgatcgaccctgcaaatatcagttttctagtagttttctagtagtgtcctaagctccctcctactcccacggacgcatctgactgtgatgtgtattgcacgtgcacaataaccagcagtacctttaaccttcagtctttttgaagcaaaatgtgaatccacttattgatatattattctattatttgtttaattattttgggattgtcctctaaatttatcttttttagcctgacgccctctgtatagaaaaaaaatcgttgcatgtacacttgaatggaagcggtgtgtatggcacatatttataattttggagatgatttgaaattagtcaaagcatatcacataaaagtttatttggtgcccttcaagctaatgcatgcagaaatatctccatctcttctctcatactcaaattaatccatatgcctcaataggattaatctcccaaattaattagctaggagcctcacatgcaactatgtaaccgtactttgatatgagtttgctatctcctaattgcatttgctgtgcagtcagcacaatacataatttccaaggaaagtttaaattccattgttacggggtaggggttttggagaaaccattggaggttgatgatatcctcgccactggttttaacaaaatacatactccctgtgtccttaaaatgccaaattttatctaatcatcagaagtggtttttgttagatggagggtgtataattaaattaagtgctatatatgtagtattgtgtaaacaccatcccatattgcacggcaataaaaaaagctattttaagcagagtatattgtgtgtgaacgcgtcccaaaatacatttttggcagcaacagtaagaaatgtgttttcttgtgctggcaacattattattgtttggcatttagctcttttctagttagaacggtagtttacagctaatgtgcatatctcctaattaaagcttacagcctttctggagctacctgttttcagcacagatatgtatgaacatctacctcgtttctcctggatctacccctactccaatcctcttttcttctccaaatcctctcttctgtctctccttctcttcttgcaggtttcctacttctagacccagggcaccaccagaaggggtatgtagccatggtccatctggtcttccatcttctggtggtggcaaaggcaatggtgtagcaatagcaggagctaatccgtggtattcgggggatggctctgatggaagcaataccactagtaacagcgagagaacagtcacagctgaattcggaataatcgtgcatcctggtggttatggtgatcaggaggtggattctcgtacggctaatcaccatgaggcagattcagaaactgatagcgagagaactgaaggtgctagctttgggaagatcgtaaatagttttagtaattctcgccatttctcctatgtggactctgagttgctcccaggaaaaaggcagaagaatttagtgtttcaacctgacgttcatgaatttctatcatatcctgattgttcttgactccatgatctttttatggttcatcaaaaaatatacgagtgcaatcccttagttttgatgagaatatcacaaacggtgctttatctcagttatttttgaaatccagttcaatctgattgtcttgcgtgtaggtttcttgttcctgattacaataaataatgttgtaacataacaaattataacagatttttaagtactggaacacaatcacctggaaaaatagcaactgtaatctattaatttcaacctcaccttttctctgtaactaacacaacatgattgagctccatggggtttttttacttcctttcttatttttgttaaacagtccaacaatacaacatatatttcaacatcttttctgaaatgggtattctttattatagatgtaaatttgaataaagatacaataattcttgtagtttctagaaaattgtatgcaatc

SEQ ID NO: 80488 - DNA, 21929 bp, Oryza sativa
caacaaatttttggggccatgcatgtatgatgtatggcagcagcaaggcacgtgcatttacccttgatcgctggagtttgttcatagacggtcccacatttgtgcaacaaatcgcatcgggactgtgaaattcaaggcggtacatatactggaaaagatgaacagctacaggagttccatagagaaaataaagtaaaagaactaaaaagacaacacaaaaaggttacttcgtaccactgttatttgacatcgccataacagtgaagcattctctaaatagccaagggcatccacaatataagctactcctaaagtgtcctcactaactaaggacacacgtaggaaaactcaactcgcaatggaggacacccctgaatgggctcctcaaaatcccaacctataaagccacaagtattgttttcctcttctacccctctcttcaaactaaggaatttgaagacatgaagcattcagaatacacgaatatattcaacacagtaattttcaatcaagagtaacctatatattataatctaattaagcaatagaatactagtattttctatcacactctcaagtactacttcaccacatcatctgtactactctatcttatcctcttcgttcatagccattcaccgcatcatctgtactactctatctcatctttttccccaatcttccatcgagagcagcaaaccgatgccaagatcggtggatggcatagcgagctcgcatacgcggccgagctgggtaccgggcggagcaagcaaggcggcagtcggctgacgagctcactcgcgcggccgagctgggtaccgggcgaagcaagcgaggcggagcaatcgaagcggacgcacggcaggagcgagctgccaccatggtcagcacaagctcaagctgcgtggtttgcgactttgccccaccgcgccgccgtctactccgccacacagcgccgcccgtgagctcccttcagctcgagctcgaggggaacgggagagagaggggagaggggtggaaggagaatatggaggtggagcacccgttgcccgaggcacccgtcgccgcagcgcgtgcctcgagcccatcccctggccgaaaaggaggagccgcatcgcccagacgggagtcgcgtggcgtcgttgggggacggtgcgaacgaaaaagtaaacggagatggacggaaggagctagggacacgcccctgaggctacccattgctgatggcctaaacatccataattttttaaaaagtaaaaaattcacgccagcagaatgccaaaacatagagaaggaagttaacttttcaggaaacaaatatcaggcgatgtccaacgtggaagagggaagacctccacgtacgattggatataactactggaaactaatctttgctcggtcgccccaaaaccacaatagtcccggttacaaaaagaaccgggactaaagatgatctttagtcctggtttaaaaccccacagccattctacgatctttagtccctaaagatcatctttagtcccagttcatccctatcagtcccttgtcagaggggcggggatctttagtccctgttggtgtcacaaaccgggcttaaagatcacctagatcaccactttagtccagactaaagatctcctctttactccctataacaaacggaactaacatcacgcgtagtatataatccctattccctatcctctccaccacaaccggcctcaatctcctcaacaaccggcctctcctctcctcagatccatctccctctcctcccatcctagccctctcctcccctcctcccttcctatccgatgcccagcgagggccgcctcctccccctcctgccttcccgtgcccagcgcctcctccccctcctcccttaccgtgccaagtggggccgcacgcggcaggtggccggcgaggccgcatgcagcaggcggctgagcacaggccgagtagcgagcgggcggcgctaccggcatccattctttattttttttacaatttgtgattcactgagatgtataattttgtgatttgttgtatagatttgagatgtataatatgtgatgtatttggtttgtgtgtaatttttttaggatttgtgatgtatttgatttgtgtgtacaagtaacttaagatttgtgatgtgaatgttttggaatattactttgatttcggaatatgcatccaactcgatttgggagaaaatacaggattaaactctggctaaaaaacaatgaaaaaaaaagaaaaagagacctaattggactgccactaccctctctttagtctcagttgatatcacaccaaccgggactaaaatccatctttagttcgggttatttcaatcgggactaaagatgcgccggattgctagtcccggttgaaaaacgccggattgctagtcccggttggaaaaccgccggttgaaaaaccgggactaaatgggttaccaaccgggagtataaatggtttctggttgctgagccgccatcaaacctaggcgagatgaaccatatatatataatatccgatggagttgatgaatcggccggcaaatcacatgatgcattgatacattaatgcatttatatttaatgaagatgaaaataaattaggacattggcagtttatattaagaagatgaatagctatggcgtttcaagcagcagctttcaagttttgctttattgttggactgcaaacatgaatagtcaaggatcctagggggcaccgcccacatcgagctgagccatccaatgggcttgtctaagattttctgcaaatttgagcttcacatgaatgaaagcaaattcatctcagtgccgcggccgcacccgcgctgtccaccacgcctaagccgaggccggggccgcgccgtgcgcacgcacgatgcgccgttccgcgcatccgccgcactgcgtcgtgccaccacggagatgatgccctgccgcgccgcgtgcttgtcaccgggccgaccaccacgcacgaagaacaaagaaaggaagaagaacaagaaaagaaaaatgaaaaaaaaaagagggtgcgccatcggccgtcgccccggcgccgacagcattggcgcccgaccgccgaccgcgcctgcagcaccgccgccgcacggccacgcctgtggcgtccggccgttccccgttacccggcatccgcatatggcaaggaacaatcgggggagaaaaatgaaagaacgaaaaaaaaggggaaaaggcgacgaacagcaccagatggccgagccgccgtcgccggccgcccaccacaaatagcacgccatgccacgccacccttcggctcgccgcgccgcccccctggccgctgcaaccacgcatgaacgaggtcgacgccgctgccgtgcccgcgccggcctaatccggccgcgtcgccttgcccggccacgaccgccgcgacgggcgtgctcgcggcgccggtcgcccgcccgcacccgcgccgccgcttacgtatggccgcgctgtcgccgacctagccgcgccgcgccacgctgcatccgcatggccgctccaccgttccccggccgccgccccgcgccgcccccgccggtcgccgaccgagtcacgccatcggccgcccccacatggaaaggaaccatcggtggaaaggaaaagaaggaaagaagaagaaagggaaagagaagtggaaaggaccgatgctcatgtgattttgcaaatggacccttgcattttttggaaattaagtgcatattcctctgcaaaggaaatttaccttttaaatcctaatgttttaagaaaacacacaaataacctctgcatttgggatatttgtttgaaaagcatttgaaatttgcaaatatcactaaaatcatattcacgcataaaaagggtccatcggacattgcatttcgaccttgactttgtatttaaggtatcttttattgctgatgtttatgattatgaaatttatttatcgcatatatgattattgattatttatgatgcttttattacttttaattgatatcattgcagtaaatatatagaatagcatataatatattgaaattatttgcggcaattttgtgtaccatcgcattgcaacatttgtgtatttgttaacgaccaaatttggtaatatcagcatcggaaaaggagattagatcaaggtggagttgaaggcggagattgatcctagaacagagcaagaatcggctgaagtccagatcggctacgattaggatcggctgggtctgagtcggactaggtgagccgattcagccgattctgatagtataatttggtgtatgacattgggttgaatcgaggtgcttcaagatgattgccgcacattgatagagtcctgagaaggcaattgtatctattaattacgatgttttatgtaactttcttagagatatgtttgggcaaaagtctgccgcaaagacttatggtatcttagagcttgttagagatagtggtcgtgtccggtatggacatatcttgtaattctcgggtataaatagacctcgagccctatgtaattggtaacacacacgttcaatacaatttcggcgcatcgccacttttttgctttagttttgtttcgacgagttcttgctttcgggttgagctgcattggtttcgatcttcaacaagaggtaaaacttgttatgacgacttgcgttctcgagattagtgcttccatctttatgacactctaatcttgtctatataattcgtcaagttatcatatatcctacataatctttggcaatatcgtcatctaacctacaatcggctaatatctgttaatagaaggcagccgattaggttaaatagcgacgttgtcctagattatataagatatctaccactttatgaaacacccagcggcttgattgtctagatattgttcttcttttcatacttaatgctgcatcagttgagtttgatctattaagtcgtgcttagaatatcaatctctagcctgtcctctggttgccgattagggtagcatcggagtttcagccgatattatctgatttaaccatattcaatctatatgcttcaatgacatgttaaatctgccatttatgtcaggatcttattgcatttaagtatattaagcttttgtttggtatattatatttgttttgatatctttatataaagtagtatcggagtattagcggatacatgctagatctatctgattggctatgctataaacatatataatcctgttattaatatatatttcgatcgaagtgatttattctgtctcggcatggtggccgatctaccccaatcacttgatttaagtatatattaatataagaactatatatcgttaatatatacagccgatcgaatagatttagtttcttactatctatttataaccgccgatcgattcacatatgacatcggctcaaagataaatgatgtcatcggcacctagccaatcggctatcatttatagatttaaccacgaattctttgtctctatttcttgttgattacaggatcaaatcaactggcacgctcatacattcgaaggcgagctttggacctgcactggagttaagcagatctcccaggcctcatgttttctatcaacacgcttttggcacgcccggtgggacaaattagaagtcagcaagcaattcttcctcatggccgagaagccaccgctatcgccatcctcggctagcccaagcactgttaaataaaagatccagaagttggggttgactcgtgcccatcgatccagagaaattcacacctgagcagaagaaggattttgaagcaatgttgcagcaagcccaggatcaggtcttgaactcattcatgcagccccgcaagggaacattggttcagaagtataaagtaaaggtagttgcggatgaccctgggaccagttcttccaaaggtgaagacgggaaataagctccaaatggctcggctcaactgagtgacaaaggtgctaccgacggttctctaggaagtcaaggtgacaactctcaaggggtgcatggagttcaaggtgatggtgctcaggggttacaagagggaaatcttaatcagaatagtgatgcggcacaagatttttttaataatttccaagaccgggtcgactatgttgtgcaccatgctttgatcaatcagtctggggtgttagtcaataccttatcaaacatgacgaagtcaatagcagatggatcaatagctgagcatcaggctgcaagcaattcttcctcatggccgagaagccaccgcagtcgccatcctcggctagcccaagcactgttaaataaaagatccagaagttggggttgactgatgtcaatgaaggaaacgtcgtgcccatcaatccagagaaattcacacctgagcagaaggattttgaagcagtgttgtagcaagcccgggatcaggtcttgaactcattcatgcagacccgcaagggaacattggttcagaagtataaagtaaaggtagttgccgatgaccctgggaccagttcttccaaaggtgaagacgggaaacaagctccaaatggcttggctcaactgagtgacaaagctgctaccgacggttctctaggaagtcaagctgacaactctcaaggggtgcatggagttcaaggtgatggtgctcaggggttgcaacgtggaaatcttaatcagaatagtgatgcggcacaagattttttcaataatttccaagaccgggtcgactatgttgtgcaccatgctttgatcaatcagtctggggtgttagtcaataccttatcaaacatgacgaagtcaatagccgatggatcaatagctgagcatcaggctgcaggcccagtttatttgcaaggaggtgtctttccaaattatcggcctttgattactgatgcccaaccatctatttaggcagttccccccgtcgcaccatcagctcagccgacggcgacggcatcgactcccttacctgctccgtcagcattggcaccaggccagctggtgaaccctcagttgttaatgagagagcagccacaacatagtgggcaggttgtgaatcggccgacgcaagatcaggttgctgccatgtttctgccgcctcaacctgctgttgatccaatacagcattagccgattcaacagacactcccgagtcagcaggttgtacaaccaatccagcaacaagttgtgtaaccagtccagcaaacgccaccaaggcaacagcctccgcggccgattcagcgaacgccattaagatagcaaatcattcagccgattcagcaccaaggctcaatgagcgcatcggccaggtttgtgacgcctggtggacaacctgtacaacaatttttaaatcaagtcgtcccagaacacttgtttcaccccgtgcagccggatggcacagtaatgcctcaagttgttcccgagcatttggcacgtaatattcagccgaaccttcataattaccagggggcagcttgaattatcaatatcagcctccttccccgcaagcccaatatcagtcagggggactggctcaacctcagtttgcgtctcaatacggtcagttcgagcccatgcaacaatagtcacagggagcagctcagcaacgaccgtgggccgatgtgattgctgatgtaatgagggaacagtttgggcttaaaccaaaagagactggaagcttgtatcggctgccttaccctgagtggtttgagagagttcctctcaacattcagttcaaagttccggacttctccaaatttttgggacaagatggtgtgtcaacttatgagcacattagccgatttttagctcagtgcggtaaagcatcggttgtggacgctctgagggttaggttgttccagttatctttgtttggatcggcttttacttggttttcttctttgccatatgggttcatcaatagttgggccgatttggagaagcaattccacagctatttctacagtggggttcatgagatgaagttatccgacttaacggcgattaagcagcggcatgatgactctgagatagctgcagccgaatgggtgaggagtaaaaaggtcataccgtgccaatgggtgaatagttctagaaaggaagagaagtatgattttgatattactaaagctgacaagatttttgatctgctactccgagagaagcaaattcaactccctgctggtcaaacgattccatcggctgaggaattaagtaaaaagagatattgcaaatggtataattctgggtctcattctactatcgattgcaaggtgtttagacaacagattcaggtggccattgagggaggcaagattaagtttgatgattccaaaaagccgatgagggtcgatggtaacccatttcccgttaacatggtacacacagctagccgaacaactgatacggggcgcatgaggggttatcaagtaagttcggctagaattataaacaaatatcaaaggaaatacgacaagcaacaggaaaagcatcatgaagaagataatggtagctctgatcctcattggggctgtgagttcttcaggttctgttggaatgaaggtatgaggttaccatctatcgaggattgtcctggatgcagtgatgttgcagggggttcaagccgattgtacgatggaggcaattggccaaaacagacaagagtacttgttcatcagagattgggcccagtaaaccaacgtggtgattcgaaagatgatgaaaataagaagactgaatggtgtcctcttagtatttttacgaagaatcagaaaagaagggttcaaagattgaggagtagggaatgcttccagcaggtcgaacaagaaattaatcatcggctgaagaaagcaaaatcgaggcaggagtggtgtgttaagaatcaggctcctgtagccgatgatgttgcagctgatgaggcaaagaggttggcaaaaggaaagagtgttgtgacggcaccagttaacatggtttttaccttgccagccgaattcgggatcgatcaagccgatgtcgacgaggtggaagaggaatcggctaagttggttctatcaccagaacaggcggtgttcgagaagcctgaggggacagagaatcgacatcttaaaccattgtatataaatggctatgtcaatgggaagccgatgtcgaaaatttgatgccttatgctacgttcaggaagttgggtagaaatgccgaggatcttatcaagacaaatatagtgctcaaggactttggtggcaatccatcggaaaccaaaggtgttctaaatgtggagctgacagtcggcagtaagactattcctaccacgtttttttgtcatcgatgggaagggttcttacagcttgttgcttggaagggattggattcacgccaattgttgtattccttcaactatgcatcaatgcttgattcaatggcaaggcgacaaaatagagatcgtactagccgacaggtcagttaatgttgccagtgccgatttagctctttgggagatggatggccttgattgtttatctggaaaagtttggaatggagattttctaaaagtgtccgattctgatatacagccagttgaagttggagaacccaagctattattttgagggcgttgtggagggttcaagtgtctacactaaggatacggtagatgatctcgatgacaagcaaggtgaaggttttatgtcagccgatgatttggaagaaatagatataggtccaggtgatcggccaaggccgacatttattagtaagaatttgtctctagaatttagaaccaagctgatagagctcttaaaagagtttagagattgcttcgcttgggagtattatgagatgcctggactcagccaatcaattgtagaacatcggctacctatcaaaccaggggttaggccgcaccagcagcctccgaggagatgtaaagccaatatgcttgaacctatcaaagctgagattaagagtttatatgatgctggttttattcgtccttgccaatatgctgagtgggtttctagcatagttcctgtcatcaagaagaacggcaaggtgagggtatgcattgattttagagatctgaataaagctacaccgaaagatgaatatccaatgccagtagccgatcagctggttgatgccgtgttagggaacaaaattttgagttttatggatggaaacgcagggtataatcaaatttttatggctgaagaagatatccataagacagcttttagatgttctggtgcaatcggcttatttgaatgggttgttttgactttcggcttgaagagtgctggagctacatatcaacgggccatgaattatatttatcatgatctaatcgactggctggttgaggtctatattgatgatgtggttgttaaatctaaggaaataaaagagcacatagccgatttaagaaaagttttcgagaggcccaggaaatatggcttgaagatgaatccgacaaagtgtgcttttggtgtatcggatgggcagttcttgggatttcttgtccacgagaggggaattgagataactcagagaagtatcaatgcgatcaaaaagattaagcccccggaaaacaagaccgaattggaagaaatgatcggcaagattaattttgttcgaaggtttatttctaatttgtccggaaaattaaaaccttttacaccattgttaagattgaaggccgatcagcattttacttgggggcagagcagcaaaaggctttggataatattaaaggatacctgagttcccctcctattttgattcctccacagaaagggataacttttagattgtatctgtcggtcggtgagaactcaatcggctcaatcttgattcaggagttggatggaaaagaacgagttgtattttatcgcagtcgtcggttcttagatgcagagactagatgttctcctgtggagaagttatgcttatgtttatatttttcaagcacaaggttaaggcattatttactgtccaatgaatgtactattatatgcaaggccaacattgttagatatatgttatcggctccaatattgaaaggaagggttggaaagtggatattttccttaactgagtttgatcttcggtatgagtcaccgaaggcgattaagggacaagctatagccgattttattgtggaacatcgtgatgattcaatcggctcggttgaaatggtgccatggagtttattctttgatggatcggtgtgtaatcatggttgtggtatcggcctagttataatttcccctaggggcatattttgagtttgcttatactattaaaccttatgcgactaataatcaagctgagtgtgaagcagtgcttaaagggttgcaattgctcaaagaagttgaagccgatgctactgaaatcatgggggattctttactggtaatcaatcaattggcaggggagtatgaatgcaggaatgatacgttaatagtttataatgagaagtgccaagaactgatgaaggaactttggctggttactttaaagcatgtatctcgagaacaaaatattgaagctaatgatctggcccaaggggcatcagggtataagccgatgatcaaagatgttaaggttgaaattgcagcaataacagccgatgattggaggtatgatgtgcatcaatatttacataatccatctcaatcggcttctaggaaattaagatataaggcgttgaagtacacactattggatgatgagctttattatcatacgattgatggagtgttactaagtgtttgagtgccgatcaggctaaagttgctatcggcgaggttcatgaaggaatttgtggcactcaccaatcggcccataagatgaagtggttacttcggcgtgcagggtatttttggcccacaatgttggaggattgcttcagatattataaggggtgttaagattgtcagaagtttggggcaattcaacgagcgccgacgtcggctatgaatcctattattaaaccgtggccatttagaggttggggaattgatatgatcggtatgataaacccaccatcaagtaaagggtataagtttatattggtggcgactgattatttcaccaagtgggtggaggccattcctttgaagaaagttgattctggggatacaactcaatttgttcaagaacatataatctaccgatttggtattccttaaactattatgactgatcaaggttcaatcttcatgtccgatgagtttgttcagtttgccgacagcgtgggtatcaaattgttgaattcttcaccatattatgcacaagctaatgggcaggccgaggcatctaacaagagcttgatctaattaattaagcagaagatttcttattatcctcggcaatggcatacccggttggccgaagcattgtggtcttatcggatggcttgtcatggatcaattcaagttcctccttataagcttgtttatagacatgaagctgttttgccatgggaagttagaatcggctatagaaggatagaattgcaagacggtttgacagtcgatgagtattataatcttatggccgatgagagggaggacttggttcaatcgcgtttatgagcccttgctaaggttaccaaagataaggaacgagttgctaggcattataacaagaaagtagtgcctaaggattttttggaaggtgaacttgtatggaagttgattttgtcgattggaactcgggataacaagttcggcaagtggtcaccaaattgggaaggaccgtttcaaatctataaggttgtgtctaaaggggcatatatgttgcaagggcttgatggtgaggtttgtggacgagcgctcaatggcaaatacttgaagaagtattacccaagtgtttgggttgacgcatgatcgactcgtgttgctgatgcatgacagccgatgtgttttacatcgtcttgagatggctgatattgttatatcgcccttagtcgtttttccaattgtaatcggttatggtttgccgatatataacggccgatattgtatcgcccttagttgtttttctaattttatcaatgctgttgacattataaaattggggggcacatatataccaaaaatgaaagtgaaaattagaagttatgttaatcggcacaaaggattgttaaaacaacagggtattaacgtatcttagccgattacaagaatttttaagtcctattacacaaaagttattgagacaagtactgctggatagccgaaatagctctttgcctaatttgttcgacttcttcaatggcttgggcatcttgagtgtcacgaccggaagtaacccaacgggcgttccttacgtgcgtgtattatttcttgtcccaggaggcaaggtacaccaaaagttgatacatttcagagtttaccaagcggaagcgtaaataattaatttattacatgggcggcgaaggcccagcacacacaaagacaaacgggaaacagcggaagactagggcgacgaccacaggcgcttgacggcaggcacgagctaaacaccaacgccttcatcttccaggaactcctcttctgggtttgggaaaaaattaagcaagactgagtacaaccaccgtactcaacaagacacacccacaagtgcagaataaatgcaagggagtacaagggggttataatataagggttagggtttgcagtaaacagcattaaaagacacttagttgcccaaagatattttgtaaatacgatcctagagttatacaatgttattaatcaaggccgtgaacccacacgaacctgccttaacccaaggcctacgatgattcagaccgaactagcaacccgaccctgggtcccagctcgtcccaagccaacccaggccaaccgttccatattttagttgttaagcaggttttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccagccctgtgccatgacatctcgactaccgagccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccataataatccatccattccatgttcaggtgatgagaatattcccaaagtgtagagttgtaaaaccacctaatgttgcctaattaaccagcgaagcatctacctaaattcatactagtggttaccatgagtagagtgcccactagttggggttttgtttattctagggtgaacaaggtattaatatcaataacaataataataaggtcataacaaaggtaaataggcatggctaaataaaacagtgataacgcgggaatttaagtaaagtggtaatgcaataatttaaatcaaaataattttataaactgggattcaatatgctcaaggatgatgtgacttgccttgctcactttcccaaacgtcggcttcaacctccacgaagagcggatcttccgaagctgcagcatctacacgaccatcggaaaagaaaatgattttactctaataaactccatataactagcaagaacaaagcacaaaaatgggttcttgacttcttaaggaaaaattagagacttaaatgatccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccatgcggcagcctcacgatccacggtggatcgggtgcacccgggctcacaccggccggcgccgtgggccccacgcgtcagccgcacccgagggcgcgggcggctgacggccgggccccacgcggtccacggtggcggcacggctcggctcaccctaggtcgatggcgacgatgaaaaaggcggccggagcggaggaaggtggcggcacggctcgggtcgacggggacggcggcgctccggcggtcggcgagatcgacgagggggtggacggggacggcgacggtacacaaacttatctgtgtataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttcgcaacttgtcttcaactgaggttgattgattattgcaagaatgagcatatgacatactcaacaagccacacagcaaatatgcaaatacacaaggataccaaaggatggcacaatatagtctcatttgcgaaagcagcatttagcaaagagttaagagtagtaaaacagtagagtaattaatcagaaactttaatcaacactgaacaacacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataacttgggcacggctattcgaatagttttactctggccagaggtgtaccactgtacccacaagacacagcctcaacatcatgtctaccatgcatcgcgatactagaaagtacccgaatagaggctgtgacaataccctctgcacaacacaactcaccatagtgcaccattcctggatcataatcacccccttataaaacaaggcttggactccccagtgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagtacgaccttcaaaaccatgtgctcacaacccaccattaatcatattttaattaccaattaattatcataacacgattaaccatcgtgagataccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacctagtgacattcgaaaataaatgcacacttgaaatacatagagaatttaaatataggatcaacatgctcaaaggattgtgtttaggatctgtgtgacttgccttgcaataatcggtcttcaattaatcttctgaacactcccgacgcactcacgaaccttcgcaacgacagaaacgacaagctaacacacaaaacgaagaaaaaaactaataaaaccaaataaacagtacaaaaacaagcataaacagtacatgtggatatttttaacatgtagatctcgattttagatgaatttagcaacttgaaccagtcgaatacaagttacgatgatttagttatgaatttccgaagatttaatctattagataaaaaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagccgcggcgcggcttcggtcgacggcggcgacggggctccggtgaccggcgacagcggggagggagcggccgagcttgcccacacctcggcgcaccttacggcggtgacggagaccgacggcaacggcggaggcgacggcgcgacacggccgaagttcggccggcggcggcggcgaacttggcggcggcggcggagaggatacggggcacgggagaccacgggagaggggcaaacgaaagaggaggactagggggtcctatttatagccttggattgaagagattggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggatgcggcggcactgtgcacggcacggctggctcaggctctgcctgagctggaagatgaacagtagcgcagggacgaaaagtagacttttccggctgggctgagaggagaggaggcggctcaggttgggccagcgtgggctgcacagcacgcgcgcgaggagggagagaagaggaaggaatggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaaaaaattataattagaccatttaatgattaatttaatatgtgggtaattactgaaatgctctttgtatgattaaaaattaggaattgagctccgaaaaatccgagaatattccagagagtataattaaccatggataatttaataaaaaataaatccatccatgctttatatttaggaaattttatttcccacatttaacttcacttgtaaattaatgaacatttaatataaattctaataataatttataaatcctgaaacaaaaatcaggatgtgacatgagaggtgaattggcttccccgatcagatacaattttcttaggaacgccatggagactcacgatcctagcgaagtagagttcaactaatttgttccctccataggtggtcttcagaggaataaaccgagctaccttggttagtcggtccacgactacccatatagaatcatatccgccttgggtttttggaagtccggtgatgaaatccatcccaatttcatcccatttccattctggtacttggagaggttggagaagtccggccggtcgttggtgctctgctttgacacgctggcacacatcacaaagggccacgaactctgcaatttaccgcttcatactaacccaccagtatttctctttcaagtctaagtacatcttcgtgctgccagggtggatggaataaggactttcgtgagcttcctgaagtatcaaccgtttaagttccttgtcgtccggtacgcatacacgatttccgttccatagggttccgtgttcatcttctgtgaaaccagcagctttacgctgtttcatattcttgaggatcccatgtatatctggatcattcttctgagcctcgcggattcgatcgagcaaggtaggcttggcttccagcgtagccaagaatccacgaccaactatgcttaggttcagggcttccatctgttgattaagttccggtggaatgccacggatgccaagagtgttgcaatggctttttcgacttagagtgtcggcgaccacgttggccttaccaggatgatagtggattcccacatcataatccttgatgagctctaaccaccttctttgccgaagattcagatccgactgagtgaagatgtatttcaaactcttatgatcggtatatatttcgcagcgatttccaatgagatactgccgccggatttttagagcatgaaccacagcggctaactccaaatcatgggtaggatagttgccttcatagggccgtagctggcgtgaggcataggctaccacatgacctttctgcattaatacgcaccccaatccttggcgcgaagcgtcacagtacaccaggaagtccttgcgagtatccggtaagattaacactagcaaggaaaccagcttttctttgagagtttggaatgctttctcgcattgagggctccacacaaatttttcttccttcttcagcaactgcatcatgggtctggcaattttggagaaattctcgatgaatcttcggtagtatcctgccaaacccaaaaaactgcgaacctaagtgactgtcttgggttgcttccaatcagtgacggcggtcaccgtttcgggatccacaacaactcctttagcagatatcacgtgccctaagaacttgacttcgggcaaccagaactcacacttgctgagcttggcatacaattggtgttcccggagctttcccaacactaaacggagatgctgctgatggtcttcctctgattgtgagtacaccagtatgtcgtcaataaagaccacaacaaacttatccaggtattccatgaacactttgttcattaagttcatgaagaaggcaggagcattggttagaccgaacaacattaccgtgaattcatacagtccgtattgcgtggtgaatgcggtcttcgggatatcctcttcacggatgcgcaactggtgatatccggaacgaagatcaatcttggagaatacagtggcacctttaagctgatcgaacagatcatcgatccggggaagagggtacttctttttgatagtaacttcattgagagctctgtagtcgacacacatcctctttgtcttctctttcttctccacaaaaatcacgggagcaccccagggggaagtgctcggctgtatataccccttttctttcaactcttccaactatctcttgacttcggccagttcatttgccgccatacggtagggtcgcttgtacagaggagcggttcctggagcaagatctatctggaactcaatctctcgcttgggcggcataccgggtagttcttccggaaacacatctccgaactcactgacgatgggtatttctggcaatcctagctgatgaagtactgaactgccggcggaagttgggggtgcaaagaaaacaaccggttgatcagggccccgatacacagtgacagtgcgccttgcgcaatccactactccttggaattgagccaaccaattcatcccgaggatcacatccaagttcttggtgtctagaagaatcaaatccgaggggaaagcaattccctggatttctataggaacggcagggctataatactttgctgtcataacccctccaggggtggtgatgagcagagggttcctaagcctttctacccccagctgatttctccccatgaatggcacagatataaacgagtgggaagctccagagtcgaacaaaatggtagcagggatggaatgaatgaggaacgtaccaacgatgatgtctggagttctcagcacatcctcggcagtcacgtggttcacacggccccgagtgacatccttaccaccgttgttggggcggggaggcgcttggccttgctgtcgcctcggctttgggcatttatccgcaaagtgcccgggcttgaagcagttgaagcacagacactgttgaccttgagcatccctgcggccttgtccaggctgcacggctggtgcaggagggcggggtgcatgggccccttgctgattctgctgctgctgcggctgtgggacgcgcaccacgaattgaggtcggagcgcggagcggggttgctgctgcggctgcgaggaggatccccctggatagggattggtgtagcggatcctttggttagccccctgttggttgcggaaattcgccaagcgacgcttgtgcgactccaattccttgtgcttggcttccaggcggatgctcttgtccaccagggctggaaatcaggatagtccccggagaccaaacgaacagatagctcagggtccatccctgccaggaatttctcctgcttctcctcatcttcacgaacatcctctggggcgtaccgggccaaattattgaactcgtgcaaatactccatcacggagcggttgccttgtttcaactcccgaaattccctcttcttaagggccatgactccggcgggcacatgggtcctccggaaggcggcggtgaaatgggcccaggtgataggctgtccctctggctgcgtagctggaagtggtcccaccatagagatgctgtcacgtcccaaaacgaccctaaaatatatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttaaaatgattttataaaaagaaaaaccctaaaatccctccttctctctaatgggccgagttcgacccatctccctccccctctctctctcct

SEQ ID NO: 80489 - DNA, 45737 bp, Oryza sativa
  unsure (1)..(45737): unsure at all n locations
gagtcggagagatcgatcgatcgatggatggaggtgtacacatgtgcgtgcggttgcagtacacacttgcatactagtgtgtgtgtttgcatggtgcggtcgttgtcgcgggaggacgtacgacacggctaacggcacgacaaggcagggggatggatcgaatcgagtcgagtcgatggatggatggatggatcgaggcgggcggncncncgcgggtcccggaaaggtgcgtgcgcgcgcgtccccgtcccgcatgtggctgacacaactcccgcgcgacacggcaccaaccaccaatccatccatacaacacccccaaccccaaccccgcccgagcacaatcccggcgtgcatgcggggccgcactgccgcctgcctcgcccgcccgcccgcccatcattactgcgctcactctcctcgcccaaccgcacgctagccgactactactcgagtactactagcgtactgtgctactgttccattatccggccccctcacgaatggatatatcgtgcacacgggccacggcagtgcgtgcatgcaaaaccggccgggcggccgccatatgtggcacaataataattccgtatgtgcagagattaatcaatacggtggtggagccacgcgtacgtgcagggagatacgcatgaccggggccggtactcaattcatgaagccgatcgagctgctgctaatcagatttcttgttctttttattcggtgctaatcaaatatcatgctctaatcaaacggacgcaccatcgtgcgtacgccctgcaggcgatcgacctcacgtacggtggttgcactgtacgtaccggtcgaggcgcgattggaacgggggctaatgctagctttcccagcagatctggtgacgtcgtctatcgtacaagttagctaatgataataaccaaatcgatcctccttttgagccgcgaggcgaggctttttaactagtacaaggtcgatcgggacgacgtacgtatgatcgatgatgcgtcgtcgatcgatcgttccacgggagtaaaccccaactcgtgatgattgcttgccgcgcgcgcgggcgtttctgctggggaacaggggaaaaaaaggggcgggcgattcgcgcggcgcggacggacgtggcggcggccgagctggagacgcgcatctgcacatgggtgggggcctcgcgcgcgcggccggccgcgcctaccgatggacgtacgtacgcgtgcgcgggataacgagaggcaagggggcgtgggccgaagagcgaccgatggatggatggatgaccgatcgatcgctagccgcagcagctgctcgtgcgatcgtgcgtgcgtgcgtgtgcgtgcgtttgctgccttgttgcctcctaccgcgacccgccaccaacgggccatgggtgtgtttagttgggaaaaagaaaatttttggatgtcacatcgaacgtttgaacagatgttagaaggagttttcggacacgaataaaaaaactaatttcaaaactcgtctggaaaccgcgtgacgaatcttttgagactaattaagccgtcattagcacatgtgggtacggtagcacttatggctaatcacggactaattaggcttagaagattcgtctcgcgattttccccataactgtacaattagtttttctttttatctatatttaatgctttatgcatgtacctaaagattcgatgtgatgtttttgggaaaaaaatttggaaactaaccgggccctatatacaatacacgggcccaatccatgtctccgattttgtcctcctctttgaccctccttcaagctccaggtcctactactagtactacgcctaccctgccgccgtatacgtcagacagcacagcaattaagacaccgtattcttccgtttcctgtgtgtgctcgtctggaatacatacagatacgggcattgatcgggtatgcgtacgtacctggtcaagctagctggtccgaaaagttctccgatttgatacgacagaaacggggaaagcaacccggaacttctcgcatgttcaaccgatcaaactcgccgggatcacacatttgcgcgccgcttaattctctgctcgatcctttgggttgggcgcaatgattcgggatagggtttgacatgatccttggccatcctgcttgtgacgcagaattggtcaacggatgagaggggcacatcgtggttaaggatcgatgggtgatcgcccctgctcccgcgctcggcttgtgccatcggtgttaatgtgcacgggtagacagctactccggccacagccacacaggtcaggttttatcagaaactcagtaccctgttcgtatcttgaaaaaaaatagtgatgttcttcaaccagtcgtctcaagactcaaaaagagtcaagtctcacctagtcaccttgtaggtaaaaaatgaaaactctttcgttgaatgttgccttagtccctatctcgtacctctgtgaagatatgaatgtatctttgttatttttcttcctttcttcttttcacagttgggaaaaatatataaatatactctttggttgtgtttagttcacactgaagtttgaaactttgtttgaaattggtacgatgtgatagaaaagttgtgtgtgtatgaaatgtttgatgtgatgaaaagttggaggtttagaaaaaaaaactttgaaactaaacagggccttttcctacttaatataataccagcaagtctgccttcggtttcaagagacaaaaaaaaaaaaactcttttgttaacatgtccgaagtatatggccactacttttcgtcatctgcagtaatatggcagaaagcaccaactaagagtaggttaccaacagatgtctcgaagataagaaaattccatcatggtttaccttttagataaaattcggttggttttcacgaaaaccagacatcctgaacctagctcgaaagaatattccattggaaaattcgatgcatttcggtccaattcaaatttgatctgaagaaaaatgaaagcgattttaaaattcctaaaagtactatgatattcatataactcattaatggcatgctttaaaaaaatatgaattttcgtgtgttcttttaacggcacacaataatagaaaagtagtatatattaaaaggaaaatgaccttcatgggccaaaaggcaatgacaaatagggtcaaccagcccattttaggaaaaagatgaaaggattcgggcggcaacgacgttcctccgccggatacagtgatcgttccctaccactgcggtagtttgctgctcgccgggtgtcgatttccatccgggaccacacagaaaccgagcgaccacagccggatttggcctatgtttggtgatgcatattgaattatcaattgcctgtgctttaaaattgttttcatgagagtgtattgcaatcgtgtgtttctcaatggagagaactacaatgtaggaaagctcatgtcagcatttttatataagttctctcatttcctacacatttccttaattttccctattcccccattttcataaaacaaaattaattctgcagtaatcttcagcttttcaacaaaaccgggtgtttttcttggacatagatcgatttgattctagttcgtgtagcgaaattttgttattcccaatcaacatttcagtgaaaccgaccagtttttgtcatgtgatcaactgaacctgagaatttggattcaaatttatgttttttaaaagaaatgtttaaaaattgttggttttcatgaaaaccgagctaccgctaagttaccaggatcagagcacccaacagaaaggtagaccctgaattccatatatggcacagttttttttttttactacaagagaagtcccaacagaaaaccttttttcaaaaaaaaagagaaagaaatagaactccaggttcactaatcactatacctgcaaaggaccagcaaagaaaaaagaacaagaatgggcattgcattcaagtattcaacttgtaaattgccgcggacgtataaaaggaggaatttggctagtattttgtatcaacataagacaggaatttgaaacgcagaagcaacctggaaataaactctatgcctgcttaccagcaaacatttgtacagttaagtcttctgcattccaaacaaatgcgaaagcactcagttatatgggcaatccatgaattttgtcaggcatgacgtaggttttttttggaacagttagctgtatctgtgtatacaataaaaaacctcttgttcactgacacctctcgagttacaaaaagatcatcagcgaaggccttttgctacatcttctaagagctattaacagaaatttcatggaggagaacgcatcctttggcctgcagagtgcataagcagataatcccagggtattgtgggtccagagcacacttctctggtagcttgaaaaaatgctgcaattattaattagacatggccgtttaagcagcactggccaagatgggtacaaaactgtggaatttaaaagtaaacaggaaaaagaaactagatgtactggtgcgaaggagcatcctccaatatctcatcaactgcgcaaaaaaggggtcaaaattttttagtggattccaatgcatccctaaggtgccataagcccttcgattgtgtactgaagagacttggcccagtcttccttaaaaagtaaagtttgtaatgttttcataacattgtaatctggatccaacttgcgctgccagccctgtaaaataaaaaacaaactcaaggatctgtaatggagcaataagcaataggctatagatagtatgagagaatgagaaagaaacaaaagttcatgacaattatttcccttttaacaaaaggaaactaacgcagaagcagaaataggtaggaacacaaagcagtacagaggcacatgtactttgaattacagagccagatttccagaacactgactaaaagtaagctataagagtcatatatatgatatttcatgaggttccgctatggtagtttggttatttacaccatttctccagttttaaatatgttgctaaagatgttctgctataaagcaccttttcccactactttttttgaaaacaattctgcaaccaacaaagaatcactttaactgtgacctactatgtcaagacacttttatccttaggcaactagtaggcattatcaacgaatccgaagctcttgagaccattcaatgaagatgaaaattctcatattcatgcatttccatcaaggtctaaggtcagggtacaaatatgcataaacctaatacccctgaagtcttttgtcatattgtgacatctagggagtgcatgttcagtcatctgactatgccattagaaaacgttgtgactgaattctaggggtcgagttctcctaactcctaggtcctaaatacatctccatatacctttctcgttggcaatacagcacatactataatcttgagaaacagctcatcgtgatctattggacatatgacagagacatctaaggccctgtttgattcagcttaggattattataatctggattattaggagtaagctgaaacaaacatataacttattatgatagataatactgtattacaatctataaaccagattactataatctggtaatccactctaaaggtgcttttttagattattgggcggctaacaactaataatccagagaaacaaacagctaacagcttattctatgccggcttattataatccagcttatagtaatctggttcaataatctagattacaataatcttaagttgaaacaaacagggcctaagttacaccataataagtgactgactggagcatgagacaagcagttgaagcatacctcaagaactaatgtagtgaccataacagtacaaacgttcccatcaatgtttactttatggcgccgtacttgctcaagcaactggtgcatacactcagctgggtggacagcatcaccttcagaggttccccaaaaggaaaacgaccgttcaacttcctgttgacaaaaacaagacatgtaggacttgtcgtaatttgtaactatcaaatatataaaaaggcattgtaccaacacaacattgttttaattaatttgtagctaaatgcatttacataaaatgtgacattgtgaacttgtgatagattagttcatgttgatgagttgaggcaaatattcaagtgcaccgaaagtttggacctagaaatgcatgcatctaaaatgtatactttactaacaccaaatataaggtaactatatttcatgttagtatcaaaccaccaaatagttgaccaaaaactcacaggactcacattaaatataagcacaaacccataatgcatcagcaaattaattaatatcaggtattataacaattcaatttaatgtagtggcgcaatttgtcaacaagagagtaaagagaacacctaagatttaagagtaaatttcataaaatcccacataatattgtccaagttgcacaaaaccacagtgattttggcacgtggcatgtaaccccaggtattatggtcctaaagtttcacaaaaccacacttgatggggttatacaatcacatctcaaatttatgagttttttaatccatcgtataactgttatatccggtttttaaaattttgatataggagtatgccaaaatggttaacggtgtggttttgtgaaactttagtacctacacgaggttatgtgccacttgtcaaaagcactatagttttctgcatcttggaccatatagatggggttttatgaaatttactcaaaatttaaacatcccaggtgctttccagcaaggtacagtgcccaaatacatcttgccatcaattcatatcttaaagatgcatataccacctattatagcagcaatataattatcttgactaaagggtgcaccgaggacctcaacaaggaaaagcagaggtgttactgccaagaaacagaccagtgacaagaaataataattacctcaatgaaggcttttggatttgggcagttttgctgttttgataacctcagtgtacgttctgcagctgtacgaccatctcggcgtgcaacagccttgaaaaattccagtaaattcacacgatcattacttgaaagttcagcagtcattcctacatcaaggaatactacatgtggcctagacttcaaaagggtgttatttgaattccttggttgtataacacggaccaaaatatttccagggtgcatatccgcatgaacaaagttatcaacctgcaaaaggtggatgttaacaatgctgcaacgtggtgaaaactaaccataattaaaagccctaaaatgttaagtgcctatgtgtaactagcaaatagaatgtactaaagagagatggtcaaggtccagtgaggttcatcaatttggaccaaaataataataaaaataatgatcttttaatattgtgttgaattgcatacacaatagttctgtaagaaactaagaacgaaggagctaaagtgatattatatgcataaaacaaaatattgaaaccctttatctttccaaaatatgtcacattttgcatattttcaaatccttggtttcaaacttgtgtaaagatatatttggattagttttgtctagagaagtgaagtgacagttgtgctgaatgtctttgctaacctatatcaatatgaaccagagatgtttctaaacaagcactgaacttttataaacaggcagttcaatttagaggttaaatgcaacaatgctcaattgaactcacgggctcacagcataaacagtaacccagaaatagaccataagacacaagagtcatcattcatcaaaagggtatgctataacatttcattgtttcactcaaatgaaatacatgctctcatctccaaacgcaaaacaataatgacaattctaagagatggctgaaagcattaccagaagcattttcaggagagcatgagtgccaatatgtgcaagggcgcttttaattcgatcatgtccatcgaggtcatcgacatagtgtgcaacactctcaccttgctcataagtttcaaccaatacagcaggatgaacaagtgggtaaagaggttttggaaaagacacatccttccaccttcggaagttgtagataaaccggctcaaatgagcagcttcccttgcaaggtcaacttgagacatcataaagacagcaaactgttgcacactctcatccagccgcaaccaattcaatgtaggaatatatctagaaattttagctactgcattaatgatagtgaaatccctccgtattgattctcctacgccaggatgtcttacttttacagcaactgttacacgctttatatgctggccaggataccggaatctcaaaccagctcggtgcacttgagcaacacttccagaagcaacaggctcttcttcaaaattctcaaaaagatcagatagctttcgaccaaaagctttctcaacagtcttcttggtataagcaaagctgtgagcaggtgcttttgtgtgtagttttgacaattcagcacagaggtcactttcaaataaatcagggcgagtagcagcccattggccccatttaataaatgcaggacctgctttctccagggtacgatgcacaagacggagccatgttttcctgtacttactgccaagagtatctgcaaatggggccatgagtatacttggagtgaacaacaatgccaaatatattgatctgaagattatgatgaccagctctactgctgaaaatatcaaggaggtgacatagatacgaccatcttgagcacgcgtgtaaagactatcacgaattggtaagtactctccgtctgcactggtcttctgagctagcattatctccccagcaacgaaagcaaagaggtaaggaactaaattagatctagtggcagccaagctaatggcacaagcaaccctacttaaaatcggagatgcctttggtacatgagaaccgattgtcatgagttgcttccaagcaagttgaccatgaaatgcattctggctacatgttgagagaactgaaaagtttcttgcagctggattccggtataaactctcctttgctcttccaagcatggatgacgtgcccggtccatgcggaaccttcccgtgcaaacaggccctgcctgtatgtgccaaaccgaacgcaaagttggatccaatgttatgtgcagtgaaactattgggtttcgagttaaccaatacatcatgaactagttttctgctcttccctatttgcataaacctggaagcaacaggaaaaccatttacacttctacattgcaccaaattaagcaccaataagctcagtagattttgagctgcggagctgacctcgacatcatggtgttcccggacagcgggcgcgtcaatgaaggcgggatccaggctcgggcgaatcgtacaaagctggagagacactcacattagaggttcggatttagcaacgcgattgggctccgcgcatccgcgagcgaggggcgaggagatcgaatcccctcgaggtcatagaagcgagcgagaggtgggcgggggtggggggccaacggggacttaccgatgcagaagagtggttcgttggcggggatgagatcaccatggctgggcccgggaaaccctagaggcagccatgatcggcggcggcggcggcggcgacgagacgggggcgcatggatggaggagaagcgcgggggtcggtgggcggcgaggcgctagggtttggaggcggaggcggaggcggaggaggtggaggtggaggtggaggtggaggcgagctgcaaatttggtggtccgatgagaggaggacgagacgccgcgtggtgcgcgggggcggacggacgggcggcagcctggctggaaggagggggggggggggtgtgtgtaactgacagcggaggcgagaagacgacggctgtgctttccttctgttccggcctccgtggaccgggcctgtactcttgggcacgcacgcgggcctgcttgcgctgcgccgtctttccaaacttttctgggtttaccaatacttttaagtaaattttactttaggttatttcgctttaaaccatcttttcttaatagtactttgaatcagatttttttattttttttaagtactctagaccatatttaacttttttattcatctacattcaacttattataaaccaaagaaatagtcttacgtatacatgtgtgaaagttcattgataaataagagccaacataatcaagattgttcatatacctgagaaaagagtctgatgtttcaaagtgaaacatagataagtctactccgtctaattaaaataatattagttaaaggacgatctaaaataaaatattgataataaaaggtggctcctttctttttggcaaaaattgaatccatttccagcaatccctgctgttttagaaaagctgtccatgcttaactcgttcgttaatagctttgttaatctactccaccggttcgacagaaatgtcggtagatggtatgaatgctcgaggaaattcagcgtccttttgtcgataagtcacgatcatcaactgagagcattcacacgtgtatattcgtgtactagtaggctctgcatcagcttcgattatttgtgcttaaaaggaaaatatctacgaagttctaccgtaacgtggcacccagcagataatgggtaattcaaatgaccaatccgaatagcaactgtcaaggtaacatttcttccgttctaaaacaaacaaacataaaataaaatgctgaatagttatatatctatattcttatcataagtttatttatttttgaacgaaaaaatagttattataactagtcctaaaataaataaattataatatagcacatactaatactataacttttatctagatttttttagtattatagtattcccattttctatagtaggcgaagaatgcagacatgacacggacccatcgacgcgggacggcctggtgagatcatcctaggccccatccatcaatccatcacgctgggccgtctgtgggctgtctgtcggtgaccacgcccacgcagcccgcgacccagcgctcgtacggttacaggaagtggaggacggtggaaaaattccacaagagttgggggggccaaaaaggacaagggaaggaaaaaaaaaaagtcgccgatccgtttcctcctcgattgccggcaagcggaagagggagagcggaagcgaggaggaggaggatcgaggcagcgggcgcaacgtggcgcgcgctttgcttgcaacggaagcgtggggattataaaagagggggcgcgagatccagatctggcgccgatgcgccccccctccctgctctccctcaccctcgactccgcgctcctccgcatcgcccacctccacgacctctcccgcctccccgaccacctcctcatcgacctcttccgtgtaggtacccccacaccatcgctcgctcgattgatcccccctttgcccctctcgtcccgatgctcggatgcagtgttgtgttgtggtatttcctattattgtttatgttggttggtttggctgatctgtggcaattggctgcttagattgatgagattaatgagactaggttatatatgtggtacatcgtgcgcgcaattagtggaacttatcggattgggaaatgggaagaggtgatttgcaccacctgttttgtgtttagatttagatcatatcacacgaggtgcccaatgcggcccatgtttgattaccaagtggtctgatgatgctacgttgaacctgtcaattttgctgagaggatggatgggggtttatgaacatttggccatgagctggggtttagactcgtagttgtgatcctactcacttttttttttattattatgatagatcaaactgaaagtaatagttttgctattatattttgttaatctctgaaggcatctttgttggcagagaactatagctgccggtaagctgacagaaaaagtcctgaagttgtttctggcaacggattgcgaggaaatcgccttgcttgttcagttgctcaacattaagcagccgcttgtaccggtccttcccacgagtatgttattcatcagcttatctctgtctatttgattgtcatgtgatttatgtcaaaagatcttggtttttgacacgctatcctcttggctgtagggtgctctgagaagttctagaagtgacactgattaggtcagtcttggttacctgagaaaagatgtctttggaaattcaggacagtgaggtcgacattgtgattgcagcactccagcccaacctgactactttctttgaggcatggaggccatttttctctcggttccacatcattgttgtcaaagatccagatatggctgaggagcttcaaatccctacaggttttgatctcaaggtttatacgaagtcagatatgggagtgcttggagccacatccatcgacttctctggtcactcatgccgttactttgggtaccttgtctcacgcaagaagtatgtcatctcaattgatgacaattgcctcccagcgaaggacaatggtgggttgactgttgatgcagttgcacagcatatgtccaatctgaagacacctgctacacctttctttttcaacacattgtatgatccattccgcaaaggggctgactttgtccgtggatacccatttagtctgcgcgagggggttgagtgcatgctctcttgtgggctgtggcttcacaatgcagactatgacccaatgactcatgttgtgaagagaaatcaacgcaacacaacgtatgtggatgctgtgatgacagttccacttggtgcgatgatgcctgtgagcgggataaatgttgcattcaaccgtgaggtgctgggacctgtaatgttccctgctctgcggctgcgcaaggaaggaaagcacagatgggatacacttgaagacgtttggaatggcttgtgtgctaaagtggtgtgtgatcgcttacggtatggcgtgaagacaggtcttccttatgtgatgagaagtgatgcagaagcaggtaaggctctcgagagcttgaaagaatgggaaggggtgaaagtcatggacgtcgttcttcccttcttcgaatctctgaagctatcgagtacttcagttactgttgaagactgtgttaaggaactaaccagcattgtcaaggagaaactgggaccgcagaatgcaatcttcgctaaagctgctgatgcaatggaggaatggaccaaactctggaaatctcacggagctcaaagcgcttaggctgaaatttggttatctgttatgagcatatctgatttcgatacccactgttatgaaactgaataaaccgcattcctgtatgctgggaattttctcgttagtgtacgctccaatactcgtgccgttttcaaagacaagcagtgatatgcaaagcaatgctgtgtatcttgtgtgttacatcaggagttttttttaatggtgatttcgttcatagttttcagacatctgtttccgtcacacgttcgtgggaatgacttttttcatatgaaatgcgcccatggctgcgcctgaaataattttacttgtcccgtttgggatgaatgaattcttttcctgttcgttgttcagtaattcacacagagtcataaacataccggtggaaacatgctcacaaagaaagaaacatcatgaagtcaggctaaggataagaatagccagcacacctagagcaaaattttactaacatcagatgcaagaaagtctacatgagttctaaaaaggaaactggggaaaactaatttacaccaattatcactaatagtacactaaatataaacgaccaagaagggctctaggaacccattttgtatctagcacccgaacgttgaacctttctcccgataaaagagggatcaggcgtgcaacagactggctctcacgccagggaaaccacaggtacaaaagaggcagcgaaagaagaaacaaaacttttcctccggggcgaacatatacaacttgagaggaaaaatacacaatggccgagagacaaatcacagtactgtattgatgtgcagtgctttcaacaacgaggtggccatttgtttcaccaatacctgttgaccgccacgttgcccatcccttcgttcttcgatcaggttttgtagcttttgaggaagatcattctcaactatgagctgctttggtcgaggatgatgctcatagacaacctgaaagcaattccaaacaatcgaacgttaaatcatggagttcaaactttacaaaggtacattaaacatatcgttgatattgagtaaaatgaaattctagacttatttgatcactgctagtagaaggttgatatattaaaaccatgtaaccagaaatttaaagcgaggaatgcaaacctttattaattttagcagtgtcaaacgggcaatagcttctcggtggtcaagccttgcaataagcagtgtcagtaaaccattggtagccattgctgtatttatccgagaagatttcctgtagtcaagtcaatgcaattgcatgtctcaatattctgtatcctgtcatgttcatattatataatgtcatcaaaaaggaaggtaactctttggtcttacgtgattatcttcaaaaaagcatccaatatatgaacaaaatattgttcagggcagtcttgaaaaaacttcactaatttctgaatggcatctttcttcaacaaggcttgttccacttttctgtgatcattgtcatgggacaagcaaacagcaattgaatctaacgcagtacacgcccatgcatcatcctccaataagttcaagtacacatccaatcctccatgagccctcaactgctctctagagttgcgagaagcgtgagccatatcacacagcagaggtaaagcatattgcctgagaggtgagtctgacatgacaaaattcattaagtgagggatgatcccattttcagctgcttgttcctgtcttcttttattgatcttgcaaagattgaacagagcattgaggacctaaaacagcaaaaaattgcatagagttataatgtgctgagaaatcgtgcagacctatttcaaattctgaatagccaactgtcttgacatttgtccctaacacaaagtttgcgaattccagaaaaagtgcagttgcacaagccattgtaattttgcgatgtcaccattcgtttttctactcctacgatcccaatgtaagttgtttgagccttctcaactctttcctacacataagctgttttagaacttctatgcaatttttcatctgttcttacatgtttgtcattgttaaataaatgctactacccgttttacaaacaaatgattcatcttttccaatgtataaatgaagggcatcaaagtcattttgagttcttttcttaattcttgtgcagaagtctaaaatcactgacatttggaatcagagggagtaccatatttactttataatatcatggttttgtctatttgattccagtacactgtacctaatgaataatgatatggttgaataaaatgcaagcataagttcactagtttgctcatctagactctgtttgtctgccagagataacataaactcttctttaaaaagcaacagaaattttactattcaaaagagggagaaaaccaggataaaaaacatttttttttaaaaaaaagaaaacgagtaagcatctaaaaattcatccaaagcaacaggatataatcacatgtgcagccaactccgtatgtttaaagcacatagcataagaaaagcctttaaaaagaaactacccacctcactatgtatttgataaactagagggccatcatgaagttcaagaatcggtatcagatgcttgattgcatctgtgcgctggagtgtctcgagacaattaggatcacccgacaaatgattaatgcacctaagaatctgcagaaaaggaaagatggttcaagaacagaaacagaaacacaaacaaatcagtcacaaagtagcaacactaagtcactaaaatgcttgaagttttaccttaagaagaataggcggttctatcttgttaaacatctggaaaagccgtgcaagaaggctttggctagacatgagagattttacgacagtgtctgcttgtgcaaactccaaaagaagatcagcaactttctcaaggtactcacgtgccacgtcagcactcatagataccatctgagctaataggccagatgatgttgtacttcccggtcttgcatttaacacccctgatccagataacacaccagatgctgtctgtgatgcagctccagatgttgatgctccctcattagaagttgttggacctgatgatggtgcatatttcatgcttggaaccctatttgaagtttttatgttggaatcaaggttaccattttctcttccctgtctagagacctctgcatgaaatagaaagaacaataagtgcataaagaaaggttgttccctcgtacctaaccacctcgcactaactacacacagtattctatagtcctaaatactgctatacgaattctacaaacagagtttagaacagtcaaaacaaaaactgtgtatattgggttcataaaaggcagatgaataaatagcccacatgacccaagacatggtaatcataactgctgagtgatgaagagagaggaattaagcataccagcaaattctgccattaacaagtcaagttcgccgttagttttcctctctgttgaagcatgcagtaatggcaaaatactttcatgcctttctagaccagataagtggcgaacataatcaagttgtccagatacatgccgagagggtggttctttctccaacaggctcagtaggggacgaatttgatcattttgaccactactatgcccatttgatactagctctatatgctttggtgatctatctgttgatgtccttcctgcagaaacactaagccgttgtggcctaatgggatcattatcatttctctccatgtgaccagcagccgccatatcggtgaatctaggcgatgctgaaggatccattatgatatgatgcctatctgcatctgcttgtaaagattgcagtgaaccagatgaatggtgatgatccagcctcgttttggaaatttctagcattggcggatctaattgaccagaccttcgcctgggggtggagccattctgtgttactgaagcaccagacccggagatggaagcaaaccttgttgcttcattcaagctatgaagagtattgaccagcctaagaagtatcccgttttttgccgctatgcgacagaagtcatttcttggagtcgaatgctggagtttgaagacctgccatatgccatcgattgcaagatgaaccatttccctgctaatttaaaatatatggaatacactaattagatataatcattaaattacaccacaaaattccaaagggagtgttaagagaagagtggactcacctgtattttgcataatcaggctccagaaaactcaccaatacagggatcccttggcatgcaatgaacatttgcaatgtcaaggtgctgaggatgcaaatttgaaaattagcccacaacgtttaattccttttatttgtatctaaatatagttagacactaacaattaagtcaaagaacaaacctggcttgacaaagctgctgaaggaacctagagtgcttgcacccgaacttcctttgcacgatctggcacggcaaaattcataaccaccggaatctgcaaataaattttaaacagcacatatcaattccacgtcaacagaatttataagtcgtaaatagttatctgaataaatggtcttacaaggccaacaaggcaagcattttctaggaaggtcgtattatcttttactatttggttgatgagttgcagaacagaagtaataatctgcagggaaaacaatcaacttttcagcgtgaagatccagtaaaaaggttctctcaaacaaaagttaaacttcatacacggtttttgggaagttcaagaagctccatcagcggaaggaaaccattttgtgacacataaatctgtttttgctcaggccgttgattgaagattgacacaagcttttggcaagctgataatatcacgtcctcactttccccaggtttcagctgtgctactattttgctgtattccacagactacaaaaaaaaaaacagacaaggaaaaatacttcatgatcaagacatgataactataaatgtatcaaaacctaagcagcaaatattactgcaatttcaaacatacacaataattatgattgttttggggaaggaaaatacaaaaaacctttccatacattttaggcacagaaaacctgctttcaaaaaagatgaataaagtgttaactagcacaatctatcctcctacgtagacagtttgccagcagatgcagttggattctaaaacttctgcagtactctggatgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactataactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctcttcaccagtagtggatgttgaagcttcagccccatgatctcctcgcttcttaggtgggaataaatcatcaaaggaggcatctccaggtgtgtcactgaatctacttagctcgttagccatctcaactgaagttttagcttcctgtcaagacatgaaacattcaacggcaattaattagctaaaaacagctacaaatgagaatatgcagaggtcacagatatgctcaaggctttgacagtgaagcctttgggggggaaaggcgataactgacaagctgcagatcaaaaatatgatctatcatacattggataaaaaatgttctcatagaaacattgcgccactctagtcatgcatgtcttaatactccctctgtttcacaatgtaagtcattctagcatttcccacattcacagtgatgttaatgaatctagatatacatttcccacattcacagtgatgttaatgaatctagatagaacatcactgtgaatgtgggaaatgctagaatgacttacattgtgaaacagaggaagtataaaatattcaatgtgctgcatttagaaatgttaaaatgtacatctttgaccccccccccaaaaaaaaaaaacttatgtgcaaggtcaaaatgatgtgcataaaattatcaccttttggaagttgatattttgtcctccagcctggaagctgaaagcatcaccatcctcaagacttgaaccatctttactttcatcttctacatatttaccatcactctttcttgattcttggccgctgctagttaacttgtttggtggaccatcttgtgatacctcatgagttagtttaccatttaaatcagttgcgcctagtgaagattccaatgatagcttctcatggaaaactaatgtaggatctttattaagaaccacgttatctttcataagttccacatcattcgaactactactcccagtagtttttaacattccatcatgaaactcatcaggtatatcttgcctggcagattcagaaaccaaatcttttcttccatcctcctaaagcaatgttaataaaaaagttcacattatgatagcgtaataatcttgtgagtccacaattttggactaatttcaaaatatgagtagaatatggcatgccaagaaccctgaaaggcatatatacctgttcaaggccagaagcagtaggtgtttgtgtatctcgtggtgggccagaaaatccagagtgattgtcaccacttgatccttcatcgtcctcatcaatatccctgacagtactaacaaaccaggaacttagcaatggcttatcaaggtcactttcgaaagacggttcaaaataattttggtgccagctatttgagagatcaattttgctgagattttaaactatgattttgttgggcaattactatgcagttgtaattcctggtagactacaatacaaggctatgcaaaatccatgtgaacaaccaacaaccaaaatcagcaacagaccgagatatgccgcctatgtcaaataaaataacactacttaaaaagttaaaagatgcaagtggcaaaatgctacttagctaaccacaaaatttaaacaggcacataaagaaaaaaatgggattatacgtatatgtactatgtaaaagcagagagagtaaaactataagaaattccagtggcaaacctccagaaggaacatctctcacaggaagttgcatctataactaacttaaacccactagtactgcaattaacccctggacatgtgtagttgtgtacacatcctacttgctaaacgaataactctagcaatgcttgaataaaattgaccagtacaggtttaatatgcagaatatacaaccattattatagacttatagtgatcaggtgactgaaaaatgacaagctatggagctatatttttctgttttccgtcctgtttgtatctttatggctattattgttggtttatcatttacaatgaatagcaattgaaaagaaggaggcagtaaatgtgagctaccttggtgattgaacaggttgtcgaagagatggcaaagctcgccttgagttttgcaaccatgggtgcatcaataatgtctttgcatcaggtctttgtattgaatcctacaggtgcttcttgaagtcagaacagcaaacaatttgataaaataatcattaaattctcaaagatatagccagaaacgacacagaaccttttgaaaacattgtcgaagaaaatcagtaatctcaggagataagccttctggtattggtggatgcacatcctattgtccatagataaaaactttctatgtaatcatagtctcatgtgtgaatggatattgtgacttttgaaaatgtaggggaagtaaacagctgcaagtaatcaacctgaacaatgcgaaacagcgcaggcatgggctgaaggtcataatatggtggggcacaggtgagtagctcaataacagtacaaccaacactccagatatctgatgcagcacaaacacctgacatttcgatgacctaatgcacaatataaataatgaacaaatacattagcatctcgcaagaaaaagtatgtttcagaatcacaagatgcaaataattttggttgataacgcttggtgtaatgctggcatggaaaatagcaataagttctatcctgttggcagtagtaattagcttttatgttgatagtactagtagaattaggagttaaacctaatcgattgattcattgaaacagcataagtgaagataattagcaaacctcaggggccatccagtatggagttccaaccactgaatgtgtgttgatatcagcttcagttaatttagtagcaactccaaaatcagcaagtttgacaaggccctaaacaagagattgtacattaatgagaacatgtagacaaatttggtacataactgcctatgaggtattcattccagcagttctctgtttccataatttctgctagattgctatatatgtgaatgagctcatctcagtgtaccctttcctaactcctgcatagtatttaatttgtgttctcatgttaacagaagtgcatgaagacgacagcttacaaggatgttattcaaaacatttttccaaaatttgtatacttaagatattccctttgcaattatctcaagtcatcacaaaaggggtaaatatggatgtgatgcagcaataaacctctttggtagtcaatatatttgcgcccttgatatctctatgtatgacaccttgctcgtgaagataaacaagtccttccagcacctggttcgatatgtaaaaaaattaataccggacatagcaaaaacaggaaagttgcaggtaatcatcatattcacctgagcaatgtagacggccaccaatgattcagggaatggcccaaatttgtttggcttgataatattggcaagtgatccattctccacatacctgcaatcatcccatgaggattaaaacttccaagctaaaaaaaaaaaaaaactaatagcctaataggtataatcatatcaagaaactgtcatgaggattgtgaactgcttactctagaatgatatggaggtgactccttgtcttcaatgatccaagatacttcacaatatttttgtgattcagattctgcgtaaagtggcagaacttagaattcgcagcaatacaattttcttgcgaacgtatatacatttcagatatcaagaaccatttaatttcaagtacaatagattatagacatgaccactaaccacagaagaaggaacggtatcatttttcattaaattttgggcatcagggcatccataggaacatgtagctaaacatttaaatagaagcttgttgggtgtataaaaataagtatacattgatggaactccaaaattttcttcataaatttgttcatgtaaggctatagctatagaagcataatgataacagcaacacttacatccaaagataaaggggaacagatgcaacaaaaacaaggataggcggggataagagattatttaaccagtaagatgtgttatttagttttttgtcaagtacaaatatgataagtaaataatgtgaaagaaaatgaagacttactttcaagagatcaatttcttgctgaatcagccacagcagcataccatgaacggaaaagtcacaataaaaaacaatttattagaacagcagactacagcaatacaatagaaattataaaatggtgatattcaaataaaatcttgacaatgaaagcactgaataagatagcacaatatggtggtaggataaaaaaagtataggatttatcaggttgtgctaaatgtcaactccaagcactaaaccatgcatgcaccaaatgacaaaaataaacaatagctcgtgcaattagttcactttagcaaaaagtaacaccaacagattaaacttctaaaattttttggtttggactcctttatgaacctcaacaccaacagctcctttgtaaattttagcttagcacatgttggcacaaataaacattaatcatgtagatttttcactgactttttcaagtttctttcctaagtcaaatagtgtttcaatattttcaccaaaatgtgtatctgtagttgaacctaccgtggccagattttggttcatggttcaagttgacaattcgatgattcacatttagggttccagcagagtgaataccactctagctaagaaatcagaaatggggtccgtgaacccaacatcgacacccaactctagtacaaaatgttgtataaaaaggtcaagctgtattacagctttccgtgggttaatgataaaaaggagaaaagggaaatgaatagttattgcctcctacccttcaaacccaaggcagtcatctccctctgtccttacctgcccactgaaaattcttctctctgtccaccacatgaaggtagactgataaacaagagaagtcacaaaaaaaaactgaagtagacattggtgagtgtagcaatggcgatggcttcagcaagcagcaagccagctgcgacaatgtgtgcgggaataaaaaattaaaaaggaacaagggtgacaacttcactgggcagcaaaatggatgagtgacagcagtggtcatagcaatgaaggggagaaacagaggtggctatggagaccaaaagcccccatgaacacaggaccggaggacaacagcaaggataaggtgtcagtgtgagcgttgatgggttcacaaccagatagtgaatcatactaagttttggcctgaatcacttcactgcagggttatcgtggctcacagtcattgccgcaaatctggtaattatgatctggacacaaacggaagtaactagaacatgagctccatactattgcattcgataaacatataacctaccacacaattaaaccagctattttatacttcctccgtttcatattataagactttctagcattgcctacattcatatatatgttaatgaatctaaacatatatatgtgcctagattcattaacatctatatgaatgtgggcaatgctagaaagtcttataacctgaatcagaggtagtatcaccctagcgtatctggccatgtgttcaggacttctattacatgcctggataggcttaggaagctgactagtgaataactgagctaacagaactccactctatgatttagttccacgtcacgctaccgaacaaatcgatatagcaaacaacaagcagtatttccccaatttccagacgcacttatccctgttgaggtcgctgctgcccgtttatcaactcccgacagccacatttcacgtaatcgcatacatcatcttttttcctttggcacacgttatgcatcataagaaaggcccaaaaagaaaacctcaccatgatgatgttgagatcctcctgcgggatgttctccaacgatacttgcttgatggccacgaagtctccattttccaggtcaagccccttgtacactcgcccatatgctcccttccctatttcatctccgagcatctgcaccggcccccacacccccccccccccccaccatgcacacagtcagtgagcgaaaccaaacccaaaattaacaccaccagaacacgaattccacccggatccgaggcggtaggctccggaacactcacatatttgttgtcgagcgtcttgttcttgtggaactgcgcattgtgctgccgcgacgccatctcgccccgccccccacacacacccaccccgagatcgggccccggacgccgccgtccgcggcgggggcgggcggatcgggggtcactggcggcacgggaacggctccggcgagcccgccgcgagggccatttaggttttagggtttgggtgggaagggaattggaggtcgaggcggaagcaggaggaagaagaagaagacggaggcgatggaagagagagagaaggggaggagagatggggggcttttccgtaattattttgttttcggggggcgtgggaatctaacggaatgagagggcggcttttatactcgggggtgtacttttgaagtgggcggaagccaacgaggatattgagagataagcggaggaaaccactgtcaattagctgtcctcaactagcatccgcgattttgtagcacatcatccggggccccctcgatttttctttccaaaggaaaaaatagaccatttttgtccgctgcttgcgtcatttcttccatggctttcttttccggtcattctctagtggcgtgtaaggagatttttatatttatttggttctactaggctggtttctgtcgtcggcgttgcaacagtgtccttgtgcacaagaacaaccttaaggaccacaaagactatagaataattattaaaataatagataatgattaatatatatatatggtcgactgataaaaagatggtgagtagttgtgtactatatagaatcattgttaataaagcattattagataagtagctggtaactctctttatttgttttccgcatcctagctcattctctccatatctaagcttccaacaataaaatgatgttggttgctttcacaatcatctctgcctcgaaattcaaaataaatggcatttttattaattatgtgactcaataaagaaaatttacatgtctatagtttggaagaaatcaactaaaaattaacggagtgttcaacttccatgataacctataggcaacaatatatatttatcatcacaccaaatcaccaatgtaacaataatggcagcatagagcttaagaaataatctggacgattttacaattggatgatgttggtaggaaatgaaggcagggaggggaagcaccaatgatacagcgatagagacacggcgcactcatgggtatgctttcgattggattttagtaagattatagagttgccgctaatttcgtctttttgataggattttagcaagatcatagttcagttgttgatctttgtctctttaagcgtattttggaagatttcttgcgggtacatgtgagcagttaatatgtgagcttctaataactataatttatcctagaatagattatcatcagattataagaaactatagttgtataattcataagctaggtttaatcataagctctatttagcagcttctctagactctcataaactgacgaccaaacaacatattcgcttgtgtagcaaaacctttcactcagcaagcagcttcttctctttttctcagcaacgcggtggaacacccatcatggcactgccgactacgtgtcggcgcgcgccaacagctaccataccataccatcacagcacgctaattgtacgatagaagtaaccctaatcatggatacgaatatacgacgcagtcaggtcagttggttgccacccacaatgtggctgccacttgaacatgttattcttgtccttgtgagtgaacttgaacattttatagagaattggctatttttcttcaatattgatggcaatgcagtttgcaacttaaagacatgcacaaagattcaagaacatacgtacactgacaagaaacattcaagaaagtacttttgctctctagagctggaagcagaaatttatcttgggtaaactttggaagtttgaatggacaaggtcattgatccgattattgtgtatataatataattgcatacactaatcacagtgggcatcctctagtgtctagaggaagtgttccaaaatctcacaacaattctttatttcagtcgtgccaaaatgaatagaaatcctcaactaaatagtgatacagcatgagcagacttcaaattgtaacacagctcactcgccgcttaggatagggttgatcagtggcttcagctgcgcaagatagacgattgcccacctgcagataagcattaacaaattactaccagaaaaattggcatccggattgtcacacccagtatggagcttatcaagcaaaagagggaagatcaatgatggaaccatcatgtaagcaaggcggcaatacaacgacaatcagatatcaaatcttaaaaaagaagccataagaaatatgagtgacattactccttcaataaactatccaggatatctggctctcatggacccacaaccaaagaataaacagacttatattgagcacatgcaggttacaagaaccaatggagtgaaactataagtcagaatcagattgagtttcagcgtacaactaataccacctgttctactttaacaagagttaatcatcagttcatattgctcctagaaatttagaccttgcaagattacctactagtcaataaaataatgtcaccattgtgcgattcaaagtagactacatgtagaccataagatgccaagttttgctggtagtgtgcttttcatgtttgccagcaatacttttgggtttcaattaatcaatcagcctactgttaaaatcatattttctgagcaatccagtttggatagacaaaccagaaagtgtaagtgaacaaatggatcagaacttacatcatccaacagcaaaccgttgctgtaataaccaaggtcaaatggaatctgcacaaattaaacataagttaatttaataggttagcaaaataaccacatgcatgtagacaaagctcaacagctaactgccatatttcaaacatcccagtattttctcaagacaaggtaatgataagaagacggtagtaatatgatagaaacacagccacacaatttagatagagtcaccatgctttgagaagaatattaataaaagaaagtgtgtgatacagtaccaataatggatatgaacgatgacgatattcgtcacatgaacatagtaggctagagatacaaatactcttagtcacgatcaaataattaagaacacaggctagagatacaaatactcttagtcacgatacaataattaaaaaaacacagtagtatattcggactcttttcttgaaccaatccttgaagacttgaaagacaggataacaaatcagcacaaactttatactaacccacagaaattgaggcaggactataccatgacattatgccatagttctcccaagatcagttataaatcgttcagtctacatatattaccctaaattgtagttctatgcatcgtattgaccctctacaatattcaatgtcatttatgccccttttttcttttctatgcattatacatagctattgaaaagtccatactcagaagtcaaaagggcaaagtaacgtcttcctgttctctcattcacaatgaaaataagtccatactaaaaagaggccattcttaatgcatctgactttaaactggcattgtagtttccagtcgaaaataatgcgtgagtgtgactgtgtgatctaatgacccatgttttcccggctccggtaattttgtccattagaacctcgtaatatgcactgaaacaatatcatcctacggcagcatgtgtcagaatctttttgaagaaaaatctaattggcatattattagagtaattgaaccactcgaattagctctgaaaagccaaacctggttacagcctaccaatttcatcttaagagaggaacatagggtaaagattgaacaaatttgggggttttcgcacgaagtcacttcttttactgaacatgggctaagatcagccgctacccccatcgatccaaccgtttcaaccgttatccgatcgaaaagacgacgcaatctcaacgagaaatctaccaatagaggaaatccttagccctacacaatacgcccaaatctagatcaaaaccaccatccggcgggtcaaatccgcccgaatcgcgcccgccccgatccgaaagctccaggcggcatacaggcgatcccaatcacaccacaccagatcagcagctatctgaagagaatcagcgggggggaagagcgtacaggttggtcgacggcccgcggttgcagcagagcagcgagaagagggaggcgacgaagccggcgaggaggaagatgagcgtggtcacccagaaccccatggccggcggaaagctctccgatcctctcccttcccttccctctcgatctctttcttccctcgggatcgctcgctgggtctcgtcgtctcggggcggaggtggggtggggagagacggagcgaagaggaacaggggtcagacgtgtagtcggtttaggggtagagaagacgacacgatgaattgggcccgggctccttatctgggccttggcctgttaataagtttgggcccacaaaactgtaaagaacaagtgggcccatgtgatggggtgcgcaccggtgttgtacggaataagtttagtttaggtctctcatgttgagatcgagtagctctgcttcgctccgggcgccgacttgccgatgaaggacgatgaaaaggaggtgcctttggctttggacatcaccatgcgtccatgcccgtcgagaagaagttggtcgtgatcgctccggccgccaccattccggctgtgagcgagaagaaaatggctgctgtggacaccgacatgccgagcagagtggctcctcaagccaccgacacacaagccgtggctcctccggctgccgccatggacaagcagaaagttgctcatttggatgtcattacgccaaagatgatcacttaggacaacgccatgtgaacaagcacatttgggggagtcaggataagctagatttaggttaacgagggtttattgtgtacaatagttagctattttggctgtgtttagttcgtgtgctaaattttttttaaatatacggacatacatttaaagtattaaacgtagactaataacaaaacaaattacagattccacctataaactgcgagataaatctattaagcctaattatttcatcattattaaatgtttactgtagcaccacattgttaaatcatgacgtaattaggctcaaaagatttgtcttgcaatttacatgcaaactgtgcaattggatttttttcgtccacatttaatgctccatgcatatgtctaaatatttgatgtgacgaaaaagttgaaagtttgaagaaaaaaagtttaaatctaaacacggcctacatcatctacccacagatttaaatgcttttttttatcttcttcttctaattttctgcctctttcttcatgtccactcgttttcataagaaagcaactagtctgacctcacgtggaccccacaatcatgttgacgaggctgcgttcgagcgcaggagaaagagagaaagatagttttgttttccacacgcacgctttccgaactactaaacggtgtgttttttgtaaaaaatttctataaaaaagttgctttaaaaaatcatattaatccatttttaaagtttaaaataattaatacttaattaatcatgtactaatagctcacctcattttacgcatcttctcagtctcctcaatcccgtccttctcgaacactcaattaatcatgtgctgcctcttacgcctgggagggagtgtgtcgtcgactatttagccacctgctccctccctctctccactcattttcctgccacctcactacttttgccactataggcacactacggtcggctaaactttcttactacgtattatacttgctctcatacagcggcgtggtgatttgctgcccatctacacgaaattccttttccagccgcaccgcatccgtgtcggagtcgatgcggttcccagccgtgtcggattcgatatatccggctcccggcccgtcaatgtatactaggcgaacttggaggacgtactgtactgactggtgttattatgactgatctgcagggaggagaaaagacaatggagtttgatgcaagctgcggagcaatgcgtgggaaactgacgtgttccgtcgtcttgacagtcatctccctctctctgggcatcttgtgtgcgctcctcagtttcctctggcccagcatatcagtggatcaccggaccttgggattgttgttctcggtcattttcctgatcggagccgtggttccagcttgggatcattacagaaaatttggatggtctgtctgcgtctcccagatcgaggagccttaccaaccgaagacgatgcaggcggcggcggcagcgccggattctgatcgtgatcgtgcggaggtcatcgcaaagtatatggcgttcgaggattccgtcgtcttcgtaggcaccacgctctcccaggggatcgtgtgtgcgctcctcagcatcctctcgcccggcgtatcatgggagtacagggccttcggtgtgcagctttcggggattttcttggtaggcgccgcgtttggaatttgggagcatcacaagaaattcggatggtctgttccacgggtcgaggagcctaaccaacaagaagtgaccggtgatgaattatgctgatgaagtattctctcggtgtggggttgaattgttgctcatttttggcatcaaattcactactccatttgtttcatattatataaaataataataatatttttaaaccaagacaaatatattcaactacagatttaatgaagctaattggatattgtaaataatacaatatttgtctacaaacttaatcgaacttgaaatagtttaatttcaaaaaaaatcaaaaagatttataatctgaaagggagtaccaaatacgagaaagtgcatcagttcgtgcgtgtgtgcatgcacaccaattttgtaaaagaccggttgtgatcacggttgcgaccatagctattctgtttggtgtagcttcatattttaaatccacagttgatttgaaatttatgtgttaaattatagtgttttaaaattttatatttcatcatgaaaataagatgattcatttaaatgatattaatgaaattaaacatccagatttataggtttgtggagctagaacattcaactccacaaaatctcatagaggtaattacaattgatcgacctgtactaccatctagaaaccagaatctgattttttccgttaagttagatcattctttctccttattaccatccagtcgcggtggctctgcgcacggactacactggacttcctgcttcgatcgggcgacacgcaagaaaaaacgccgatctctgcatgcgcttgctgttcctaaacgtttttgcgcgatggatgacttcgtgacatgctaagacgactaagcattgacgttaattcgttgcgctgttctaatatacacgttttccttgatgatctcagttgaatattattctgaccgttaagcataagatcgagcttaatttgttacgtacgtcaaagaaagataagaactttggggttaatttggtctttcaaaaacacttttgaaacccttaagatatcaagcagttatatatatatatatatatatatatatatatatatatatatatatatatatatatatttctctatctcaaaataactcaaattatgatatgacgtgagttgttttattgttagaatccctatgttgttaaaaatgatgacaatatgaattaatatataatatatcacttcacctctacaagttgtatatacggtttgtgttaatttgttatgtttgttataatttatagaagttgaatttgagcctacatatttgtaaagtgatatattatatattaatcatcttgtaaaatatttttaatatttttttataatcctttaattaacatagaataatcaaataaacatttactcgattgattataacagtttccccattagggaggcaaagaggcggcgaagaagggggtctgtgtgtaggcggcgagctgcaggttagagccgaagaggagaagaaggaggttcggaagggagggatggcaaggaggaaagatgattacaatgggtgcagcaacaaagattgggggcaaagaggtagcttcagggaggaggaggaggaaggttttggaacaggctttcagggaagtcgcatggggtttgatccgggctatggttttgggcagcagggtagcttcggtcagaggtggtagaggcatggttaccgcctgagaggggctcgtggttttggcccaaggcgcagcagttttgcaggaagaccagggagagggtcagcaagaggattcaggtcacaacgtccagcttttgataggaaaatggatgatatgggaagaaagggagaggagaaggggggagctgctagctcggagaggaatggtggtgcaggccgggtgaaagtgggggaggtggaggtcccccactttaaagaagagagtgattctcactaaggacaatctagcaaaaagaaattggaagggcaacactaagtgttgtttttgtaaccacaatgaaacgatacaacatctcttctttgattgtcatgttgctagatttgtttggagtaccctttttataacatttgggataaatccgcctaacaatgttgctaatatgtttgggatttggctaaagggtttgcaatctaggctaaagcaccaaatttttatagggattgcggcgttgttgtgggtaatgtggatttgtagaaatgatgtggtcttcaatggctccaattttaactcttacttgcaggttattttcagggggacgtattgggctcgacaatggtccttgctgcttaaagaagattagcgcgatgtgatgaaagaaggatgcaaactgttagagacatctatcatgcacttctttggtaaagatggatggaacatgagaaagcggttaaaggagtaatgtggtcgttagtttgtttggaaggtcttttcactttgaaaggcgttggaagtctttgtgctcttttagttttatgtaaggtgcttgagcctttgtgatccttttgtttgtgaacatgtgtgtatgaactgagcttgtttggtcagattttctgtggctgtatacacccccgttggtgtagaagccgggttttataaattcccattatctaaaaaaaattagcgaccccagcggattcgggcaagcgctagtagatcaagcctctagtctaagggtgcatttctcgttttttattttcagtttttctttttgttttttcctggtttttccccttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacctctactactacttttatactactagtagtagtactactacaactatactgttactagtagtaatactacactgttgtacataaaatttaatttatgtacatgtatgtaaaatttgtgtaaaatagggtagtagtactactagtaattatagtagtagtaggtggtactagtactgtactataggaggagaccgcgggggcggctgggcgcgcccattagcagtggctgcgcggctctctgcactcactgttcttcctgcagtcctgcttcgggggatcactgatttcacatgacatggttcacatcttcttcttattttttgaaacttaagcaattttattaaataaagacagataaggaggatatggttcacatctcacattaacaaaatgcgccgcttgctgtcacattccagtagttcccaggaccaagcagcttttcggctttcgctagatgatgatcgtgaattcgtgactcctgaacgcgcggccggcgaaaccgtcgtgcgcaaggcgtgtttcttcggagttcggatcacacgttcacacgcgaagaagagagaagacaaaagcattgacgtttgttgctccgttcacagatacgtcttccctgatgtatcatcccatttgaatatagaccggctcgttagggacgtgatatttgggggtttaaaattgatcccgctggactttacagtgcatacgcactcacaagtcacaagtacgtttatacatatccattccgaacacgttccagaagacgaatggtaatatgggattcgtgttaataattaccaagactcgttctatgtatctgagtgaacgtacgttagttcctcgaaggagatggggctgcttctagttcctatacttaattacatgacatgtcctaacagaattcttcaggttgaaggctaacttaaaccttcatattatactgctaacagccttcttccgggaaaaaaggtacacatccacatgccgcaaaaggaaagatagtttattcagctgttttccgatcaataaaaggaaaaaaaaatcattcatgcacaactgcatgcaacagtaccaaccaagtgaaatttgacgacatttgactctttcacaaagtcacccggctcatttttctgtcaacgaaacagaggattacacgagacagtgccgatctagcccaggagaaacaagggaaaaccacacctgattactttttctcgcggctcgcgggtacaaatactgggatcagcgcccgctgtatctgtccatctctcaattcaaatcacccacgtcaacagaagtaatcagccacattggcaactggaaatgtgtgagggcggaagggcagcagcatccatggctcgcacggcgagcgcgtcccggcgacagccggagacgaccagcctcgccgtggatgaggccggaggcagggcgtcgcggaggccgagaggatggaaagccgtcgggttcatgatcggtctctctctccttcctgtctgctcatgaattcgtactccctccatctcgaaaaaacccacctagtattgaacgagatattttctattgcaataaatctgaatataaaaaatgtttcattcaatactaaattgtttttttacagaggtagtactacagttcatgataagttcaaaatttgagccactgttttgttttttaaaaaagcaagaacaatttaagagtgctgctttgtgagctaatgaccaaatgctttttggtgtgcgtggaagcagggctctacctggcaatcgccatggcgttgaacgcgttcgcccagcccgtcaccaactacctcatcaaacgttacaacatgaagccgaatgccgcaacaaacgtggccaacgtcttcagtggcacctacagcttctcgccggtggtcggagccttcgtcgccgatgcgttctgcggcaggttctggaccctcttgttcggagccgtcgccgcctttgttgtaagtgatcagcattgcatccatgacccatcagaaaactatttaaaaattctcgaaagatatatcttgttatttatacatgtcattcaaataattatgattttttaaataaacaagataaatttatttagaaacatataaaatttaatttaatttaaatataagatgcaatgaatataggttaatttgtcataatcaattttattgatttttttaaaaatattttcataactattcggataatatgcgaataattaacgagggaatgttctggagagtttggagtcccctctcatcatccatctctcgcttatcaggttaagagacgaaattaatggctgcttatccgtgatctcctctcgcccatgcaggcaatggtggtcatcacgctatcggcgacgatccgtcagctcaagccaccgtcgtgcagcgacgtggcacggcaagccggcacgtgcgcggggccgtcgggcctccaccgcgccgtgctctacatcggcatggcgctgctcgtcgtggccacgggcggcgcgaacccgaccagcctgccgttcggcgcggaccagttcgaccacgacgacgcgagcagcggcagcagcagcaacgaagccgacgagcgacgacggcgcgccgaggagcccgcggggctcaagcgcttctacaactggtactacgtggtcaccatgatggcctcgttcatggcgctcaccttcatcgcgtacatccaggacaaggtgagctggggcctcggcttcggcatccccacggcgctcgtggccgccaccttcgccgtgttcctcgccggcacgccgctgtacgtccgcgtgccggccgagggcagcatcttctcgagcgtcgcgcgggtggtcgtcgcgtcgtgccggaagcggaggctcacgctgcctcacccgcgcgacgcgcggcagcaggaggccgttctgtacaatcctcccgtcgtcgtcgcagctggaacgggaaccagccgcgtcttcaagctcccactcacgttgcagctgagctttctgaacaaggcggccattgtaaccgccgacgccgacgagatacggccggacggatctccggcgaggccgtggagcctgtgcagcgtgcagcaggtggaggaggtgaagtgcctcgtcaagatcgtccccgtgtggatctccggcgtgatgtggttcatctcggtggcggagctgaccaactacacgttcctgcaggccctgaccatggacctccacatgggcaggagcttcaccatcccgcccgtgtcgatcgccgccatattcaacctcgccatcgtgctcttcgtgccggtctacgatctgctcgtcgcccgcgcagcgcagcgcgtcaccggggtggagggcggcatcacggtgctgcagaggcagggcgtcggcgtggcgatcagcggcctggcgctcgtggtcgcggccgtcgtcgagcgcaggcgccgggcctccgccttggacaacggcgggacgtcgccgatgtcggtgttcgtgctcgcgccgcagctcgccgtgatgggcgtctcggcggcgttcaacatgatcgggcagatggagttctacaacacggagttcccggaccagatgcgcacgctcgccaacgcggcgttctactgcgcgcagggggcgagcagctacctggccacggcggttgtgaacgtcgtgaacgcgaggacgaggcggcgcggcggcgggcagggctgggtcgccgaggacatcaacgccgggaagctggaccacttctactacgccatggccgtgttcgcggcgatcaacttcgtctacttcctcgtctgctcctacttctaccgctacaagggcgagccagaggtggcggccgaggactcgccaccggccactccagaggccgtcctcctgaagcactagccagtagctagcaagattggttacggtagatcactctatgatcaattaattcgatttattattggtgtgattaataataaagttgccactactggacgcatcgcgtttacggcccatataaaaaaaagcccatacaacctgtcacgtgcctgacatggctacccagtagtcccagtacccacaaatggaccgcttatatgagccgcaaaggccgtgatcgaacggctatcagatgccttgtatgatgatactatgatctgatgagtacttcgtagtctgctgtacgatggaggcatggagctgaaggggatcgacttcctgtgttcgatctgggacgcataagcttgatcgaaccgtagccatatatcccaagagggttcggagatttactctccgaatcctcaaaccagcaataatatcgtgactgaccgagccggaggctgtggccctgaataattttccgtttatctgggccgcaaatggcatgatccaacggctgtcagatgtcccaaggagggtcggagtttgaaacgatgaccccaagaacaccatctgaaaaacgacagatgcaaggacttcactggtgagtaatgaggatgcatgcgagatttacttcacatcataaatggcatgcatgatctgaatatctctgatgataagatgatgatcgagtacgggtcagctcgttggatggcggatggcctcgccggcgccgaccacgaagggacatcgtggacgtgcacgatggccgccggcggcatctcttgctgctccgccggcgtggacggcgccgacgccgattggttgcagtctgcagtcgtccgcgtccgcggtgattaagtttagtaatgaagatgctcttgcaagatcgatcagaatgatgagagctggccgcatcccggccgtccatgctgaggtacggtgcacccaacggcgtctgggtcgatgtcaccggctccattcgtctccagcgccggcctgtcagagtgagatgccagctgcaggaggccgtccgtcctcctgaagcactatctagcaagatggcttcatgctcttgaatcttgatcatgatataattaattaatttctaaatttccagtagatgtgatcgacataagaagctatcactaatgaggatacacacgagatcgatctagttacatgatgaaacgatgagtatatagttatttagttagttacatgatggagcaagctggagggggatcctgctggtggtagactacgctctggtcgtactcgtaggatggccacgccggagccgaccacgtcgaggcggggatgtagtggacgtacacggtggccggcggctcaggcgccctcttctccgcggccgccgtgtacaccttctcctcggccgccggcgcctgcttcttgatctgctgctgctccgtcgacgggttggacgacgacgacgacgacgacgccggcggcggcccgatggtcacgacttccgcgcgcttcccggccttcctcgtccgctcgatcacgtccaccgggtccgcgctgccggtcaccgtcatcgttcccttctccgagtcgatatcgatcttgtcaacacctgatcaacatggacacatgtcacactatgcttcacattctttttgcactttgtaatttagaatcaacagttcatttgcttgtttcttcgatctgttaatgcttcatattagtatatttgtttaaaaatatatatatgatatcgttgacttatcacataatatttgactactcgtcatatttaaagaataatataaatacaattagatataagttaaaattatagtattttctttgatgataaaaaagtaccttggaggccggagacggtttgcaggatcttgcgcttgcatttgtcgcaggaggtgtccaccctgagcaccgtcttcttcgacatggacggactggtgcgagagagctcagctctcccctagctgctacgtatccgtgtagatcgagtcttccacgacggcagagccgtgcatgccggtgtagcgggtgctctgctgccgcggtccttgatcgagctaactaactacagcctacaaatatcttgcttggcttttatactgctgcctttcagcctttcaggtggcagtgaatggtagctcaactcctcgagtagaagtatctccttgatgcgtctcttcattggctagctctaccaatttgtcatcaacaactctctagctcgctactctacatttctagaacacggttcacatttttcacgctactctacatttatagaacacggttcacatttttcacttggtgtctggtgatgccaagcaggtgtcccgtgtccttcagtatagtcatatatggacatttcttcaagattaacggctggttggtagtaggcaagtaggcaacgaaccttaactgcaattcctaactgttcgtacttgtaggttagtgttgcgctcgcaatacgcagccacgtctcctctgtggatgttggtggttagaacaactttaacctatccatgactccatgggctatacctatacataattaacagcctttagcattctagagcctagatattgcatatatagacaagcaatatcagaagaataagaaacactttctgcattcggatgacctcattttagacatttagcgcaacaaaatcacaatacgcctacactgaaaatactccggaaaagaaagtacagaaacgactaacttgccaggccgcactaggatgtcagaactcagatcacagattcacagcaagctgagtatacgggaatttatcatagatttccaaggtaaacgtggatgcctcagtatacagtttattaactcttcttaatgtttgtctactgaaaattcggcctactgctgaggcaaaccacacggtatacaggatgtactacaacaactaccactctcttacacgttttccctagaagggaggagaacctgcacattggacatgcacacttgtagaaacacaacaatcaccaagatacaacagacacttgtcctatgccctttatatttcaaggtcgtcaatgttggagctgaacctttggagctgaacctttgtgtcacctagggccacatccctttggaggatcacgtggatctcccccaacttctccatttctagtgtagaaattgactatcttttgatccaatttaaagtaatgtaccatcttatccaagggtttcacatccagatcaataaaatatgcctgcaacaacaaatgtgcaaatcaatgggttggtgggaaagaaacattaataaaaagagtttttagaaagaaaaaaacaattgttccacaaggaactagatgacttatcgaacttctcaaacaagaaacatatcacatcaataccttgtaatcatagctttggttcactgaatcaagaaatacagaatcgtactcagaatctgttgttccactctgtcttggtcgaaagctgatcattaggctacaatcttttgcagtagcagagataagaaagtccctgacaatcttctcactcttgtccaatggaagagaatgcaaggtggagtacttgcgcagaagttctgtatcagttatacttttgcataccaaacaaggctgagaaatgatgttatagtacagatgaatcgccccttcgatgtcatgatcatccagtttttgagtggctaaaagtttacccaacactccagacttaaagattgcctctgacaggagctcaataaagtcagatagttgtaagccagtaaccttgctcagatcttcaagacatttctctgtttcattaggatgaacactatctgcgccacctcccatgccaccaaaaactaaagaaccatccacaaaaattctaaagttgttctgaggagttgaaaaaaatgacttgatagccatatgtattctttcttttgatccagaaaataaatctaggggatcgtattcacttgtcttcgatatctgaaatgtgtttaaaaatatgtttagaaccaagctgatttgaaaagcaaaagggatgatatagcattgcaacttccaagagtgacagaatgaatatgaagcatctattaatatctgtttcagctagaagagtagtttgttgtctttcagtgagcaaaagagtagtgtgctattatatatttagtactcaaaattatggctgcggtgaaatcaaaatctggtacccaaaaccaacatacctctcccagatgaaattttaggtgctgatgcatcttataccgtgttacttgtttcttgatagaattctccttcgatatgtattcagatgacggaagaaatccacattttgcctggaaggcaaagcatgttaaaagaaatgtgtacaaaagatgaacagtgaagaaataaataaagctcaaaatgtacctttatctccactgctatgcaactgcttcctctaggattacctgaggtttagaaaaattaccaaaaacaaacatagtgttaaaaaacaaaatctagcagcgagttacgaataataatttagcaatggcgcaatgtaaaaaactaccgaatcatctttaatcattcaaactaatcaattttggaccaactaccaattttaggacggaaacaagctcttgcggatggaacagatcagagttaagctagaaattcgaaaaaacaagcaggttctttcattctttccatgtttcagaataatggagaatcttgagaaatataaattgtatgaatccttccaaacatatcccaagtttcacaagtgtcatggagaaagttgggcttaccaatcttgatcctatctatttggttgtagactagaaaaccataaattacaaacttgccactcttaacaaacaaataaggttaaagcatgtgatgcaaatagaaataataaactgagtaacagtgttgctgcaaatgttatatcataaagagttaatagatcaccagacctaactgatatttgctctttcttagtacaaacaagagtcacattatactcaaaagggaaagagatgaagcgttcaaataacattgaaacgccaagactttaccggaaaataatgtgtggtcagaaattagaagagcagaatcagctccagcatcaattgcactagcattcactctccatgcaggacggttgtcaagcacattctttccagcaagctcgaaaaagttcttagacacacgtacacggacctgaacatgaaaaagagaccacgtttattcattttagtcaagtggatccaattatctaatcaaggatgtattttcaaataacccgaattttccattaattatagagcaaaagaattttaaattggaaaacgttggttgatttatttctaataaatatcaccgtaacaacattaaataattggatttaaaacataccccgccatcaacatgattggcacccaaatgttggctcataacaattgtagcataggcttgtggcaagcaatcatttttaacagattccaacaatcctgggatcttgccccacagatgttcctcatgacttgagaagactatacagtttggtgccggttgtcccttgtcttttagaatctttttgactcgcagaaccttgccaagctgttcaagaaaacatcatcaaaacatttttcctgtaaacatatcatacgagggaaacataatactttggtcacaaactaaaaattttagtcaaccaagtcaagataagattattttctctttttcctctcttcttttaaaaaacagaagaaccttgctctccctctttccattacaggaaacaacaatgttgtagcaatacagcaaaaggaattgaacaaaaaaacaaaactagaccgggcaggcagatcacacaactaagatggcgccgccaccaccccttctttttgtgtgatcacacaactaagattattttcttttgaattatataatattaaagtgaaactatttgactacatgaaagctgtatgggattttctaatttacatatacaaacatttgccatttcaagagtgcagctctggccataggacatgcatccctgggcgttgcatcaaagttggtaaaacatctttttggggggaaatcaggcattcattaaaccggctttgtgaggaaagccaaacaaacagagtcttataggaaaataaaaacagctagctaaactaggacagaaacgactagacaccaactgctgggtcctagctagatcaagcacaaggctacatctccagatcacctcataaaacaccatccaaaacatctcatgaaaagagcttgaactactgtcgcctcccagacacccaaacattcatagctataatcatcagaacatcaaaagtaaaacatccttcttgaagcacatgcatcaaattcgccgatttacgggagactataggtcagtaaccaataatgacacaagcagaacctattcgatgcataccatagaaggtgacgagccagtgtagctgaggattagattcgctgcaccttctcctttgtaaacccaatctttggcatccccctcatgcagaaccacctccatccccacacagaatctgcaggcttccaagtatgagttcaaggtctattattcaaaataagtaaggaggaatagtaggcgaaaaacgaagtaggaggaacagaaaattgctgcttaacgccgagtaacacagcaaactcgagtccaagtgcaggtgcattcatttactcatctaccaaagagaagatcaagcgagaaagaagcaacacttggttcctggtcggtgcggcattccgtcgagcagatagcgagctttagttgcttaccagataacaacagctgctgcggccgtggggatcccctgcagccctgctccggcgatcgccgcagcagcagggcgggcgggatgatgcagcgcgctccaagcctccagctgccaatttcctcctcgtcctcgaggaggaggaagaggaagtggaagtggagccgacgatgaggaaagcggcagattcccctcccctgcaaggaaggattagcaaggggcaggaggagacgt

SEQ ID NO: 80490 - DNA, 2676 bp, Oryza sativa
ccctttttaaaattaaaaatttaaataaagaaattcgcaaatattcatttaaagagcatataaacttcaaatggccataacttggccatttgaactcggaattggaccgttcatgtctctaatttttccttaagaagtcaagaacctatttttgtgctttgtttcagcttgttatatggagtttattagagtaaaagccttttcttttccgttggtcgtgtagacgctgcagcttcggacgatccgctcttcgtggaagttgaagccaacgtttgggaaagcgagcaaggcaagtcacatcatccttgaacatattgaatcccagtttataaaattattttgatttaaattattgcactatcgctttatttaaattcccgcgttatcactgttttatctagccgtgcctatttacctttgttatgaccttcttattgttattgttattatttccttgttcaccctagcataaacaaaaccccaactagtggacactctactcatggtaccactagtatgattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctgggttcggggtgcatggttttgatagtagcacctcggccatataaggaccggtcttcgggcctctattgcaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcgtgcctacctgtcccgggggttccggtcgtaggtggggttgggtcggtactcttgtctatgactaggatgggttggaaactatgtcacgtcttccgtccgtataccgtggtggtatgtggcacgtggctacacgtgaggaagatgtgtcttgtgggtaaagatgtacacctctgatcagagtataatctattcgaatagccgcgccctcggttatgggcaagcctagcaatgtacccaagttagtgttttaattcttaaaacatgcttaacaactaaaatgtggaatggttggcctgggttggcttgggacgagctgggacccagggtcgggttgccagttcggtccaaatcatcgtaggccttgggttaaggcaggttcgtgtgggttcacggcccttattaattatcttgtatagctctaggagcatatttacaaaatagctttcagcaactaagtgtcttttaatgctgtttactgcaaaccctaaccccctatattataactcccttgtactcccatgcatttattctgcacttgtgggtgtgtcttgttgagtacggtggttgtacttagtcttgctcattttttcccaaacccagaaaaggagttcctggatgatgaaggctttggtttctagctcgtgcctgccgtcaagcgcctgtggtcgtcgccctagtcttccgctgtttttcgtttgtcttcttgtgtgctgggccttcgccgcccatgtaataaattatctatttacgcttccgcttgttaaactctgaattgtatcaacttttggtgtaccttggctcctgggacaaggaataatacacgcacgtaaggaacgcccgttgggttatttccggtcgtgacatgccacgtttctgccgcctcaacctattgttgatccaatacagcagcagccgattcagcagacacccccaattcagcaggttgtgcagccaatccagcaacaggtcatgcaaccagttcagcaaacaccaccaaggcagcagcctctgcagccgattcagcagacgccgttaagacagcaaatcgttcagccggtccagcaccaaggttcaataggtgcatcggccgggtttgcaacgcctggtggtcagcctgtacaacaatttttaaatcaagttgtcccagaacacttggttcaccacgtacagccggatggcacagtaatacctcaagttgttcctgagcatttggtacgtaatatccagccgaaccttcataattaccaagggggtaacttgaattaccaatatcagcctccttccccgcaagcccaatatcagctagggggattggctcaacctcagtttgcgcctcaatatggtcagttcgagcccatgcagcaacagtcacaaggggtagctcagcagcgaccatgggccgatgtgattgctgacgtaatgagggaacagtttgggcttaaaccaaaagagactggaagcttgtatcggcagccttaccctgagtggtttgaaagagttcctcttcccaatcggttcaaagttccggacttctccaaattttcgagacaagatggtgtgtcaacttatgagtacattagccgattcttagctcagtgtggtgaagcatcggctgtggacgctctgaaggttaggttatttcggttatctttgtctggatcggcttttacttggttttcctctttgccgtattggtcgatcaatagctgggccgatt

SEQ ID NO: 80491 - DNA, 127709 bp, Oryza sativa
  unsure (1)..(127709): unsure at all n locations
gtggcactggatcatctccacaccgggtcatttcttgttactcttggaggttgccgcctcctagacggcttgtggaggagttgcccggtgacctctccgagaagattatggaggaggcccggcgccggtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccgacgagtttccgaacctcggtgaaaaatctcttgtctcattgtctcatttgattgtcacatttacatttgtgcaatttacatttctagaaacacacttgagatcatatcaccctaggattgcaaaacattgacatatgagcgtgatttactttcctagagatataattgagccactatcaccctaggtttgcaaaacattacttagttgcttagttagagttcatcctcaccaagcctagcaacttaggttagatttgattaggtgttatttagttttaaatcgcttattctcccccctctagtcgatatctcgatcctacaagtggtatcagagcttggtctctcttgattgggcttcaccgcctagagagaagatgtcgaacgagttgaaccatgtagggaaggctcccatgtttaatggcacaaactactccacttggaaaattaaaatgtctactcacctcaaagctatgagcttccaggagtattgtggatgtaggctttgccatcaccgacacacccttgacgtagattgatcaccacaacctccaactcaatgcccaagccatgaatgccttgttcaactctttgagccaagaggagttcgatagagtgagcaacctggagaccgcatatgagatttggaacaagttggcggagattcatgagggtacaagtgagtacaaggatgccaagcttcatttcctcaagatccaatatgagacattctccatgttgcctcatgagagtgtgaatgatatgtatgggaggctcaatgtcattgtgaatgatctcaaggggcttggggcaaactacactgatcttgaggttgcccaaaagatgcttagagccctaccgaagaagtatgagacccttgttaccatgctcatcaactccgacatgtcaagaatgacacccgcaagcctcttgggaagatcaacaccaatgacatgtacaagttgaagaagaaggagatggaggaagcctcaccctccaagaagtgcattgctctctaagccgaagttgaagacaagagcaagagcaaggtgaatgaagtcaatgaggacttggaggaagagatggtctttcttactagaaggttcaatgatcttttgggaaggagaaaggagagaggaaggggctccaactccaataggagaagaaatagaagacctaacaagactctctccaacttgaggtgttttgagtgtggtgagaatggacactttgcttgcaagtgcccttccaaggatgatgatggagacaagtcatccaagaagaagagtggaggctacaagctcatgaagaagcttaagaaggaagggaagaagattgaggctttcaacggggactgggactcaaatgaggagatctccgcctcatccgggtccgaggaagaaggtggtgatgatgcaagctccaagaagaagaagatggccgttgttgccatcaagaaggctccatcactgttcgctccactttgtctcatggcaaagggctcctctaaggtaacatctcttagtgataatgagagtgatgatgattgtgatgatgtttcctatgatgagcttgtgagtatgtttgaggagctccatgcttatagtgagaaggagattgtcaagttcaaggctctaaagaaggatcatgcttctttggaggtcttgtatgaggagctaaagacctctaatgagagactcactatttttcatgagaagcttaaggaagctcatgacaacctcctttccactactcaacatggagctcacatagatgttggcatatcttgtgatttgcttgatgatagtgctacttgccatattgctcatgttgcatcatctagcatttatacctcttgtgatgatcttatggatatgcctagcccttgctctagttctagctcttgtgtttctatttgtgatgcctcacttgttgttgagaacaatgagcttaagtagcaagtggctaagctcaacaagagtttggagagatgcttcaagggtaagaacactcttgacaagattttgagtgagcaacggtgcatccttaacaaggagggacttggattcattccaaagaagggtaagaaaccttctcaccatgccactcgttttgtcaagagaaatggtaagtattgctccaagtgtcgtgaggttgggcatttggtgagtgattgccccggaggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgagtgcttgatagtggatgcactcaacacatgaccggtgatagggctatgttcaccacattttaagtaggagggaatgaacaagagaaagtgacatttggagacaatagcaaaggaaaggtaattgggttaggtaaaattgctatctccaatgatttgtcaattgaaaatgtctctcttattaaatctctaaatttcaatttgctttcggttgctcaaatttgtgatcttggcttgttatgtgccttcttcccacaagaagttattgtttctaaccttcttgacaagtcttgtgtgttcaaaggttttagatatggaaatctttatttggttgattttaattctagtgaagcaaatttgaaaacttgtttagttgcaaaaacttcattgggttggctttggcataggaggctagctcatgttggcatgaatcaattgagcaaactttcaaaacgtgatctagttgtgggcttgaaagatgtgacgtttgagaaagataagctttgtagtgcttgtcaagctggcaaacaagttgcatgttctcatcctactaagagtatcatgtccacatctagaccattagagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaattagttgcactcttgtgaaaattagaagtgacaatggttccgaatttaagaataccaatatcgaggactattgtgatgatcttggcatcaaacacgaactttccgctacctactcacctcaacaaaatgctgtagtggaaaggaaaaatcgtacattgattgagatggcaaggactatgctagatgaatatagtgtttccgattccttttgggcggaagccataaacaccgcttggcatgcaaccaataggctttatttgcatcgtctcttgaaaaagacttcctatgagctaattgttgggaggaagccaaatgtcgcccattttcgagtttttggttgcaaatgttatatttaccgaaagagtgttagactaaccaaatttgaaagtcggtgtgatgaagggttttttctaggttatgcctcaaatagcaaggcataccaggtctataacaagaacaaaggtattgtggaagaaaccgccgatgttcaatttgatgagactaatggctcctaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgccaagtcaagctcaagttgaagtggaggaggagaaggcacaagatccacctatgcctctaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttggactttggtgaaacttttgcccccatagtaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaattctaaccatgtttacaaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtttgtcaaatttatgttgatgacatcatattcggttctactaatgaggtattttgcaaggaatttgatgatatgatgtttagggaatttgagatgtccatgattgaagagttgagcttcttccttggacttcaaatcaagcaactcaaggatgggatgttcgtgagccaaaccaagtacatcaaggatctactcaagaggtttggcttggaggatgcgaagcccatcaagacacctatggcaaccaacggacatctcgaccttgatgagggaggtaaactggtagatttaaagctttatcgttccatgattggtagcttgctttactttaccgtatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcatccaagaaacaaaactccgtagccctctctaccgccgaggcggaatatgtttcggcgggtagttgttgtgcccaattgctttggatgaaacaaaccttgttggactatggcatatccttcaccaaaaccctactcctatgtgacaatgatagtgccataaaaatagccaataacccggtccaacattctagaaccaagcatatcgacattcgccatcacttcctaagagaccatgttgccaagtgtgacatagtcattagccacataagaaccgaggaccaactagctgacatctttaccaagcctcttgatgaaacccgcttttgcaagttgaggaatgagttaaatgtcatagatttctctaatgtggtttgagattgtgcactatggttgcttcttttgcattttatatatttgctcctatttgctcttatgctttggacttattgccatttggttcttcattgcgaaaatggagcatgtcacattaagggggagttttggactcttgcatgtgctttacttccttttatatgtgagcaaatcaaccaaaagtgctagtagtgtttttcaaaatgcccaagtcaacataagtcaaaacttttgcaaaatcaatgatatttgaaaactaactctttggaaaatgtttcaaaagggtccctatatgttttccaagcctcacattgctagaaaaatgatttttgaatgaaaaataccattttggctctcttttgaagaatctagattcttgtttttggtcaaaataagattaaaccccaaaatgagtttgagaaggaatctgagaaaagattcaaaacaaagttggtagtgaggaggatttgaaatgtttttggtattcaaatcatattcaaaaaccaaatatttcaaaagttgtttgaaaatcaaattcgtccaaaaacccctatagaccataaaaggccacatcctagcactcaagtgagttttgttgcaaatcttcataaatttcaaatattatgaatggttggcaatatttcaactcacacatttcaaaattgctccaaaaatcaaaattttattgatttttattgagtgggggcagccaactgtgcaagggctgtgcacagtcggctggggggccaggcggtctgactggcgctatatgcgcggtctgactggcctggtagtagcggtctgaccggccactagggcacggtctgaccggcggcaacccggcggtctgaccgaccacgtaaagccggtctgaccagctggggatggtgggcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcttcgatttgcaccaatagagggtggtttcttggtgtgattcaactccttcaaccggtaaatcactctcactcttgtgcttttctctcaaatcggtctatttcaattctagggttaagggtagtttccccctttgcttcaatctctatgaaatagacctacactttgatgttcatgttccaatcttgtgcaactttgtcctaacaatatttttttagaatcatttgtgtggattgtggaaggattcggttgtgctactgtcagtggcggtctgaccggccgagagcctgcggtctgaccggccgaggaccgtcggtctgaccagccgtaagccgccggtctgaccggcctatggccgtcggtctgaccgacttggggcttgcggtctgaccggccttggctctcggtctgaccgcccctgacagacagcactcccccttctcccacttcactatgtggcttctaaaactgttgtttatccatcctttgctccatgtttttcagctatgcctccccgcactcgccatggtcgtcgtgagcccacgcccgatcccgtcagtgagaatgaggattcaagcggagatgagtatgttcaaagtgatgatgacaatatggaaaatgttgagggtgatgagatggaagtaagtgatgatggtgatgacaatgagagtggaaatggtgaagatgatgaggcaagtgatgataggagtcctctcgattccaccatccaatttgtgcttaatttgaggaatgctcaacaatacactatcctccgtcatcataatcaattccgaaggcctaacgattgtaatgatccaagatttcatacacggttccaaaagtccgtgtatgcacaagtgtatgccaacaaagccttcgccgaacacaagtggatttcttggaagcacattggtgagacaccggagtttgagaatttgcaagagatgttccggaccgttgggattgatagaattgtcaccatgaagcaaccttttgatgaagatctcatccggcaattctatgccaccgtatgggtgtccggcgattgtgatgcaatgaagtggatgtcgaggaccctccgatgctctatcaaccgccgtgaatccaaggagctcttgcacattcgcttcaacaacggggatgaccttcatgatgagcacacccacaaccccttccccattgatcacttttctcagttttatgaagaagggggaaggcacacatatggcaaggtggcgggtttgagggctctcccaagtgtgatcaaccgcatagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactcttggacaaggaatctattatgctccctacataatgaggttgattcaaagcaagttgggacaaattggtcacaatttaaaagaacataaggagtacaagcctcgtctccaactctcctcccctagagctcctcgtgtgcgccaaccaacattcgatcaaggtgcaagctcaagtgcagcccccccttctcctcaagggtatgatccaagtgcttttttccatctacaatatgcctactttggaatgcaacccaatgacttcttcaacccggtccttggggctattcataccctaagtgaaagcattcaacgcttatccaccgggcatgaagcattgcatgaggatgttcgtggcttgtgcaccgatgttggcaacttgaatacttcggtgggaagattgcatactagggtgggtgtattggattctcgagtccaaaccttggagagtacccaagcttttgtctatcatcgccaccgtgatgcttctcatccttccacttcggcgcgtcctccttctcctccacaagagtgaagacctttttggtgcttgatgccaaaagggggagaatagtgtgttttatgttttgtgggttgggtctagtagtagtgaggttagtcacctcatatttaataggttaaggaggattgggctatatttggtatgggtatgggctattactctatattgtgtgttcctttttcgttttgttgttctctatgtcatttggacccttcgtggtcttgtaatagcctatatttatttgtgagccctttatgtggtcttaatgtgaacttgttctatgatggatggttggtgtgacattgatatatttgtgaccatcttatgctcatggatgaatatttcttgaagttcacattgagatattgctcttgtgtttgtgatatgttgaaatgtgaaattgaattgtgcattggctccatatttgctatttgtgattgttatgcatatgtttagggggagcttttgcttgtcaaaacaatatatgtccatgtgctctatgtttgattatatatatttgtggtgtttgtcatcaattaccaaaaagggggagattgaagcatctaggcccctagtgttaattttggtaattaatgacaagcactaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaacagatgattttaattgccacattaggtcattgcattttcatttgtgctctctttttcattacacacacattcacttgcaaattcactgggttctgcctgaccaggggcggtcagaccggccacatagtggcggtctgaccggcgtgccctggccggtcagaccggctacatagtggcggtctgaccgatggcactttcccggttagaccggccccctaaaggccgagatggtgctgctcgggatggccgatacagagccaacggagccgtattcggtcagaccgagccgatggcggtctgaccgagccgaggccggtctgaccggccaccccatgccggtctgaccggccagaccgatggggccctctgacagggctacaacggctagttttctagccgttgcagagtagcacggtctgaccggccacatacctccggttagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttagagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcttttgattgtcgcatttaaatttgtgcaatttacatttctagagacactttgagatcatatcaccctaggattgcaaaacattgacataggagcgtgatttactttcctagagatataattgagccactatcaccctaggtttgcaaaacataacttagttgcttagttagagttcaccctcaccaagcctagcaacttaagttagatttgattaggtgttatttagttttaaatcgcctattcatcccccctctagtcgacatctcgatcctacagctgcacgcgcccggtgccgcgcagctcgtgcggaaggagctcgggccgccgcttgattgccccgccgcccgatgccgtcctagatcaactgggggagtcgggccgccgccaagctcctcctccacttccgcgcgccggcgctcatcttttttcgccgcggggggggggggggggaggggggaggaggaggctggtgcgccggcgagagccaagccccgtcgcccctccggtcggtgccgtcgccgcttggctgctcagtgcggtgaatgcggtggggaaagaagacaggagagaggggagagaaaaaagtggtaaaagctgatactggtgggacccacaagtagtaacttgcactgtggcacatgtagctaaacattgttcctgatctaggtggtgtgcgaggcttcgcaaatactagtggcgcattatgaatgtcctaaggtatacacgctgcacaattgcacagtacactatactgatggagtatgcaactgtgcacgatgtgagttctgtcccaaaaaaactgcttttggatacaatgcaaaggttagtggattttcagctcacaatatgaaagtcgtcgcatgacttctttttgtaatcgtactaatcgcgcgctttttgtgacggcatggcatagacgcatgtaaacgcatgccttttcgcaaatttgtaaaacgaaacgaaccttttgtcccaactggtgcaaaagcgtgaggaaaacgaaatgattcgtggtgagctacaacacacttcactcgatcgatcgtagtagcaggctactagccgcagcagcagtaggtcatcggacgccacagcgatgatttgcatgattcctcatgttgatccctggcggtggtaagaagagggggaaaaagtgactttttatcgtcaacagcgaaaagcaaaccgctcgcgggaatctcattattggcgtaccatttgttttttaacctttcgaggccaaatacgccatgccttccatccgtcgatctaccggttggagtagtagctgttatattgtgctcacgtttttgctagtgttgtagacgtggccgcgtgcgtgagaaaacgagaccgagaaaatgtggcgtgcgtcgcatggtggagggagggacagagatgtggcacggctcggcgcgtcgcgtttggctggacacgaggacagtacgtacgcctgcgctgacaagtgggggatcaccatgggaaagagaagcgagcaaatggggatagtgtcgtgcattgagagagagagagagagaggcgatcgactgacgacgacgacgcaaggaaaagctacagcgggtagcgagggacgacacgcagcgagcgagcctgcgcaaatgaggaatcatggcttcccccctcgaaaggtcggcatctttcgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcaccgctttgcctttgctggcgttgcgcgttttgccacactcgctgcttcttttttatacttcgggtttgggcgggtgccactggagacattcgtggggtgccattgcggcgtcttctcctctctcaggaggtgagtgggctctgtgctcttggcttgtctctcagctacttgcttcttcttagcattacccattttaagtttttggttgttctaatccggtgatcttgggtgttccctccggcattgccgatgttcttgagactacgatcacacattcatatgcatgggtgagtgatggtcttcgcttcttgtgaaaatgcctcacctgggggaaggagggctggtactagtgctactagaggggtggcgttcctgttcccttgttcgtaggcattcgcctggagttgtgtttgcatttacaagctgcacggcagaggatgattgccaagtggcatttcgtcgagcacgtagctgatatattcgtggtgacatttactagtactagtgctactactctccgcgtagctttctactgctactaatcctagagacatgagctgtgtggcgtaaaaacacaaaagccgcctgctttcttgggaaagggaggtggttttggccgccatggggacccaacacccaagctatagctagccaatgcattttgaacctcccttctccacgaattcctattttattttggctctccactttgactgctgctcacactgcacaccgtatgaaatgatatcctctgcctctgttgcaatggtatgcaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgagtgtttcagactttcagtcagattctgctgcttgttgatgcataattgcgcacaaatttgttgcaatttttggcatgatgcgagtagcgtccgttccttcttcaggtgccaagaaggtgatcaactcggagctctggcacgcttgtgccgggccgcttgtgtgcttgccgcagcgggggagcctcgtgtactacttccctcaggggcacagtgaacaggtcaatcttactgtcttttttcacaaattgcagctaatctcgttttgaaatgctgcaaccatagacaacaatttggtcagattgatgctcaataatactttgggattgctattggaatgatcaatgttgaagggatgatgcccttgcaggttgcagcgacaactagaaagattccaaattcccgcattccgaactacccaaacctgccatctcagttgctgtgtcaagttcacaacatcaccttgcatgtgagttcaagcaaattcaattccaaacatatttgtggccaaatgtgttttgcctgtgcttgattgtttgttttgcacaggccgacaaggacactgatgaagtttatgcacagatgacccttcagccagtaaactctgtaagtatgatgtttctctgttacattgtgtactgagttctgtactactttatttggttctattaaaatgtaaacaccaattgttattgaaatgcataaaatgtgattacagaaacaaaaattcagtgtgcaaggaataaaagatggattctaaattaatatttatttgtgccgtctattgtaggaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggtatagcctttatctacattttgtttgccgcatagtttttctgtaaaaaaatgcttcagctcatgggtttaagttttgtaccgacaggattactcaatgcaacctcctaaccaggagcttattgttcgagatttgcatgataacatgtggacattccgtcacatttatcgtggtagggtcaaacaatattcggattttatttgtcttgttcattgatacataaatatatgcttcttgggccactgtctcctaaaagtttcttcttttcttgtcccttgcaggacagccaaaacgacatcttctaacaactggatggagtctctttgttggggcaaagcgtctaaaagcaggggactctgtcttatttataaggtgaaataagttctataaatacatgcaaagtctgtttgttacttaacctgtgtgtgctatcagaaaattgaatctgagattgttaagccttttgatactaaaccctatgcaacaattcatgcattgaaataccacaagaactgcttatgttatttgctctttcgaaagaatgtccattaccagtattagattttcctacagcggctatctacttaaccttaaccaatatatacatattcaactttctagaatattaaaatctcaacaacaataacttttctatttcttgtcagttctaatgtgaatatgactgttataggacaccgcactttttactcgctcggactgacaacagcttgtatgtaatagtataatattttcttcacaaatatgtgaggatgaaatgccatttttgacagaagttcctgattgcagggatgagaagtcacaacttcttttgggtgttaggcgagccacgcgacaacaaacaatgttgtcatcttctgttctatctactgatagcatgcacattggcgttcttgctgctgcagctcatgccgcatcaagtggtagttcatttactatctactacaatcctaggtacagaaatttacttacccttttacatatgcttttttttttcctggtgagcatttggtcattcatggaatctccataggacaagtccttcgccatttgtaattcctgtagcaaggtacaacaaggcaacatatatgcaaccatcagttggaatgagatttgcgatgatgtttgagacagaggagtcaagcaagcgcaggtttgtccactttttgttctcattttacatagcttttgttttctgtttcagattttatctttatgctatttatttatgtccacaaactagaccttggtgtacaaccgtgtaatggattatgctgctttaaaagtataaataattcaactgtgaattttcatgattcacattggaaaaataatgactacatcaaatgtcgttgcatgggcatacttgcgttctatgttgagtttagcgttttgttgattaagtacagctagaaaacatattccatattgtaaacaaaattgtcttgttttacagatacacaggtacagttgtgggaataagtgactacgaccccatgagatggcccaattctaaatggcgcaacttacaggtgcctttttcatgcaaaagcttaaggaaaactcagaattctgcctatcatggtgtatttgatatttatatacttcttgctactaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggaggtatgtctctgacatatgctatacaaatatttatggtcgtgcaatatgctgaaacatgccttacccttttgcagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccaccaaaggtagaatcatcaaaatcacctgatggaggaaagtctgtcaattcgtttccaaaccaagggtgtttttcgcagttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggtttatactacttgactgtttatatgttaccatttgtcaaatgctcttgatagtaaatataacttaacaactatctattatgtttttttttgtaatacataggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcagtttgatctctctccatgatgcaatacgaggggaggtagtacagtatacaaacatgagttagattgtagaaccaaaaacaatgattttcaaatttttcaatgtagtattatagaacgacatatatgatctggagaagggtgaggctacaagcaaggtcgcaaggtccgtaggagtaagagcttgtctcacaaaaccatttcagaaaaatctgacatttctactttgagcgaacaatcattgtttgcaacaccccgagtacctaagaccctcatgctacatgtgagcatcaaaggatgatagaacaatagccaaaaaaccagtgcaatcacaaaggagtagtatctactagcgacgatccaaaagaaaccgcttcctggtagaaatcctctcctgcaaacgttccaatcaatccagttgatttcgccacccgcatcttgataagtactcgtagaagacttcaccagacataagttcgtctgcattcaaaatatgtgacccaacgtaaaatttactcattattttgattgctaataagctatatgaataagcatataagtataattgaaacaatgagtccctcactttatgctatatttttccatgcctccagaaaccatacctttagaggccggccacatcaatatcaacactggccttgcaataaaactggatagctgcagcacccatgatttcaagaaaataagcaacagcatgcgcaaccacctttgagtgattttttcagatttttgtgtgacccagcaagagaaacaccacaagtgtggaagcatggaggcacagatggatgaactcggtctttctagtgggctcaaaatcataggcagtgtcaacaagatacttcccagcttggagagctataaagagaccaaaccaaaagagagcaatatacacatcaagctctgactcatctgtaatgtgtttcagcagcttccaggtaattagcacaagtgagccatggaacgcaagaagcaatagtgccagtatacctagccgcatccaacgcttgcgttctttttccctactttcatcactctcagtatggccattgttgatcccattgctgcctctctccctactcctatcgctgttcatgttgttgctcctcctgctgctgctactgctgctgcagctgctgctgccaccgctgttgctgcccctcctcctcctcctcctcctcctgctgctgctgctgctgtctctctcccttgtcctctgtctgaattgcccagcaggtccaagcagcctttccgtgccattttcagtgtcttgagctgtatcccactcccgagccaaattgttcaagccattttccatcctccattcatggcctgatccagtgttgttgctctggccagccagattttgtaattccactatatcaagagttacatcagctctctgcctgtctgtcaccacatttgtgcttgggcctgccagaaaattggagctgagctcaatggtgctccttgacatttcctggtgaggcacttggcctggtggattgaaaggcgggagaggtggagcacggaaagatggcagggatccatcccttgagactgctgctgaaggaggcggcgctgctgcacttgccgtagtggacgaggtctgtgtagaaagccgaaccgtgggcggtgatggaaccattggcggcggcagagcgcgcgagctggcggacgctggtggggagaaggtcggtgaaggcggtgatggaaccattggcggtggcagagcgcgcgagctggcggacgctggtggggagaaggtcggtgaaggagaaaatcctggcaacgacgaactggaacagctcttccataccgtcgacgagctggtcggtgagagctccagaagcggtggtggtgttggtggcgacgaggtggatggagccgagaccttcgtcgagggcggtgacaaggagggcgagcgggccgcccctcgccgccgccgtgtaggagcggacgtggcgtcgcgggtatgcggcggggccgacgaggagcgcgtaccccttccccgccgtgccgaggtagctgctgctggtgaaatcatcgtcggcgacgtgcttgtgatcggcgtggagtggaggaagacgaaggttggcgacgaggagccgtcgcgtggcctcgcaatgttgcggcggcgccgacaaggagagtgtacgccctccccgccgcgccgcggcgggtggggttggtttgctcgcgttcttcgtcggaagggacgaacagtaccccgcagatttgggaggaattggatttgattttggtaagacggtagaaataatggtgagaggtttatgaatttttgggggacacgccggtggcacgggaagtgtgtgcacgcagcaattcctttgcctcgttcccgcttcccgctggctgacagacagctctgtttattgctgtgtgtacgctgtagaagttacaccgttcttgcaacaaatcgaaaaacaaaagatgcatttatgagcagggagtagggaataaacccactaccaccggtatttgttacggaaactactagtacgactagtcctgttcttctgttctgggaggagctaaggcaaaccatggttttctctgtgttctaggagtagttcgcaatagattctctaactagttttgttttgtccattttagattgatgccaaaatatgttctacaattttttttatgatttgaatggtaattgtgatgttttgatttgaaactaaatggttggcattgcccatccctaataatagatagaaatccgtcctctacatccatatacacaaccagacatgagataatcataaacgtttgatataattagtgagcatattttaattttttggacgacccttatctctctcttcttcctcctcctcttcctcctttcaccccttcactggccaactcctctcattcctcttctccacatcgccccccttggcagcttgttgtgtgggaggtactttcacctcctcaccttggtgacgttgctggcgagggatggtagtggtggaggccacccccatcttctccacctttggcttgacgatgctcgactgccatcttcattcccaattcgggcacaaagaagaagagggaggaagtggcggtcaagaaagcgcgttgagctttggtcgaagtgggaggaggaaggaagaggcagcttcctccatgaccgccatcgccggacgacaccaacgtggcaaggctggttagtgtcgtggcagccaccatcgtgatcattccgtcgaacggtgggggaatgacgctccttgtcgatgggtgtcgttgcaccaacaccgaccgccatccctactcgagcccgtgtggcactatgaggaagggagaggggaggggaaacatctaaggaagaaaggtacatagattttaatagttagggattaaaatatctggtattatagttgaaggacgaatcagattggatgtagtagatttgaggagttaagtggactaaggccctacttggttcatgggactaatccattagtccctccattttagtcccttttaatccctaagaattcagacataggtaactaaaagtgtacactctgggactaaaatttattagtccctcttgaaggtacttataggcatagtagaaaaaaccggaacggtagatgactcgatcaccatgctggttcaccagttcgatagtccaaccgtaaaccggctggtagaaccgcggtttactaagtacatataatatatatgtaatatatatattttcagactgtcacatacattcggctggtagtatggctacaggggttggcttaacttatcttacaggggtcgactccccatcggcgcacatttcctttgatttttgctaaaaaaaaacaagcctgcggacatatatggcccaaaacacactaacatcgcattccagagcatgacaaagagctgcaccatgctcagaagcgaagcccgacaacccattgcgcttgcagacagtcttgaagaaccggcggcacaaccaccatggcgaccgtttgtgacagcactggtgcgttggcgtcggccgtaccatggggcctatcagcctatgcccacaacctacccaggccgtgtttagttgagccgatgtcgctgtcgtcgtgaaactctacgtaatcgcggacaatgagaacgaatcactcctccatggctggcgccctctcctccagggctacattcattcttggcattggcggcgcttctacgtagatcaaaccaatcatggttaactgaataactggtggtgaagatttcaatgcacgctcctcattgacggctcatgcatgaatcaaggccacagctcagagatacggtgtgtcccaagagtgtcccgcgtccgacgttgtgagcgatgtggtggtttaatcacattaggaatcgatgtatatatgtctgaaaacacaaaaattaaagctacgtgactggtgggccggggcgtatatcggagatgaagaaagaaaacacaaaatgcggacatcgcacgtggcgaacacgactacggacgaaagcgtgtacgtaacgattgagaaaatccaaatctactttaagtaggttagattagaatagataaatccgaacaaatggcgtttttcatagtttttcatattttatacttacactattacgcatgtgcatcatataatccatcactccgccctcttccactacactattttcgatgcaattgaattttattgtcttcatattgatgaatgaaaatggcgtgcatgtttgtttacaactagatgaaatctcgtgcgttgtatgaaagttttgtataatattagtgaaaataacatgtaaaatagctacatattatagtaatttttttatcgttgatcgactattgaaaaaaaaagctatatatataaaccatttgatgatgtggtctataactatttaaatcatatatgtattgatcgtttaaaaggaaaactaagatgatatgacccaataacagaaggaaaagagaaaataatataaattaatcatcaaagataaaactaaggtgatatgattttataagaaaagaaagaaaaaatgagataatttgggcataaaaccattccataactagaaacaattaagttgatgtgacgtaatgaaagaaagaagtacgtagtagtactgaagatgaactttctaaatttctataggattagagaggcaaacaggaattaaatcagcatatctccatgagtgtaagtcgttatctcggtatatagatcacttttatctcctcgtcgtcaagtcgtgtgcgcatgcatgcatgatcctaatgatcctttctcatggataatgtttcacgaggatttgttcgtttaatccctcccaaaaaaataagagagatttagaaggattaatttcacatctacgtggaattattttttcttaatcccctctataccttttttttttgagattatacgaacaaagacccagatttgagggatgatcgatttttgagatcgatatatagccgtcactcagcaacggtcgtgccccacgggcggcagttgatgctcttcgttgctgaagtcggagatcttggggatggacaagccatactctctgagatggccgacgacgaggtatagccagaataggcactcaaacacaccacaggtgacgaagaaccggcgccacgacacggacatgtggtggtcgagggtcccgatgagcaacaaaaccacccaaaatacgaggaagacagcggtgccgatgactgtcagcttgaattccctgagcttgtgtttgtacctggcgacttggcgacgcacctccgcgtccacgatctcacgcgccgtctcatcctccgccgtatgctcgctccccgggtcctccgaaaccgctctgtttgggccgctgccgccgtttccaaggcagagtaccggaataatctgcgtcttctcggccgccatctccaaactctctgtacttccggacccgccgctcattacgccgacgacgacgagaaacgcgccggagactcgattcgatacagctcgacgacgaacgcgcggcgtagggcgcgaatcgacgaggaggaagaaaaggaccagcgtggtctgggcaaattaagaccgagtcggtgtcggttttggagttctggacgacgtatggttgggctcggctcacattgcaaaggcccattgatctgtgagactgtgacgatcagcagcccttttttttgggaaaagctagataccggtatcccgtccctagcatccacgacggtatcttctttttccttgttcccagagcacgagcacacacatgcagctgcggagcagcgctagcatcgggcatgcgacaacggaggaagaagggagctcactggagaagctccccgctgcctcgcgagcacatcaacagagaagatatgcagtgccgcgggcgacgcgttccggcgtgacggcggagcacgtggccgctggtgacgagttccggcatggggcgttgacgatggaggtgttaacagtgaaatttggtaagccctgagtagtcatcggcttagagtcagcatcggctttgaagtcctgagattagccgatgagagttgtcaagtcgtcagttgtcggattcttactatattcggttaagaaaattgatctactaaaggaagcttatccagaagagaccgagttcaaagagaatgcggcatggcaagttatctattaattaggaatagtttgttagttttcttttatcttgaggaaaatgtgtttagtgtcctataaagactttatcttttccttttatctttagaaaagtttctttcttgtccgacaatgacttgtatcaacccatgggtataaatatgtacaccaggggtctatgtaatctatcgctacaatcaatacaattcggcgcatcgccaccttttaccttttctactttattttatcgtccggcgggacttggcacctgacgcggggctgcatcggtgttcgatctccggctaaggggtaagtccaatgttccgtcggcccaggcaattatatcatttacgtcggcgtcgttcaaggctacatcagtacattcaacctcttgaattgctctggtttggatgatatatttgcctacctatttatcatatgtctctgttaatctagtctttgcatatcaatttagctctatcggctgcttctcgttttagggtttctgccggtatcagctaaatcgcgttgctagattagattagcttagacatctaccaccctgaaaactcagtcaacggcttgattgtctagatattgtgttttttttcatacttagtgttgcatcagttaagtttgatctactaagtcgtgtttagaactataatctctagtctgcttcttgattgccaataagggtttcatcggggtttcagctgatgagttatctagacgttacattggcttgtaaggattgcatatacatacatattggatttagccgatcgtaacaaaggtttcactgtttaatctaatcttgtggatttaatgacatcggacctccagccgatgtatgctttaaccttcggatcagtgcttattctatcatatcattgttagccgattggtttctaccggattatattactatattatattatcatcaaccgattgcctttatatcattatctacattggacatatagccgattgcttaaaccttatcgctattggctggtatcggcatcggctggaatcactccatcggtttgtcagccgatcggctgttttatctgctgtttacatatcttgtcagttgcaagatcaaactgactggcacgcccgcatctcatcaatctttggacctgcacagaagttaagcagatttcccaggccggtgtgttcgattttttcgtcaacaggaggacgcagccaccagtgtggggcgtggcagcggaggcatggccgctggcgacgagctccggtgtggggcgttgacgacggaagacgcgaccgccggcaacttgctccgacgtgggacgtgacggcggaggacgcggccgtcggcgatggcgatgagcccggtgtggggcgtggatgacggaggagcggtcgcaggtgacaagctccattgtggcatggacagtggaggatgtggtcgccgacgacgagctccaacgtgggatgtggacgatgggaccaccagcgatgacactttggtgcccggctcccgatatctcgtaagtatcacctaatacatggtaggaatcgtctgatatctgacaggtatatcacctgatacgtggtaggaatcgctgttaacgaccatatttggaaatgccacgtcatggattcaaagctagagtcaaagccgatttggagaaattccgttcgagaaagcagaatacgcatcggttacaagcagcatcggctaccgcatgaatcggctataggcggtatcagctgccacatatcggctaagtgtcggatccgatggagttaagccgatgcaaccagtctcaggaaagatggtcccacgtccgtcattggaattggtcgaagcacttcatagccattgccacgcaaggattggagtcctaaaaatacaattgtagctattaattaggacatttttcagtttccttagagatatgtttggtaagagtccacctaaaagacttattcgtattttaggttgtgttagagataagaggtgtctagtaaggacacattatgtacttgggtataaatatgacccgacaccatgtaatcaagggatgacagttcaataatacttcagcgcatcgccaccctttttattttcgttgtttcgataagtttttactttcgagttgggctgcatcgggttcgatctccgacgaagaggtaaagctttttatggcggcttgcgttctcgagattagtgcttacatcttcatgacactctaatcctgtctatatgtaaaccaccgagttatcaaatataccgcataatctagattgatctcgtcatctaaacttcatcagctagcctctattatcgaaaacagccagcaggtttaggtttcgatatcaagctagactatgcagtgtatctaccatcttgaatgagttttcatcgatttgattagatattatgtgtcttttcacgcttaatgctgcatcggttaggttcgatctgttaagtactgtcttgaaatattttatctagctctttctttgattgttaatagagatagcatcggagtttcagccgatcttacctgatttagtcatcttgtttccttatttggttctagatcatctaaatctgccccttatatcaagatctcatacgtttaaagtatattaagcttcctatcaatctgctagttcactctgcttgttagattggtttcagttttgtatatttcatctgtgctgatatcttggtataaggtggtatcggaatactagccgatacaagttaggtttgcccaaacctatcggctatgctgtgaacgtacatatccttactttggggctcgtctagatattgagtgatttatactgtctcaatgcagcgaccaatcttatcccaatcacttagtctaaacgtgttccattggacagattatgtatcgttaacatctacagccgatcgagtagacccaacaatctccaagttttatctgcctttgccaatctgacgcaagttacatcggcatggcttcggacgatatgtcatcggcaatccagccgatcggcaatcgttgatggatttaactttgtctttttttatatcttattggttgcaggatcaaaccagctggcatgctcagaacccgaagaaaatctctttgaacctgcactagagttaagtagatctctcgggccagtacgtgtttttcgtgtcaacaatcgcctgataccttataggtatcatctgatacctcgcaagtatcgtctgataccggctaggtattaggacatgatacctcatagttatcaggacctgatacctaaacagtatcatcccgtcccaacaggattccgttgtatagcagcccttctttttttcatgaaggttgttgtcacaccccgaaccggcaccgccgtacaacttatgacagagacaagagataacagaaacttgacataatagtatgatagaattggacctacatatatagaagtatagaacgatctggattttggagtgaccccctcttgtgagggataatcgatctatagccgtcagtcagcaaaggtcgtggcccacggggcggcagctgatgctcttggttgctgaagtcggacatcttggggacggacaagccataatctctgagatggcagatgaccatgaatagccagggtccggacgcaaccatgccagagctgacgtaggtctggcgccacgactcggacatgtggtggtcgagggtcccgacgagcaatagggccacccaaaatgcgaggacgagaacgatgacgatggctgacagcttgaattcccagagcgtctgcttgtacctggcgacttggcgacgctcctccgccgccgccgtatcctcattccccgtgtcctccgaaaccgctctgtttgggccgccgccgccgcttccaaggcagagtgccatatggtcgcccggcgtcttctcggccgccatctcaactcgctgtacttccggacccgccgcttctcaggccttccaaaatcgacgacaacgagaatgccgcgccggggactcgattcgatacacctcgacgacgaatgcgcggcgtagggcgcgaatcgacgaggacgaagaaaaggaccagcgtgtagatggatcggtctgggaccgagtcggttttggagttctggacgacgtatggttgggctcggcccacattgcagaggcccattgatacgtgagactgtgacgatcagcagcgcttttttttttcatgaaggttggttacttgtgaatttgtgtttgacagtataaatccgacacgggtattcttcagttttctgatggttttgaaatttttgaattgtcggcctttctattagagatgggattgtctagtagtgtttgaaaataccaccatgatataatgaggtgatacccacgtttgctttgaaatacatgttaaatctctactattataaaaattgaagatgtttttaccgtattttggtatgtcatccatatttgagtcgggttttaagttcgtttgttttgaaatacagatccatgtctgagttagattttaagcttgttcctgtcggaagtataaacggagtcatataagaaatcttttaaaaaaaactcgtatgctaacttgagatgaaatacgtactcctaataaatatcctaactaaaccataaaacaataataaaattaaaatagcatttatctgttacaatgcacgggtattttttagtattataatataaaagataataatattatattctaaatgatgtcatgtttgaatgaaatttaagatactcttgagtagttattggtacaattcaattttttttgagcgattcgatccgccatgctcgtagtttttgacgaatctaaattgtttggttagactccagctataggaaaggtggattcgagagatggagttctgctaaacagggccttacatgatctttattttctaataattgctagtagatgttaattatatgtaaggtaggagtatatatttattgccatgaacaccaatataaccattggggacgctatatagctaggaagtgactatgattataccggtcatcgataactgagtggtagtaattatggatatccataaaatgtgctgggaaacaatactcgttgatatatttttcactctgctaccaataaccatggttcattttaaaacatagattatgaaaacacgggaataaagaaaacacataaatgaagttatagccccataggtctataggaatatttaatttattatgtttttatttcagtcctattcttttgttgtaacttgtaaagtctactagaatttatttttaaataaataatgaaattccttgatgcaaagaatccgtaagcgaagccacctgatccaaagcggacgctgctatatagcaaaaaccggctcattctctcgagtccgagcagcaaaccaaaaaccaaggctctctcccactcgaccgaaccccctctctctgcttcctctgctcctcggagagccgcagccaaggacgccaagatagggaccgaaacccccgccgccgatggcgacgccgcccgcaagcggcccagcgccggcgacgcgcccgccccagcccccctcgccgacaagcgccaccgccccaaccccccgtcctccggctcccgcgaccgcgaccgccaccaccgccacggccacagccacagccacggccacgcccggccgtccaccgcgggcggcggggagaagaagctgcgggcctcgcacatcctgatcaagcacgagggctcccgccgcaaggcctcgtggcgcgaccccgagggcgtcgccatctccgccaccacccgcgacgacgccgccgacctcgcgcgggccctccgcgagaagatcgtcgccggggagcgcaagttcgaggacgtcgccaccgaggagtccgactgcaactccgccaagcgtgggggtgacctaggtcagtacgccacacgccgctacccatccacccccatgtcaatctgttggtgtgtttctatacagaactatgagatttgctttctgatgagcgtctgattagatgtgcggatggaacttgttatttcgaatcgatctgaattttagattagtactaatgttatacaggcacagaaatttgatttatcaagtacacttcgtgagatctatgtgaaggaggtggtgccgtgttagtttgtattaggacggtcaattttgatgaagctatccccgttttaattatgtgcagtaattgaattttacatgtgacaattgtgctataattcgtgaagacagtcatgttagctcttaatatgagacaattactatcagtgtaccatcgcttcagcgtgataaagtatgaacatcactgccagattctcagttttgattggtgacctagtccacttaataagagtcttaagaatcatgcgctgatgcagttttgtttgcgccacccttatctagtatccgttgtgttttccatatcgaactgtcctttttgatggaattggggctctagtaactgctattatggcggggatcattaatttcttttcttgttatgaacatgtcatgtccttatggtccgcctttgggtatgggccgagagggccaaggcccaacaggaacggtatacgtagctcatttggngttggttagagagtctagggttagaagttcccctctatctatatataaagggttaggaagttcccctctatataaaggggatggttccccaggttagggtaggaattagattgaattatctcttcgtgcccaccgaccctgtctcctcggcgctgtatatcttattctttaggaaaaaggaaaaatgttactccgcaggcggaaaccatggtcatggtgaccaacttggaatgtgtgacagcagtcaattccttcatttttcttctttctatgaataccttgtaaaataatcacctgtattttactctgccatttgttgataagatggacagttttgcggaacatggcataatttgctatatgtagttatgtacatgaggcaaacacattcggggcatgagacacagcacaatacactattacagatatagcggtgtgctattgctttttttttttctcaaaaggattttctcagcatgtgatggctggctatattgatcttttgtggatatttgcattcagaccatttccatccctgggactattaagcactattatgagcatgcacatgagggactaagatcacaaaaacaacgcacgatacactagtaatgaattttcttgcaggtctattgttccctgtgcgggaaattattacctgcccaaatcggaataaccacttgtgacatcacaattaagttggaatatcttgggctgggtggtctcccctattatgtcgctgccataatgaaatgatgcttttggagacggttattctggcagatgcgttagcatttggcacagtatctgacagggaacatatgagttgtaattgaggtctcatggtttgctagtgtgattactatgaagtagtgagaaggagacggcaataggtgtaagctgacagaaaattttgatattgtccctttttttcagatgtctcctatttatctgttctttctattccacatatatgattaatatgtttgcaaattatttggtactgtttatcttggtgttagtaattttttggtgcgaaaaaggagaagaaattgcaggggagcaaagtgccacatgctattgtggcaactaacttggttcttctcacaaggaattcatgtccatgattctatttctactgatgattcttgatttcacacttctcttactagccgagacctcataattaagagtgatcttactttcgcagtttatggctgcaggtccatttgaaagaggcaagatgcagaaggcttttgagaaggcagttcttgctctgaaagttggggagataagtgatgtggttgatacagacagtggggtgcatatcatactgaggactgcctgattacggcggcagtacgggccttctcaatctctcattctctatacactccgtcgctgtctgcaactctgcatatcatattgaggctgtttgggggcagaagtatgggccttgtcaatctgtatacactggggaaattggatgttggttattgcttcgttacaaacctgtgcatgtactctcgatctgcgaaaagtttatgttttactcttacattttgctggagacatttgctctggaatgatgctcaagacaacctatgaatattgattgttacaacatgtttggaattagctgaactgagcaggaagttatcgatgcattcctgcttacattcttgtttttgggtcgaaatgcgagctcagtcagatgatgaattttaaaaaatttctacacaaatccagctgtttggtagagtttgccactttcgaatgaaattcgaacgaaatcgtgaatctgacaggcgtacgagtgctccagcgtacaggaggcagctgccgattggatcccgcaaacctcgcgccttttccgcgattcagccacgtacacgcaccgtccccttcctgggctcctcttcgtcttgctgctgcagctttccttcttctccaccccctcggatctccaggagtcgatcgattctcttctccttctcccccaactctccaccttccacacccttcggcgacacgccgacgcagacagccaccgcacgcggcggcgacgacagcaacaccggccaccatgggcgcgtccacctccaccagcaacccgtcactggaggcgcaggagcaggagaccctcgcgtcggcctccctcgccctcccgcttctccgcgccgccttctcccgctcgaacggttcgctggcggaggcgctgtccccgccgcccgccgccttccgatccgactcgccgccggtgcccccgcgcttccacgacctcgtcgcccgcctcggccccgccatcgcctctctcttcttctccgacgtcggccccgcgggggacgcggccggctggctcgggttcctcaggggattcaaccgctgctgcgcgcgcgttccggcgtcgcagtcgctggcgctgctcctccgcgtgtacgccgcggcctgcgccgacgcgggtgctccctgcggccttcagttccacccggacgaggacggcgccggtggcgaggggaaggtcgtgggggagctggcgccgggggagatcgccgtgttgctctggatgtgctgggtcatggcgtggagcggttcggctcccggggtttcgggtggtcaggagggaggcggcaagggggaacccgtgttgctcccggacgtgacgcacctggtgctgtcggcgctcgtgtcggcgggcgccgtcgcggatgacgctggtgtttggggatgggaggtttcccgtggtgggaagggggtgaaggtccaggagttcacgtcttgggtgctgtccacggctgctgggcttggcaactgcctctcgcggtatgtgcaggaaaggttccggtcgtgcgcagctgatccagtagaggtaagcaagctgcattgcagagtcagtaatttactgtgaaaggttagctgcattgcctttgttttgcatagaacatggattttgagaaccagacatattgcatacttcagataagtgcaaaatggtgggggatcttcaattgatgtgattttgccatgttttcattagttatgctgtactccctctatttactttttcaatttaacgtcctcattaaaaaatgatggaagggatattaatcttaggtgttctttagtagattcatatttgatgacacattgtcagttgtgggagaactaaattatgtagtcagattctgtttattcccagtatgcaaattataagaaaaattctgggatgcttagattcaaaatgagtaaatgactggtaagaagacaaggatgcttagagtcaaaatgaataaatgactgctaagaaaacatgccatttcttctttatatctgatagttcagggtgactaaagaatcctactgaggatgtccaggcataatggtgtttggttagtaaattgctctggtgtttctgatgtggctgggtctttactgtaacaaaaagataaataagtcacaaaaacttttggtttgcacttggttttagtagtttggagctcctttctgtgatgatcattgttttgctacaatgatgaagctttatttattttacccattttattggaggaaccaattagatggcatattaatgatcattaagcttcaaccaaatgtttgatcttagacgttgattcttacacgcaggaacgttctgtttcaactggtaacacgtcatcttgtaaccctgacgtatatttgttaacacgtgggagggcatgggcaatctctctcagcctcagaaacacattgagtgaaaagtttttatcagcatctgtcattggaatggatacagaagaccttctttataggttactccttgttctaaacatctggtgacattttactcgttcttatgtttttttaatgtttctattgaaggccgtaaacttctaaactgtaatcaataccagatcaattcctattatggtttttcattacattttggtaacttttagcctttactgaatacatctctgcaggtcgtcagttcatggaaaagggctgagccggttttggtcttgtgttgagggatataaaggaccagtgctaattttactctcagctttctctcgtagtggtggtgacaatgttgatactgatcaaagatggggcattggtatattaaccgaggagggtttacagaacaaagacaccttctatggtagctctgcttccctgtgctccacatatccaatattccgcatgctcccaccatctggtatgacttgtgctggtcatttcctttttaccacagctgatagtagcttacggccttactgtgcctctgacctagcaggtaaggagaagaatttcatatattgccacctacatcctcagataagggtgtacgaggcaaagccaaagcctgttggtttaggatttggtggaacgattggaaatgagagaatctttttagatgaggacttctctaaacttacagttcgccatcatgctgttgataagacttaccaacatggctccctcattcccaaccaggtgaatttttgcatgtactagtcattacaaattataacctgattgtgctgtgaagttttttaggtaggaaatctgaatctgttttgttcctgaaatacagtttgtcaattagttggtagcagaagcagaatgggttttcaaaatgtcgttgtagtgccaagggaagtaataagattgaggcaatggatgatttttcagttgagtagtactgacactaagctaaaaagaattcacaaattagaaactgcatcctgtttataatttacataaattacgaacaacactggtagccatgtaaactgccttttaggtttcattttaatagggcacaagaacactttgccactttccttcccttgtaaggtctggaatgaattgtagtagcagtatgtgttgtgaaacaaagaattcatgaactgatatcatctgacctcgcttcagacaaatcctggccttcgattaaatgctagcaaaacatattactctacactctgtttcttttcatgtagggttatttacctgttgaggcttcagtacttgatgttgaagtatggggccttggtggagaagcaacgagacggcaacaggatatgtacaagaagagggaggatattttctcagagcagcgaagaaaagtactaatcaaagcacctaaatcttttaactactaactatgctagtactgttaaacgtgtgacagaaattttaatgactgtcccctatttttgttttcaggttgatctcaaaacatttggcaattgggaggactctccagagaaaatgatgatggacatgatttctgatccaaatgcagttcgacgggaggaccgttgaatacaattttggactatatgtttattatagctcattatctaaaaaatgtttattatagctgccttagtgccagtacatatctggacatgggaaatggacgatcttgaggtttcatctttcttgtaccttggagatatatagaggagtaggtgcacatatttgctccatttgatgtttgggccatttgactgggcaacacgtcatgtaagtattgaattgaaaagagtcttgtatacagaatatcggtctacaacggcatagagcttcctttctcatgctccccttgttttatgggaatcgatagcaaacaaatttgtatctgtattgtaaattgtagattattcccgtgtccagactatcacacagacatggtaatttccgattatctcacatcggtttgcaaacggcctggtttctcgttaatgtctgacggttcccttggccgattcatcccggctcctgcagtatcataggctcacgttatcagtatctgttaaaccaaactacattttctcgagttctgtacatatgctgaaaggtgctccctccgtggcttcatccaatttttttttatttctagctacaaaactggacaaacattgagttcatagttagaattgaatttttggaccaagaatgtagctggtaataatataaaaaagctgagtttgccggcttataacttctaatttattttctaaattttgtaggtgcttgttttcaaaaactaggtaaaaatttaaatcgtttatgactcaaacagtgcataggtttggcccgtgtctgttccaagagagaacaaggatacctttgcagccatgattgggtagaaagaacacacacacagttacacatagtacgatggacgtgacgagacagtacgagataaacacacacagagcgggagctagcggtagaccatatgcctgctactagtagcaaaagtacgtgcaggctgctgctgctgcccttccccgggttgtgctgttcatttcacaaactctggtgcaaccactggcctgatcgatgatcgatcgatcggatagtacaaaaaatgtactaggcatgcatgttcagtttcaccgaccaattgcccatcaactaccgcggcggcaacaaattctctgcccgaccatgatttgcccggagactcaccaccccacgccatgttggtggctgctactccctcctgtggtcctgcctgtcggctccttaatctcgagagcacacattccattttccaccttgggcagacatgtcccttcaacttcaacttgtccgtgctcgcttccactgtagtgcattcattttgcacaccaaaagttcctagtgagcaaccaattcagatcctatatggtggagtattacaatttacacatgtagcatttctcaccgacatgtgagcccgaggatctatgcacccacgtgttagtgagcagtactacagcagaggaccctcacttagaagaaccacattttttctagtgtacctagatatgtttttcaaatattatctttatcctaaaataattattgtttaaaaataattatcattttatactaatttggtataaagattaaggttttaaaaatataaccataggatatactatattgaataatgtactccatcactatttactcctactaaacaacatattaatctttatattttgcaatagtgggagtatttttatcatgatcatggatcgtacagtttggatccaaaaactttttttttaagtacgtgtctctcgcctcgccttctctcttatatcctcggtaaaaaaatattaaattctatctataaatctggataatcatttatctaaatttattgctagaatctttttttaacgaaaagagtatccaactagacattaatatgagatgtggagatcactatctcctattgacaggtttattgtatctgcccctcgtttctccaccactccgacgttgccctaccctggctagctctgatcaccatgccgccattccattcatgctactcgtactcccagctgctgccgatggcaaccaagggtggcgccttctccgacctccatgctactgtagctagcaattggcaatgtagcatgctgcaagcttctgctggctgctgctgcgtgtgtgagataagtactagcttctgctgcctgtgtgagataagtactagctagcagtagtgatctctatagagagagcagctgaatctttttcagattacactgaaaggtagacgtacgagctgtggtatagagagcagctgaatctttttcagattacactgaaaggtagacgtacgagctgtgaatagacgtacaatgtacagtactctcctactactactactacgatggctaccaccagcttatcctactacttctacactgtaaaagcagaaaagaaatgatacgacacgaagtaaataaagatggatctatgggtcgatggacaggcggcggcagcagcgcaacgcagtggactgaaaaccggctgctagtagcccccttccaacgctacagtagcttttcttcagtgatagctagcctcgggaacgtatgcttgcatgaatacgatcgccatacgccttggacaagagcatgcatgattggctcactgaatataaacacaaactccgatcgatcctgtacaaactcgcgacactgttttgtttacggttgattcgataggtgcttttctctgcctgtcttctggtcgagttattccactcccctttctgcaatcctcacaaagtttgatttgttttccccagctgatctcttccttttcttttttaatatactacctccatcctgaaataaattaatttttcacccatacatatcaatatacgaaggaaaaaactgaaatatccttcactttatcaaatatttgctactaagtttttaggaacaaataaattgaagaaagaagtaattttggtatgaagaaaatagttactactcagtaatgtacaccaaatacggttggaatttcatatagacaagccaatgcagcaagtagccatgaatgtgtgtttggatacatgcaatatgacggtattgtattttgttttcgttgcatatttcatttatttcttcgagtaaattggaaccatgccattataattttcccttcttcattaggagtatagctgatagcaagagtagcaagcagaagattcttgtagccatgtgtttatgcagccgaacggctacgctgtacagcacagcttaaaacgctgtaacaaaggtctaccgaacaggtcccatgattacatgagtatattagtttctttgattaaattaagtggagttattttgagacggagttagcataacatttctttgaacacacccgaaacttgttaccctctactccctgtgtatcagtttggatagttcctatgagtataaccacgggatccccgtgaaacttcagttaaccgtagcttcagccctggtactgatagcaggagcagctagccggagtagctagagctttcatactgcctttcttcagtcaccgtttgcctgtcttccagtttccatgtggtgccacagagatgttgtccactcctctccctatcatgcaaaacaagaagcacttgatggctgaactgaagttatacacaagctctcttgcagttgcagctcacaacacattcaattcgcacacctctctcaatctctctctctctctctctcatgtagagagagagagaaggctgcaggagggcatgcagaacagagcaggcccttaataggaagaacctaagttccttagggacagataggtacaggggaggaaagggggaagagagagacaagtttctatagggcaatcatgctcctctttctgatcactgcaagaagagaagaggagaggagatcaccgagaagatatcacaaggtgtccatccgggcacagccatggatgcatgtgttgttctgtgtccttctgttggaaagcaagaaccagcgtgccctttgtctctctagctgcttgctgcttgaattgccatggacacaaaattgcaccattgatatggagtgaaaagggctatgagatgagatgggatcagggagtaggttcttctcttgactgactcggcgtttcccattctgtagagattcgtcatactcctccatggtgaaccaaccggttgatcgatctctcatctctcctcatgtgatctgctgcactgcacaacaggggccggggttcagttcaagtcaagagttatggcgaggtagctggctggaattgctgctagctagtatactagggttcatgcatgcattcttgtgaactgtggcggtcactatgtgaactgtagcggtcactgtgccggggcggcgcgtgccgtggacatgcttgtatgaggctgtgttgagatacagacattggatccaaacttcggttcttttccatcacatcaacctttcatacatacataacttttcagtcacatcatttctaattttaaccaaaatctaaactttgcgctgaactaaacacagcctgagtataggcacgaataaattgtaggaggttccaataatcaaataaaaccgtgaatgcaaattaaaagaatggatacattttcccctttatgctcccgtcaattgatcacttgccacacgttcacagagtgagtataatatgtaaactgttaccccactcaattgaattgatattgaattagaagagagagaagagatcacaaagccggatgcagcacaaggtacaacagacgttacaagataaagagatatgccgtactaaaggttgttgtggaatgagcggaaccctagggttttctattcctcgctctcgccggtgttagtggttctcaaatccatcctgcaggaaggccggctctggtcatcggcgggtaccgctttgtttgggggcctactaggagcttagtggggttccctccaccacaatctccctctatatgggagcagcttctctcttgtagtttaatctcagtagtcttttagtttttcacttatttttcatgtcccccggcgatgacctttttggttgttgcgttgtgtacttgaaactctgcttttttctaatatattgatgtgcaatctatttgtaataggatgtgtcacatccacctaaaatcccttatattatgggacggagggagtatttagcatggttgcattcccaacacacactttcataagagagtttttttagttaaaatatttgtaatattcaatatggaagcttgagttcacaattgaaaagtttcatgtgatctaaggcattgtttagttcccttcaaacttctaaaaattacgtcacatcaaatatttggacacatgcatagagtattaaatgtggacgaaaaaaaatcaattacacagtttgcatgtaaattgcgagatgaatcttttgagcataattacgccatgatttgacaatgtgatgctacagtaaacattgctaatgacaaattaattaggcttaataaattcgtcttgcagtttataggcggagtatgtaatttgttttgttattagtctatgtttaatacttcaaaatatgtgtccgtatacttaaaaaaaaatttggcacacgaactaacacagcctaacttgaaagctttggttgaaacttgaaagtgctaaagtgtgtgctggcaattcgtctgcacgtactaaattgcaattctcttgttatagctaggagtatggttataccagcaaacataatttagccttttgatgaggagcacctatatatagtaccacattccgagtacctttaggataatctatattgaaaatatcctaatactagtattatcagtactagtaaaaaatcttaattgttgatttatgagttttacaaataaaagataaaatattttacagcaattaagtggtaatagtataaatagatactacaatccataatacgatcaattaaaattaattatactactaatcataaagatcattgtaaaacatctccagttcggctgtatttaaatccaaagtttggatcaaacttcagtctttttccatcacatcaatctgtcatacacacaacttacatcatctctaattttaactaaaatccaaactttgcgctgaactaaacacagccttcatatacatcgaccacactgaagttcatcaaaaccgtacgttcgtcaaatttaagaaacataaaacagaggatatatgcaccactgcatgtaaggcaattgcacagaaaaccttgtgctagctggatcgtatgctacagtagactgcgtaggatgcattggtactgaaaaaaagttttgttcagaatgcatgcaaccgcgcgcctaccagcagtctattgtgtccatgaaccaatcatgacagaatatcctcgcgttcccgagggagaaaaatcgaactgaatgaagctagagtttacacgaaattcgaataaaataatccaaatgaactaggagtatatgtgcattcatatgtgtatttggtttccttctaatatactccatccgttttataatagtcataataaaaaaaaattagatgtatatgacacatccatccaaaatctcttatattatgagatagagggagtaacaccacgtaaatccatcttatgtcgttacaaacacccttttattcttataagtagttaaaataaaacccgtattttaaaagttttagagggtgtctcgtaaagacctgtttttgcgtgtggttgtgatgtcgcgcgcgcctaaaaattgtttcaactgtttacagatatttggggatagacggttgctacatccatatatgaaaaatacattttagctgtttgcaaagactttctgtagtaatgtgagagttcaaaaaagaatatgggtatttggtacatggagtatagaagtcagctaaacctctatctttctttcccctgcgtaccaggctaccagtagcttacatttcttctttgtaatttctctcatcaaaatgcaaggttgaaaaggctatatacctactagctaatagtatctctcaagatcaaaacattgtcgaatcacggatcaaaataacgtcagatttcaccattcaaacgcagtactgaggctatgtttagatgctaccctaaaatttttcatcatattatatcaaacgtttgaacacctgtatgaagtattaaatacatgctaaaaaataactaattgcacatattgcgactaatttgcgagacgaatcttttaagcttaatgacggattaattaggcttaataaattcatctcacggtttactgatggattccgtaattttttttgttattagactatgtttaatactttaaatgtgtattcgtatatccgattttcgatgtgacacggtaacaaattttacccttggatctaaacacagctataaagcaccggacgaactggattattttccctgtcaatctgatcgacacacacctctcataacgtaacattattcacagagaactgaaaacacaggcaagtttgaagaagcaacatggtaccaactctcacatcacaaccacaaaccatgccaccaccatggttgcctccaaatacagctcaatgaaagcatcaacatgcatgctctctctctctctctctctgtgtatgatgagagagaaggcttgcagcttagctaaggatcggagaggagaggagaggaggaagaagcgattgccataaggaggcgcctgcatggtagtacgcccccttgcgtagtccccacatgcctctcttccttctcctacctcgtgtgtcaacttcacttgtccatctccaaaagatatccatgattctccctcagagcgccccaacctatatcaccccccctaccttccatagctccccttccctagctaccttcactccatccttctctcctccttataaaccctcatgtccctcctccacccagtccaaggccacaagccctttcttcctcttcatcttgatcttgatcctcttcttgatcttctacttcttcttcttggtttcacttggcatccgtttccatggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggtacgttgctgcgtcatggctaattccgatcgctgcttccctgctaagctgtaatgcgcgagccggcgccgagccgccgatcgatgcttctgcgtgtgcaggcgcgacggctccctctttcccgggcttctacgtcggcaatggcggcgccgtgcagacggatcaggccaacgtcgtcaactgggactgcaccgccatggcagccgagaaaaccttcctgcaggtatgatcacacgtactactacctcctccaggtgtgtgtgaattcaccatgcaagagcaagctaatgtgcaatgctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtgatagagctgttttgccttcatgccatgatgccaactgcttgatgagaagaacagtgtgagtgtttctgattgagagagcaatggtgtccatgtcctagctactagagagcttagctagaaggaagcatatatagaagcatgtctgaaagatactatatttatatagctagggagtatgcagcattataacatgcatgctgcctgtagaatgcagtggtcctcaactggtagtgcactgcatgctaagttgctactactaactacactagtggctggctggttgtgatgtgtttgggcacagttgtgtcaaacttgtctctccctttgatggcttccagctgaaggaaaaaagttatctatatctctctgtctgtctgctgtttactactgcctggttgctcatgctcatcacctgttgagatttttctcattccttttttcagcaggagtataattttcgctttttgtactgccagtttcttgtttcagaattccatgtatagtagcaagcctgggaccactttggttgaacttgaattgttggctagtgttaggaaatggtcagcctttccagtgtgatcatcacatttacttctgcagtgttggaaatgctctcgcctgctcacgtacacacattctcgctttatgcctttttcatatctgatgatcagacaaagcatatcgtcgcaatagctgttagcacagtgaagaaatgcaagtttttcttcgatagagatattaagagaaaacttatatatatattttttgttcgatagagatattgtactatatactatgaccctatgagctgcgattataaaaaatgaaaatgatcctgaacatttcagagctttctgaaacaaacaaacaaaaagtatagtaggagttcactcatagattaattacttacaaagcctaagaagcattcacaacctaattacttgaactgagagcatcatttttaagatcaaacatagctgaggaattggttccataatattaccccctcaaaagatagtacaagtgaaagatgtattaccacgcctaagtcctaactactgaaaacttacatgactgaaagtagctacaatataagaacatatgaaacgcttgcacgatctgctcttggttctaaaaaaaaaagatattacagctcttttccagctgagattatcgaagaatttcagaacaatggtttcatgctacatgcttccctcatgtcaatagaactgaaggttggccacctctttgtctctgatgtgaccatgctgctccccaacaccagctcaaataaacaagatgggatcacattttcctatgaagaccatggaaaaagcggtgttttcttcttcttgagtgctttcgatataccctggacataacgtgcggcgagaaataaacctagattgacagaacatagagatgaagtcaaacagatgtgtgcagtatcctcaactgtgcacactttgtaagtaatataataagtattactagtaagtaatatcctcaaacagatgtgtgccatgtaggttaaactgtgtcatatcatcaaataagacaggcgctcaaattttgtactagaatgcaaaaagaaaagagaaacagaaaataaaggatataactcccaacaagcatatgtgattaaaaacatttaacagaaaattgacgaacattatggttaattaaagcggatatactctggtattcttcaataaaagaactaccttggagttattacaaatgccattagacgaaagcacggaattgtcatctatcaacttctcattttgatgtgtcagacagtagttatcccaaatatgcttcctggaacaaagagaactaatattacagagggcatacataacaataaaaatgcataaatcagatttcagatgttcacaatatccttaacggtgggagatatcgacaaacaacatgtccgtgcatttcagttactatgtgtagggaacagatggaaacatggagtttgcggaacggattcagatgaattatgaaacaaagagatcgatgaacatctagctcacatataacgtattctgtgggctgtggctcaaacctgaagcaaacaaagagtcagcctattcaggataacgtataactcttatatcagctattctgtgggctgtggctcaaacctgaagctaagtttctggctaaggctgtgttagcatcagggagacagaatctcaaactagttctatggctacaatttcaacacaacatgttatttcgttgcttcctttaaaataaaacgcattattttgttgtcactagtcatctggtaatgcaaatgctctggttgtacagaagtaacaaaagttactccttccataatttatagtttagcttaacaaacagccatacttgattccagggattgaacttacccccagcatgtcaggcaccatatatgcaaatttagtggtagtagtgttgggatctctttccagtgatcactacttgctaggtaaaagaaatgcacaagcataatcagcagagaagtgtgatccttgacagggtaggacaacaggactgaagcttcctaaaattaaggaaatatgattatacctgtgaagggatctgatagttcttgaaaaaaagccataaagaaaaatagaaacctagaaggatcagcacgatcatgattataatttacttagtttcaactgacaagtaataagatatggaggacctgtctataacctcaactaaatgggcttcactcattatgcatacagattcaggcctacaaaagttgagctcaccaatttgctgtaagatcaactcaaaatcaaaacaaatttcagcttgggttcatatggggtttgagctaagctgcaaccctacaaggctgcaactcaaatcaatctcatatatcctgtgactctcactctttcagcatatataccccatgacatccttatgcacaatacctctggattgatcaatacgttgctctagtctcccttgtaggagatgctagacagcgaaattacattgcaaatgtttcaaagatcatttagtgatcaggacaaataaggttaccatgagtgaaagtaaatggtattcatcgcaggatatcatccaccgtagaaaggagaaacaatttgcaatcatcacattgtttaaagagatgtgggctttaccatgagatatgacgatggcccatcttttcctgttcaatctcatccgtcttcttcctgatagccatcttcaaatccttgacagtggctgtgttcaacattgcaacatctttcacacacacaaagaagacattaaaacgtcatacgatttatgcaatctactagtagatgcaaattaaccaaacaggcagtgaaatgtggcattcgaagggaccagtaccgaaggaggtgccatccagcttgacgacggttagccgcatggcgctgccgagctcgaggttgatcagcgtgtcgacgtcggcgagggagggcttcctgggcacgtcggcgagtatggggtcgtcgaggagggcggcgagcatggactgtagcttcgcctgcttggcctcgctgctctggtaagccgcaacctcctccggcttcgtagagaccgaatccgtcgcctcctcctccgccgcagagaacgatttcccggggtccattgcgtttccgccgccgccgccgccgccgtggaggacgaactctcgccggccagtgctagttgggccacgagcgtgtggcccattgtaattaattgggccgtagcgttattcctgcggctgcgcgttccagccgttggattggattcttgagcaatctggacggagatcctctcgtttgatctgtctctcttccgctccaaatcccccaaacccttcgtctccgccgccgccggaatcgggcctcgccatcggagtggcggcgaggagttgaaggccaccgaccgccggcttcgaccacgccgcctcgtcctcgtcggatccgcgaccagaacgccgccacctcgtcgtcggttccttcgcgcagatcgccgccgcgtctcatactcttcggtatagcaagcaagctctcaacgcctctttttttgggttccctaatctcaatctgctgcttggattgctgaattagtgaataatgctgggcttcgatggtggattttctgtcggttgtcggctacggggctgatccagccccgttgccatccccggggagggacgcgccgagtagagcagcttgcgaagtggttgcggccttgcggggagggacaccgagcagagcgttcttgcttgctggttgggctgccaatctctggctatccgtgatctttgatccatgagattctgttgctattccttcacatggaggtttgtgttgtactttgggcgaattcggatggatgttggattaggcagggttttagagagcttgggttaagaatcctgcttactgatgcacaatagaattaaggtggggattagaatttgctaagctgaaggtttgagatcagggggccagcactgctccttggttagcttgttaatttgatgatgaactactagtgatcctgtagcatgcatctctgttttgctctgtatactcttgttagtgtgattgcaaggtggttttcttttgctactgggcagtgtactgttgattcaaaccaactcatgttcaggccacctttagctgctaccccgttgtttaagtcatcccctcctcatgtccaggttgctcccagtccgcagccacctcttcctcctcactgcattgtgttccctaggtgaccttaggccttccttgctgctacctccacctgtctctgatcccgagtcctgaccacccccttcctccttgcattgccatgacactcttttgagatcattggctgcatgtacatttctgtctttggctttggtgcagcttatcagtaaattcgcatgccaaacttggtggttgcatattgcagcactagagtcgatggaatgacctggtgacagtatggttaactatattttaaggtctaacaaaacggagtggtcctatatctagcagtttctttcagttagtaacccatttgttcaaccatgagtatttattgttttagaaattgttctgttgatgtgcctgttaagttcttcactggaaagtctgtaatcagcattgcttctcttacacatactatgcccaaagatcatagagttgttcgaccaacagctgaatagtatacaaatggatttttttttctgcttgttttttctgttagtgatggaccagcattgcttgtttctgatatatatttgcattctgctatggttccacaggttagcattcgacagccatggcaaagcatcatcctgatctcatcatgtgcaggaagcagcctggcattgctattggtcgtttgtgcgagaaatgtgatggcaagtgtgtcatctgtgactcgtatgtgcgcccatgtacgcttgtccgagtctgtgatgagtgcaactatggttccttccaggggaggtgtgtcatctgtgggggggtcggcatctcagatgcctactactgcaaggagtgcactcagcaggaaaaggaccgagatggatgtcccaagattgtcaatcttggaagcgccaagaccgatctcttctatgaacgaaagaagtatggttttaagaagagatgatcaggaagttggatttgtctggtccatttcctcgctgtgttttcagtcgcactgatatggttgttaaggacttaaggcggacatctttgtattctatggaatatggtctagattcttaaggctgcatgtgcagtacgtacctgatgttaatgaccatgattgttgacatgagatgtgaaccgagatacttttaagtcttataattatgtaagccactgattgtagggaataagtgaatgctttagctgttcgaacgacctgatatggttatcaactgggaagcaatgatacttatctaggagctgagatgcagctgaggttaggatacaggttgttgaagtcaggataaatgttgttgaagtcaggatacaggttgctaggaataccaacctaactcaaaatatatccttcagtcattatcctcgttggatggatgacagagttcttatctgaaacgtctcctgaaacactgatctaatccattttaaaacaacacgacgagacggtcaccagagtccatgattgagttcaagaacgaaaccgtcaggcacatgacctgcctccgtcacggacaagggtaacatggtaaacacgcaaagcgttgcctagaagatccggagaagtttttttttaaaagaataaaccgctaaactaagcagcccaaaatagcgcggaaagagagcagaaattacaaaaaaaaaaaagagagagagaaaagaaaagcaaatcgacgcgaagaaataagggcaaagccgccgacgcgagagccagcccatccgcctcaccacctcccgtccctcttccgctccaaatccaaccctcccctcggccgctccgcttgcgccgccgccgccgccaccggagcgacggcgagggagggagtggggagaagcaggaggaaaccccaaaccgtcccgatctcggggtcgggaacccgccgccggcttttccgctcgttcgtccgtccgtcgatcgcccgccccaccctatctagggtttcccgcgctgtagatcggatcggttcggattggttgcttgggtttggagagtaatgatggggtcgaggcgatccaggcgcgtttcatgggcctccggaggcaatctctgcaaggtactgtgataaaaacttgccaccgccacggcgaggagacggattcgcttatcctgtatctcccagttttgttgcggagatttgcatcgtctccgtgcagtgcattcgttggagattgttttgctctgctagctcgctttctacccttgatttgctttttgatttagtcgccttttgttcaaactccgcgaaaaatacgatcaaatacgatctctcaattttttttcagtggtaaatgtgtgaatgcttacaaaaaaaacgaacatgctattctcagtttgcaaatccatgagcagaagaatcgactgagatggatttcattctgccaatgatgcagaatttctatgctgaatttgcagcgaaaaaaagatgggggaacccccagcaaatatcagtaccgaaccacaattaatacgcagataatgaaacaaaaaggacgataacaacatgatacctggtgcatgtaaactatcattcttttggggaatatgtcccattggtgtatcattcttttggggacaaaatatgtcccatcggtgaagcaagatttagccatttgatcttcatctagaaaattatgtaccaaagaatcttttttttttcatattcttgagtggaaggactgcatgctttaagattctattcaaattgtatagccagataattttaaatggcatttgttcacaattttcgtcttaggttttttataatttttattccataggtctataccaacttctgttagtgttcacatgtaatgctgaattttatgccctagcaggcagcaagcactgccctaaatatgaatgaatttggggcttagattttcaatagacaccgaatgagtttggggcttagattttcaatagacaccgaatgagattggggcttagattttcaatagacacctgatgcaaagcaggtcatgtctctgacacatcagtatgcatgataggacgtgtatttgagaaatgtctcattatttaccctctataactcgaataccatgaattgtttagcttgcaaaaaatgctggattttttttacttttttttttacctttaattgactaggcattacatatatttcagaattgtcatatattgggatgaaacacaagcaatgttaatttgaagcatgtgactgttgtctaggttcaaattgttaacttttatatattaaaacctaatctaaaggatgttctaatgtgttaataggatacaaacaaaaataattcaaaagtatggctgtttatggtataatatattggattgtgcttcattttgggctcaagaattgaactgtagcactacactcaatagtaatgtaaacatttaatcaggattgtgcttcattttgggatcaagaattgaactgtagcactacacttaaaagtaatgtaaacatttaatcaggctatctcgcttcgtctcattttgaccatttcctgccattaatgactctaataaactttgatgattcaattcaaagtgtcctatagaacttaatgaccaatatatcatttttaacatattaagctatgtggagcttatatcacttgttaacacatgactttaaaggatgaaagtaagacatgaaacaaatattctatgagttatatgattcatctcaacctttttttgctttgaagtacaaagagtgatctctaattgattcagcaattcacaataatctctaatttattcagcaattcacaataagctcatgagatactaaagcatttatttcaccgaaaccaagtaatcagcatatgcagtaagcatccttcaaaggccacgtctatatatatgtaatcacacatgcatgttgcttccatgattgttatatcaccagtattttttttagtgatatcaataccatgctatgttgtgataagtccagagtccagagttggctccttgttccactcatccttatgctatgttgtgataagtccagagttgactccttgttccactcatatcctttttgtacgtatggacggataactgacaaccgtatgaaagtgcatccatatcaccaatacaacactccttttccccttgcacgtgcacctttctttcttcgtgctataatggtattcattgttgttttttaaatggatcaacaatgtgaacaaaatattcctactgccaatccagctaatgaacagctaaattggtattcatatcttaagtatcctgtttgtgagatgacatgttagttgcagatttacataggactgaatgaagtactttcctcgaatcttgattgctggtgcctggtagctgatatgttatggactgtgaaatctaagaagttaatatggatttgcatatacaacgtgtcaaatcatgtatatattatctgaaagttgattttagcacttcacattggccttgagtgtttaaattgtacagattgcgggaataaaatttggctgatggtttagtagtactttgaataaatgatcaatagtaagatggtattaattgtaagagatttttattggtgttctagaattttgaaggatggtcatagtcttctgttaagaaacatcttaaaactagtcagcaattgtgttttgtggattcatacaagctgcaatctgccggctgttagaatgtatgttaggaaaattaaaagaataaatagttgaactgctgaagtagccctgaaatggcattgaagaggaagggtttagttcttgtttcttttcatcttgtcttggataggcatataagatatataaaagtggcatgaaggtattaaacaatccttttattttactggataataaagaatggttttaactatcctggaggcaggtaggtgctaagcaagtgattgaacattggatggagttctttcaaaaaagaaaaaagaacattggatagaaactagctccttgctttgtttgaggttaatgtctgtcacaaactgttatcatgccttaacattgtgaaccctcctaaaaaaattattcttttttgagacttcattgaactatacattttggtagtcagcagaagattaaatttaatctgagctgaagtttttatcacccagcattatagcccttttgatgatacgatgaccaagttcttcaaatttgttatttggctcacagaatgcttcatgatagtgaatcatcttattgcccatgttcttcggacttgattgtctcgtttaatgtttcttgtgtcactaaagcattgtaataaattataaatactgaacaaccttgtatcatgtgtttgtgtcaggtaaggcttttcctgtcagaggattccccctctcaagctggattaagaccgcaggataatctccaagcaaaaggctcatggttactgcatgcagctggcccaagctcagatgattccttgcctccaggctttgagtcattgccgccaagcaatgacctcaaaattgacatgtctcaaatccccctaattaggtggaaatgccccccacatgtaaggctcacagttactgttgtgttggacaatagcaagacaagttcaaagattactgaaattcccaacactctcttgattgcagatagtattggagcaggattggcatattgttgctggagaagaaagtagggagattgaaattcaaaatgagagaataaatggagcgcttgaggcaatttacccacgtccatcgaacattccgccaaagtaagcaagctccttttttttcattacaagttcttcagatgtcacataccattttttataatgatttttttgtgtgccaatccagcccatttctttctcttgatgtgaaagatgcccattatgacgattccaaaaccctgttggttcctttgatccctcttgaagatgatgatgcatctgatcaattggaaggaccaacccttgatctaccaagccattacaacataacaggagtttcaaatactcctgtttccgctgagcaacaaccaccatgtggtggtgctataagttctggattcaccattgagcctcaggctgcagtctcagcaacagtcactgcaattatgcaaaccatacagagtaatcaaaatgggagcatggctgaccaaaacgggagcacgattgaccaggaactactcttcaaaatactaagtgatccttcacagcttcagaggttaatgaaagaatgtggcccagtcagacatgaacaatcagctagtagttctgttgttgccccattggtatcaatcccaccaccccaaataactgcaagctctcctgcccccttctctgatcatgtcggaacctttcatggcatgaatcctaccctgccgcctccaccaccaatgatgaatcggccaccttcaaccattccttcagttgctatgaatcatccaccaagttcaagcccagcaatgaactttggaagtgccctgccaagttcaagcccatcagtgaactttggaagtgttccagggaggggtgtcggctattataaaaccctcatccatcagcatggaggggagagactggaacaaccatttgagcagcatggaatgcagtttggtatgtaccgccaacctggtcctccacaaaatggcggtattgatgccatgaacggtgctgctgctatggtgagcagagatggcaaggtgaggccgatgaaaccgtgtgcatactttaacagcccgaagggttgtcgaaatggtgctagttgcacattcctacatgatgcgtcagccccaacaagaaaagatcatcagaagcaaaagggatcaaaaaggataaaattagacaacacaatgggcggtcgaaattgagctgaagccgccatttaatttttgactgttctttggttcatctatcatggatcagtaaatattactccgttagctcttccattagcctccttttttatgttcgtcgaggagaggagatgttctgaaagaaagcaaaatatttcatgattgattggtgctcaaatttttactgaatcaagttcgagctcgatatcttgttctgaattcactaattctgtctctagttgtgacagtcggtttgtcagtgaaacgtcgcactctgcaaatactagtgcacggatgaagcgtagtcttcttcgcattcattgtgccagtctattcttaggtgattcggtgatttttcgtgtattgctgcatgaattactaagtaatttttaatatatttttttacaaccaagatagaagtaaaaaagaaaaaataataaaatataaggtgtatcagtacttatcatgaaacaaacaaatgataacctaatatgaaacatattgataaatatatgttaaacattataaaaatgatagatagatttgttaaaatattatgcaaatgatgtgacgggtgatgattggatatgtttgtatgttaatttgttgaattaaataaattgtagatgatgttgtatgcttgcatgaggttaaatatgtaattattgttagtgggtgatgatgtagcatggttacatgttgagttttagacttagtgggttataattttatagatagtatagatacatactctttttccatatttcgctaacttgtagtaaatttatgataaaactatatcaacatctatataaaatgtgtgttgataatgtattttagttgtcgttataggtgttcataggtttttctataaatttagctaaaattagagagatttgacgtaggataaatcatatactcattccgtcccaaaacataagaaacttggactggaggagaggagatatttcctagttatacgaatcttgacatactgtagattcatactattatgaaatgtcttatccgatacttagttatattttgggacggatagagtatgacacaacattgcctgatcgaccaccattggcgcgccacctagtcaatcgtttgagctctctcatcgttgtcttcttaatttttcattggatcctcctcctttaataagaacgtgttttcgttggagggaattgttaattcgagggtaggggttcttaattacgttgtttggatggcgaagtttaagagtaaactctcactttttcaatacctaggtaggacatataactatgagggaatttcgtcgtaagtacgttaaagataaatctgagccggacatcatcataaaatttaattctcactcgaactttccgtgattctcatctctactaccaaataaaggatgatgagaaaaattgaaactttcatgaccaatctttccaccaactcttaacatgttgagcatactaaaaactcaagaattttggatagtttttttttttttgaaacagtagacggtaggagttctaccggataatttagaagagaattgaccctatttataaggaaaactagtcccaaaaaccatacaactgtacagtttgctaaagggaaaccgacaaaaccttacattgaaaacatgaaaaacctgtgacaaaactacaaaccacagtacacaccgagggaagagcaggaccttcaagacgaagcctccaaggaggtaaacaacgacagaatccgctgtcgacacccacccaactgagctgggttttcacccaaaaggagagagagtccacaaggcaacacctccaaggagaaaacggcgcccgcaggtgtcgatgtcgccgatcttaggagaccagactaggctttcgtctaagacttcctcaaaaggtgtagagcctctagaaaatcagagctggagtgttgaatgttatcgttgttcggcccaatggctgaattcaatgcaacagctccgactccatcgaaacataaagactctagcatcgtagaggacaagaattttggatagtcaatggaggataacacggctttggagagaggggctaatacgcatgtgtccatgcacattaggcccgtgaacatgtcgtggcccaatccaagttcgaaagcccatgtgcattcagcctacaaccacacgagcattcgacttggttgaattttattttaaaatataaacttttagtatagaaattatatatataaaaactttatgtgtagaaacttcggtatagaaattttatacatagaacttagatgcaaaaactttgtacataaaagaatatttggtatagaagctttatacatgtatttatggatcaacccgagaaaggaaataggaatgaactaaaaccacacgctaaggaaggaaatgagcgcaagttgcgcaaccacctgacctaaggctatgatctataaatctttcccaacttctcaacggtgtaatttttaaaaagaatttaaaaaaatatttatagaaaagtttttaaaaaattatattaatttttaatttttaagctaagaatatttaattaattatgcgctaatccgtcacattgtttcgcatggggaggaatggatttgaacccgcgtttgcatgccgagcaccgtgtggtggtgttggcatttcgtgcattaggaattgggactgtctgtataactttgtgggccacatttggatcgttgatgtcagaaatttaaatggactttcctcgcaaaaaatgcttcagttcgtaactccatttgattttgttggccagacatgattgtgcgtctctttggactgggcctagcgggttcattggtttgtttttttttctttccctgcgcactgacacacgggagtagaagacaaaagatagagcaagtcaatttcttgtcgacagaacctcatacagcggtcaggcatttctcactccacaccaacatgaacatcaatattggcaaatataacagaccgctgttgcattacaagtcaagatatattacacacacaaatcattcattcattcattaccagtcaaataacaacaaaccaagaaccaacaaatgtacattataggaaagctgttgctgttcttctcccaagttccaaccataccgagtattccaacaaagaataaaaaaactgacgaattagatggtggtgtgcggtgggaaaacaagcacaaatctgagtcatctcatcaaatgcttctatggcacctcgctaaaaactcttgctaggcgcactcatcatatatgccatctcctatctgcaaaccagaagttcttgtttagatatatgtgcatcatggatggaaatacagtctatcgtattattctatactgttcaatagatggtaacacaaacatagcaacagcactggtagatgatcatactgagcaagcacaaaaccacactgaagagagtaaaaatataagtacatgataatattcagggattagtgcattaccatttatcagtaatatagccagtaataaactgaaaacaatgaacattacatataaaggacgaaaatgttctgaggcgacactaaaagcaccactgaagagatcacaggtcgctgggaatgttcagggaaggcggattaccggtaatgcccaaacactacatttctatgttcatcttaattttaatgttatgcagttccctgaaatagcttgtgtatgcaagtgggtgcttcacaaaagtggacctcacaaattagagtagagtttaatgacctaaactgcatatcgaggctacaagatatttgttgctacagtgatccagagaaaaacaggtaatcattacaaatcatcttcgtaaactaagctttcaagtgcaaactgatcatactaagatcataggatgatagtagcaactagcaaaggaatagacttgtgcgcacttagtcacttaccagatgaattgggaggaacaggaacagcaccattgcttttcacattctgctgagcttgggatgatgatcgttgcatgcgaggagatgaatcttgcttaccgttagtcatgggcaaagagtgccttttccttggattgttgtcttgcacatccgggcttaactttggtgatacactagcagatgcctttgcccttgcagattctgtaaactgcatataacttggcaatggagtgctgttgcttatgcgaggttcttgatcaacatgatcagatttaaccttgcctgagctctctcgcctcccaagtctgtaatcctttgacagattatccatgctgctccgtcccacagaatcgctgcttggactagttagtgatctcttgcttacatgagacttgggccttttgctcttgctttttttggtgttaacagagacctcacttgatggtgtcccatgagattcagcaaaggtagttcggctcaagggagtaccttcaggtgtcttcacataagatcctacagatttttccagttcatcatgtaaatcaggcttttcctgtcccagatgtggttgttcaacaggcacaggatcaattgcattggcagcgatagcagtgtcatcagtttgtacttccttttctggctcgatagctcctccagaagtgttcacttcagaatgcaaaacactgttatccttttcagcattatcaccaacatggttcctatcttccagggatccaatctccagtacaatctcgccaccatcagcttctgatctatccggtgagtcaagtgtagaggagattgatatctcagttccacattctgaagcagcaactacgattttaggatcatgccccactgagctctctggtatgcttgtgtcattactttgcttgggtgagacattgtcttgtgaacgaggagtatgtacctttggtttgtttgccccatccagactgttggacctactgaccgtcaaattggaagtcaactcttcaaattttaactgtgcagcagcaaatgcaggattgcatgactttctagccataaactttttaccttccatctccgaagtctgctcagttttatatgcatccatagtatcatcaaaggaagattcaggtttttcaggaagaggaatgggttcccttgatgtatcagtttgagtagattgttcaactgagacctccaaaggttgttccgcaacattctcagtctccggttcagtcaatttttcaacatcttccttgaacttttcaatcaaatctggttcaggaacatcttcaatttccattccagaagttctatctggaatgcatgcagaaacctccaggggatgagaatcagatggccttagtgtctcttccgcatcatcaggcaccaacttcaggaaagagatgtcagaatccaaaggaagggtattttcctcatgttgagcatctccttttattttctcatccaccgactcgttattctctctatcctctagcaagtgtcccccagtgtttggtggaatcatggatgtccatctctccatccatttccatgcaacatcaggttcagaaggatcacattttatgtgaatggattttgaagtcgacatgctgtccatgagctgacagaaggtaacaaacatgagaaaatccaaccaagaactaacgtatgataatcttagttaataagggttctttcatctaaccttcagagcaaatccattattgagtaatttctcacttgaagaacagatcaaagagtcctgcaaaaagaaatgtaaaatcatgaacaaacaagcaaaatgttcaagcaaggctactattcagtattgtcacacagaaacaagaattatatacgtgttaagtgcagcagataaggttttgatccaaaattaatgattgtgcgtgcatggaattcaacatcgagatgcgagatatccaatcaatgtagcaactaaagtggattgcctccgcacatactaaaccttaagatcaattgccaacaagaggttgacagctttcaggttactagaagaaggaacttggcgaaggaaggataagaagatcatagacttcacatagcatattaaacttatattgaataatattaaaccaagcttaactgactggcagcaaaagagtttatactgtctagatacaatgataccatacgtgtctaaatgagagtgccttgaatacctgaaactttcctccatattgctgtgcttgatgaacccggacaagtccttgcattttaacaatagcaagcaagcattgtaatgattctgcagcctgcctcctaacaagatgcccacgtatcacagcttgcagtttcacaaggtccttatcatttggtagttcttgctcttcctatagtcatgtaaatgacaataatgtaataacactaacagaaaaataattaataaatataaatagtgggaaatactgcaacatacagtgtgcactctgatgccagactgaatgacagcagcagcagtctccgcacaatcttcctgatggtcttcactgcttccatcaaagagagagacggtttcctcctgcttcacctcagttgatgaaacaaaaatactttcatccgtcttatcagtgtgttcctcaacatcattatcatttggctttactattggagtttcagttaccctttcagttggttcttggattggcacttcagttactctttcagctggctgctcaattgacctttcagttatctggtcagctgacttttcaattggttcatcagctggcttttcaattgattcatcacctggctgatcaattggcttctctatcagtttttcatcaggcatctcttcattcaaaggcccctcatctggtttatcttgctgcaaaattttctcgtccggtttctcttgctgcagaattttctcagctggttcgtcttgctgcagaattttctcatctgatttctcttgctgcagaattttctcatctggtttctcttgctgtagaggtttttctgaggcataggagtaagttgaagaatagatgttgcttggagcaatttcagcttttgctttgctcgaactaagagtttcaggttcagatatatcagaattcttcaaaacacgatgccttgtagacctcctacgaaagctccacctacttttatctgatatggccttgttctgtaaaagccaacatttaacagccattagcatgattcatctacttgatataaggaagagaagacagatattctgtggtagctttttcacccgagacgaactagaagagatgttacaagcaaaatgcaggtaatgagggctagtttcgtgtatctgaaatgtaggcaaccaacatacttctcatttaatgaagcaaaatgtcgttgaccaggaagggaaacaacacaaaaagaaaggaagtggcagataaactctattagttttgaaattaatgtaccagttcctaataaatctccccaaagttttcctcgcaaaaaaagacccaaagtttgttaatgccttactggcgtgatatatccatcaataatcaatttatttccaaaaataccagttcagtaaataaactataaaaggaggtaagctaacatgattcaggtaataccttggtgaaattatgcactacttaatcaggagtatttttaatttgccaacttctaataattgcaggtggaggcatagaatcctagcaaaaatacatttggtttgctgtcagctatcaccactgatccagcaagaaaaaatttgtccttttgcaattatatcaatgaaagagagctaactactctctcttttccctgaacatcaaaaagagctaactactctcagtcactcactatagttggtacagatcctctaggctgtcccgtgaaaattccagatcccatttcaccaacactatggtgcggctgtctcctacgattagaggatttttctcgattcaacatagagattttatacgatgagcgtccagccaattagtgaaaaatgagctgctccagagtccagtgaactcctccccacactgagattcttggtagggaaaaacagtaatcaacagcgcaacattacaaccaaagtgtcaaatcatgggggacaaggctagcaacactcagctccgaggaagagaatgacagatgccaatcatgcaacaagacgagagacaccatacacagtgagtagcactttgagcagcagataaacaccagatcccttcctgacatcttgcatggactcagggcggcaagagtagcagccataatattccagctgctgcagctagagccatgcagcaacagaagagaaggggtaaaaaaaaggaaggaaattgaaatcaaaattgagcctttgaatgaactcataggacgtgcgggaacagcacgggatcaccagccaaaaaaaaaaaaaagctctcattttgctggctgcgtcttgctcgccgccacgaatcaaccccagatctaactaaaacaacacgcgcccgcacctcgaccccacgcatcccactgagatctgctgaaaacaaacgcaccagctcgagagaacccccccaaaagaacaaaaaaaaacggcttcggcgagcaaggccggcgcggcggcgcattcaagcggaggtgcggcgcgcgagtacctcgtcgacgtggtcatccgcgtcgccgtcggagccggcggacgggtcggatccgccgccggcgcaggcgaggatcttgaggcagccgttcttgggcttcgtcatcggggtcgctttcgccgccgccgctgccgccgccgccgccgcgtcggcctcagtcagtgcagcgcgtgcgtgcgtgcgtctggagcggaacaggatagggagctgcgttcctctgacttgtttcttctctggctttgcgttggttttgctttgcgtttagctgcggctctgcttgtttgcttgcagtttttatattccggaggattcgggccctccgctatctctaccttgccgctgttcctttctcctccctttttttttccccttctccaatgcagctttatatgctttgtttatttcttttccttttattaattaaggttaattaattaatacgtaattgaggttttaaaaaagttttgcgagtgattttatatttgtttcttttacctttgcatttcatccgggagaagatacacacggaagacggtatacgcgcaagacggcgagacacatagttttcgtgattgtacatacgcaagagtactagacacatgatatacgtgggtataggatttataagcctctagtatattaagtcagtaaatgggttatcatatgagtgcttagatgttctatagcccaaccatattggatctttaaggccgtgttctagctttcgaaggggtcagaaacatcttccccgtgcacataaaacggagtgatatattaactcatgattaaataagtattagctataaaaaaacttaaaaatagattaatatgatttttttaagtaactttcctatagaattttttttataaaacgcgtaccgtttaatagtttgtaaagcgtgcgcgtggaaaataaagaagataagttgggaagaaaagtactcgtactaaataggccactcaggttttacattttctttttttcccatcgagaaggatgtgtatgggggttgggatcatttcctccctaagggcaagtataatgggaggttctaagtcggctaaatgctcaagtggaggagagatatgagaagcaggctgtaaacttacatctggcttggacacaagaaccaaaaaattttgtgagagaggcaagtgggccatatatattaattataaatagctaactattgtatgtgtagactaagagaaggctgtaaagaaccttatatgcaacaattcggctatattattagccttgctctaattgatctgcaccttgatttgagggttggcaagagaggagaagggaatcggtgagaaggtaattcatagatttaaaagatagcgagataaattcgacttgtttcttaaaaataacgctagcacgtgtgacacaccacatgacaatctaatttaattgtgacaaaattagtccctctaattccgtgggacagtgtctcgtcgctgcatagctcgatctattggaatataccgcaatatatgtggggagttagcatctctcattcgatcgttgtcttgtaccacatcactcgtaccgtccttggaccgaccattaacaagcctaggcctaggggtgcaaacaaatgttgttcttcttcatggcgctggtaccgtcccgtccggccacgatccggtcagttgtgattgcaagtccacggcgcctttaagttcgcaataacaaggccattaatgcaagcaacaatctaactccgacgagcctagccatggcaagagcgtactttggtggggcttccgtttctccggccgcggccagcctattgttaccaagtacagtacacaggtcagcacttgttcttcccatagtcgtttttactcctaaattctcagtactgatgctactattaattaattgtaaagccgatcctgaccctgtcactgttggtaaagagcgagaggccagccagctgcatgcatgcggcgaaggcgatacccctgcaattaagcggctggtaagtacagcgaccttcgtaaccaacaaacgatcgagatgacacggtaccggcactaaatcgcggcaaaaaacggtacgggcgtcgacgtgacggcccggcggaatgctcgcgcgcgcgcggccgcgcggggcgggggcgagcacgagaaagtgcgtggccgcatgcggccgcggttgctgcttgcattgggcggcgttgggttgttggtggtggcggtgtggcggtggtggcgcggtgatcgcgcgagctttgctcgctggccgcgcgccgcccaagcgcgggatggggcccgtggttcggttggttggttggcgtttcacgtgagacacagtgatcgcgttcgagaaaaacgggagagcggagcggagaattcatcgcctccacggcctttttcactgtgttaactctcacgagctgcaccggccagaccagtcactgacactactgagtttctggcacggtcgtttcggtccacacgcggtcaagcgctcgacagctagaccgtcaaatggggttagtaatttatggtggttaagtggtcaccacgcgagcggttttgcacgcaacaacggtgtggcaattaagctcgttacgagtgtttattaacggtggtgagtgagtgcatgtgaaaacaaagtggggccacgtgcgcaacgaggggtgtccgagccactacgagcagctgcgagtggggccaccccgagaccaccgggcacgtgccagcctttcgcacatggacacgtagcgcgctgctcgccacgttacagccacgtgcgatgccaccgtaaacgttatctcctacagctcctgcctttgttctactctctccccctctctctctctctcaggaccagaaagaaacaggcagaaagaattcaaaggaagcatcatctaatcacctagttaacaacggtgtcgtggcacagtaattaacggcctaagcaagcgtcagatgcataaaaccataataagagatactactatatccaaacaacaaggtgctttttggcagcgtgcaatgatgcttacactaaaggcatcctacgcgaaaagaacgaccggtagtgtggattagattagggcagagcatgagcatatatggagggatggaccaggatccaaaagcagccatgattcttcatgtagtggtggtgctaccttttgttttcattcttaatatcaattgttgtttccttcctactaccttgatcttaggttcttagcaggccaacatttgttctgaccatgagttgatgatcagtggtagagtcaccacctagctagatagtactatattctagcataatgccaatagcattgaggaagaattaatgctgaatttgatatgtgccatgaactatatgtagcagaataatttggtaggagtaagtagaggtgaaaaatacagttccagtgactgtgatcatagagaccaaatgtctagagctgtgatagtttctgaaattgtgatatgggatcagctaatgtgaggattaaactaagaaagaacgaaaggtcattgctctcttatttcctccccacttgttgaacttaacacaaagatgtgagaaactaaagcaagaaagcagcaagcacatcttatcccatggtccctggatagcccaaaagtcgtgcatgcccaacacaaagggggcacacacactacctttcttttttctctgctcactcactgaaacatatatatgggttgcatgtttcagaagtagacaagagtgattggaggcacacaaattggcctgcattgcaccagctcacatgtattaggtcagggtttgttgtgacagttcgtttattcttgttaatttgggaggtgattaattaggggccacatgaaaggtcactgtcagagagttgggaggcagtgacaggctactccatgttgcttgtggaggaaaaagagcaagtttgagggcacaggccatctgagaggactggagactactgccatctatctatctgaagatgaagacgagatccaacggggttctctgctttttattattgtctccaccagtttggacagtacatacacagattcagtatcaatcataaccttctttcatttctctctttattataactccggctaatgttttgtactatatatgaagctttcatatatatgtaataataagaaattaaataaaaacaatgaagatcgaattaataggtaaaataataaatgcggttatgacaaagaacaggtacaccatttccgtattgacatgatctactgtggttaaggttatgtgttaatgatgctcactcttgaaaggctgtattattattggttttggggggcctaaacggctaaaccccatcctaatcaaacgagctgtacgtggtacgtgcactaatctggatcctttttggtaatgatggattgatgggatagcgatgctatccaatatgtattcctatgcagcggcgttcgcgaaaaaaaaaatattcctatgcagtggaactgatgtggttgccatatcatttcttagaagactttacagatgcacaactgggattttttctactattctagccttctcgcaattggaacagaggaaattgggtccagttaattggctaattgcgttgttataaaataaaatgaagtgattggaataaattgtcagcaatgttgaaatcttaacggataaaggataaaatagttaaggaaaggtcaggcttcgatatcaaatgagatttgcctgtttatcaggaaattaagccaagctgtacctgtctgaagtctagacaagcttttggtggtatgttctatctaccggtagaggaaaattcaaagaaatttaattaatgtttgcccatatgctggctgtaccaggaatattcttatgtacataatagaataattaattagtccatggatttagaaaatttctagatagaagagaaaattgttcacagaatttttctgcttatacaagtcatatacatttgttggaattaaattctgtgcagtgatggatgacagcactatatatttaggtttcaggagatacacatcaatgggacagtttcatgcatgcaattctaagctacatactcaaccaacactagtctttgatgcattatatggcagattagtgaatcaatcgcaggctacgccgaggatgaagcaacaatgacaagataacccagctgatattgaaaccttgaagagagggggaaactgaaaatgacaaggagagttagctgatgagtagctctataacccaactttgtcctcataaactagctagcactcaggacaaggaagcttcacctaactggttgtggtggtattgaggcgatttccattcacgtttcttcttcgtcgtcgccttcttcttctttctgttgtagtagataggagagcgccatcgtctatctttccatgtttcctgtctgtgctacctactcctttgacaacgcctaaacacgctgcactgcagtcagatacaatctagaacgctgttagcaacggatgaatgtacatttcgttgccgtgacatgaccaatttgatgagtcctgtccaccagagactagaagatatatcaaattaaccgtgtgtatatctgcctcagttggtgtagagatcggaagttaattagctatgttttgtttttgagaaattaaatgaaatgtaagagtacgtgatcaagaaaattattcacattttgatttagttagaagaaattatcgaaaataatcagtgcttaaaagtatctttcacttgttaccatgcatagatgaaaatttccagtttccaataaccaccaaaacatcagcgcaggtgaagtttccttttgtctgtttcgaagacagagtatgaagaagaatttttacggccacctactacagtagatatatactatcgtcagtaaccaacaagtgacaagtattcagtaggcagcagcagcaccagtagataatgctccaaaattccaatcagcaccgaagaatctccctgtgaaatccggccaaattacgcaggtgacgtcgtcgtggacagcttcgttgcagccgcgcgcgactgatggaagctgtgaacctgcacactgtagctgctgctgctgctggtggatgctcgtggtcaatcatgtactcgaccggatcggacgcccacatgctgctgccaatggatcacggagaggaggaggacaacgccgcatgatgcatgttacccctactatactcgtatagattattgtctctccagccgctatactcgaattataatcaatctagcaccgttatactattcattagcgcgagctgtttgatgattttacagttaactgcagatcagcagatcggatgtcttgagagccggaagtgaagtcagcgtgctgccacctgcaaatgatctgtacaagtgtatacttagagccagtttaatagtatagcctactattaactttaattcatttatagccgatctaatagccaattcatacaatagttgcttactatactattaatatattgtcatacctattatacacacattgcgtcttagagtccgtgttgtaggtagctacaaatttatagcccgctgcttttctctctcatcttttatctcatgaaaatatatttatagctggctaatagtgcaactgctcttatctcagtagctcagatcagtatcacacagctcattgcctcactggtagctcgtggagtgagtgccgcatttttcttgcgagtattactaccacttcattcacatgcccgtagatccgtatatagccacggtacagttcaaatttatcctatccagtagtaagtaactagtaactacaaataaatatacctgtcactcactatagtagagataggattagatctagtcgaatctctcccgttctgaggttcacctcattctttatgtggcttaaaagagtggtcggttttcgactcttcttgttttagcatgacaaacatggctgtcctcgtcggcgttcttcttgatgtctcctttctgtcctttggatggtgggttcaccttcaaacccttcagttgtaagttgaaaggacttgattgctttttctatatctttttatgtctttcttcgcatatgctatgctcgaagtgtaatttgcccaaccattgcttttatgtaaaacaagctgttctctcagctttgcctccctggtacacaactcatgtgttttgtcctgaatcaataaaacacatgagtgcaaaaaaatactcacctgtcaacatacagcatctatatgcaaactctgacaaacattatcttagcaaagaatttcaaaatgtttaagaatacgacatgtaatcgttgcatgttaaacagaaccatacaattttcgttcactaaaatataatatagtttttagttatttgctatattattttagttaatgttgacaagtactacattggaagtgagggagtataataaatacgaaatgaatgacatcagagagtactgtactgtacagggagtttaaattagggcctgtatttgtagcctgattatagacaataaagttggcgacgttccacgtccataggcccatttaggcccatattactcctgctgggaccatcacggtccatgggctccggctccctctcctcgccgccgctctagctccagagcaggagccgctccccctggctggctgcctgccacgtactccagctccggacaaaatcgaatccggagccgcgagctcgcttctgccattctgcttccccttctccaaccaccctgctctctcctctcccccttcacagttcacacctgcgaccacgaggcggtggcggaggagacgaggcgcgccggggagatccgaggcactcgttgaccctgcgctccggcggccgattcgctgccggggacgccgtcttctccgtcaactccggcgaacggctgccgcgctccgatctgcacgtcgccgacgtcggtgagtccacttcctcgtcggctaatcctcctccaaaccccctctaccgaccccgtgttccgaccggtcccgcccctctccggccaccgcacgccccgtcgtcgtcgccggtgaccatgcgcggcgcctctgggtcacgtgaggcccgcgtgagggagcggagcgatcccgtgcggggcgtgatggtacagcatctggtaggaatattccgaaaaaaaaaaggaaaaaaatcctcatcctcatcctgtggcttggtagccatattatcgcttaaactagactagacacgggtccgactccgagggcaatatcccccaccacccatctcatccagagacgagctcctcgaatttgagggagtccggggagaaacctacggggtgatcttctggtccgcatcgggtcccctcccattgcatgatgccttctgttccttttcgttatctgcctggtgattgttcggtgggtcatcctgtccatgtttgtttaattcgatgctggtacgagtacgatgctagtggagatggaaccgcgcgctcgcgtgtaatgtgcaaacacggtgaaattggtctgcacattttgagagcgtagtgtgtgttgatcgggttttttatgtgcgagttttagtgggataggattctaggagaaaggaatgaagaagtgactttatatggcatctgccattgttcgctgataacattgatgccacctgttagttcctgatgccaccttgtccacccgcttgctgaagtctaaaattcttgtgtttatacactcttgctgatcttggcctcttggccccttagcccccaactaactactactgatgcaaccaagtttgtttcctgagcctccatgaccaacctgataatgccagtaatttaacagaaaatacgttgaagtgttgttcatagtttctctaaggacagctagtgttgggtataattttttgttatagttagtttttcctttatttcttgccatgttgagtttctatgtattaatgtctaatctttggcattctatgcagctgagcttttgatctcgccttctcgagacacatctgatatcgctgttctttttatgagttcacaagacactcaacatgaagtttttagaatacacccccttcgacaggtaatagttctatcctttgtttcttcttattgatgtactcttggtagcatgcaaattttacacaaacttattaactctactgtttgattcgttttgtttcagtataaatctgttccttgataatcttgaccttggtgattgtacgataagaggaaaccttgaagccttctcatgtaggaatattccctgccaagtctcttattgagtatatgactttaatgacaatgaagaccaaccttctaatattgatttgtaggcaagcacactggtaatgaccgtcgactttcaataagtctagaacatgaggtaaatatttaacatttttccctccatgcattatcaccattgagaccgctttaggataaattaccatgtcttatttagaaaattgtatgtctgttcatgcaaatcatatgaaaaccgaagcaaagtgaatactatcaaatatgtttgtgattataccgatttcttaaaaaagattgtcgtgtcctcagattcttgattgcctcagtaagtcttctgatagtgatcattcatcaccagtggagcatttgtcatgtcggtcaaggtaatcacgtttagattacttatgttgcggaatttctattatacaatactaactgccttttgtgtttgctgctcattccagtcggaaaacattgatctatctagttctcacccttagccacatgtatccagattatgatttcaggtaaatttctttcattttacaggaaggtagtttttgtcttcttaactagtgtgttctaaaaccatctgggaggaaggatattgggtaatgtcatagtcagcctattttggcgatttggcaacccgcttttgtccttcctgccagcctaagggggtgttgtcaaatggtatgacagacggattgatatccgttgctctttgagctgagagttcaattctctccattacccttgccctttgtgtatttgactgagctgtaactttcttaaaggtcttcttgctgttatgtgacacatgcatgacaggatgacctttagataacatccttttgtcaacattttttcacttaccagtgctgttcgggcacacctgttcttcaaagaagaggagtgggaaagctttaaggagatgacagacacctacttatctgaggcttcaaaggtaacaacttgaactctcttttttatgcatctactcttaatccaaagataggtgtgtttgtaaacatgcatgctatcagaatttagaaataggtacggtatgactgcaaaagcaaaaatgtatatattaacacatagctaattttttccatcatgattgtcctacttatttattttcattttcactggtgtgatttgcttaacctaaaattggactatctttcagcaatgggcagcaacaaatgagggcacttctcttctagacagtatgactaatgtcattgatgaggtttgcacttacatgatgcttaattcagagaacttggatattcatatattttatactgtcaaacattactttgtaggttatcaaaatcggagagtctgacatctacagctataatccagaccaagatggagatccatttcttgaaaagggggtcatgtaagttaagctgtgataaccatgcttttaacttagcaatcaaatgaatgttacatgaatatggtatactgttttcttttagatggtcgatcaactttttcttctacaatcggaagctaaagcgagttgtgagctttcgttgcagttgtataaggtagacacttgctatgcagttctgcattcttttgcaggaaacacgatgcgcgatgttttgaatcactcacaagtttctgttatattacagcaaaatatcaggagatgacttccttaccagtgcaccatccgatggtgaagaggaagatgcactgatagacatggacatataattgacacctttctggcaggaaaatgaccaaccagtgtggcatccagttgtgtagtaccagtatatatcatgtatggcagtttggcagttgccagtaggaactacaaccagaattttcttagcagacttcacctgtaccgaggcctgcataatattatgatttgacagcaggaaattctgcgtttctagcctgagacttgaattggcattttacttggtgacctaagctagtgtttgttgagatcgaaattctcgttctatgcagttgaataatgtatatttaacaatgttatgttatgcttgtaacttgatttgcaaatttgctatgctgttgtttgaacgaggcagtgccgactcctgaatgagttaagcattacgcgagtttgatatggagaatttgtctgccgttggctatcaaggttcgccgcactctgtttgcgacgattctgtaagctcattacacgcatgcacaaaattgatgccaacggcaaccagcaataattttcatcgagttcacaagggaattttacggccgagctccacgcccccaacttcctaagcttgtcagacaagaatttacacaacttcctaagcaaaagcttctaatggctatagaagctgcggtgtggataaaatcttttgagccctgggctctacgagagctaacttatctcatgctcttggaggctaactaaacagagcttttcaggttcaaatcagacaagtcttcaataccagaggtaattccactcaaaaaacaggctcaacaatgtaaggcgggcaagagtaagaaaccattgctaagaaaacaaatgcccttgaatggctgggttggatcgcatcaggagttagacaatcacacgatctgagttcaacaatgccctacttggtttaaactcacttccgagctcttcctcgcttccccctcttcccgcctcgccccaagctcccagttttctgagcaggagactcggttttcttcgggcggcctctgccccttgcagatggctttggctcaggagttgcctttttagctcccctgcctctccctctgtttgaaggtttgcggccacgtctacccttaccaccttttatttcaccattttcatcgtcgtcgctatcatcttcctcatcatcatcctcttctgattcggaaacatccttggttttcttgcgcttgttagatcgtgcattggtgctagcagatgccttcttggcaacctggacctccactctgtcttctactgcagtgaagagttccaatcatgcatgagtcgatgcaaaataataaaatggtaaatgatatgagaagcatttcagcagcctgcatgattacaataccagtccattcaaatttcagacaatacgctcacagcaaaatgtaaagtaacagcaggatatagaaatggcatgtaaagccaaaagttgctcacatacttgactacttgagttacaccaacaatcacactggcactattaagcgattttccctccacaagcggagcagcctccccgcacaagggcataaccacattagctcatagaactaagcacataaaaactattgactgtaaacaaaaggaaccatggtggtaggggactatccaattatatacaattggagacaataatttattctgcacatatcaaaccaaactaaggatgatattcatacaacgttaaatttcttgaagcttgcatacataatttaacaatgtgattgtaaaacaaaataaagaggacatgcaaaatacaaaccttcagtggaggtatcaccgtcataaatatccagctgagaaaaaaaaacatttattataagataaccaataataatccaaaaacctagggtaacgagagaatgcaagaaattagcatacatctgtacagtttgtactgcgactactaaaagagatgctagatgataaaacaaaattattagtctaagcaatataagagacgaaataagataagtgaataaggtagctcattaaagaacaccttggtaacagataaactatcttgatcaaagctgtgcttttaaaagactgtaaggacaaatgtagccatttttaacattagtgtagctccatttcaagggtagatagcctaatgcaagtctttaaacctaaaagttatagcataacatccgttggtaaatctaatgtgccttattcgagatagagactatgataccgcataacacctaacatagctgctaactcgagcaactcattttctttgttgaacatctcaagtaaatgttgcaacatattgtaatctcttggtagcatcaagcagatggcctgtgaattggagcacattcagttacctgattaagccggtcactagcaattgatctgtctacaacaatcgcagacaacccatatccacaaccaacactgcagaatgtgtcagcaatttagttgattatacaggagctgcaactatataaacattttgatttagtgtagttaccttataacatgcattccttcaaggatgtcaacctttttaggattagcagatgacctgcattacaagttcaatgactgtaagaggaattctatggttttaacaattgctagcctagtattaaaatgatattaacagtattcaataggcgtacttttgcccattagggccatagccaagctctccattttgggctgttccccagcttatgcaagaatcatctgcaccaacaacgtggtgcatgttaccagaagccatgcaacgaatgttccaaccactgaacaataaaatcaccagttaaacagataactttggataacatcatttgaacaggcagctaatcacgatttatcaacagaaagaatagccaaggacggaactattcatcactatatggtatctacagttaagtttgtccgcaagtaaccttaaatccaataatggctttggatacatccagtcgtcgcctgtattctttaactttccccacatgtacaactgtcctccacctaataaacaaagcaaatacccaaaaattaataataatgtggtgttcattcttatctttttatgcaacactatcaacatcattttggttagcagaatccaagtctccaaggttcaagtatgatattcttaacaggacataaataatactacacaacatgaatctccatctaactagcaggaaacacatagagtgggaaaaaaataaacctgatgcatgctcatatcggcctatcagaaggccagaaaaaaatgagcaggcttacgctataagatgcttagtgtacatgctaaagcatttaaaaacactcaactggctcctcgactacataggatcccctttgcctatagcacctcgctactcaatcatcaaagcaaagaggttgtaacagcaaattagagcaaagccaatagtatcaacatttcagcagacacaaaaccctgatgacaattgttcacataataacacatgggaggatcaataaaacggcaataagttgataataacttgacagatttgttggcagagataatgcacaggaattccataagacaataaaataatgtcttcccgattttgaaaaagttagcatgcgacatgctgaatttcatgtctcatttattagtccatgccatttaactgaatacatgaataacagtacaatcatcgaatttcagaaatacaaccaaaatgctctataatattataattacaaacaaaacaaaatataaacttacatcacaaatagcttattttccatgtatgatactcagctaattgcctaatttacaggcccaaagtggtttttattaagtatttctttatgattgagccaaataataacagaactactctatcgatgtccaaatatcagaaaaggaaacataccggcagtgcatgcagaacttgccgcaccagctgatataatagcattgggtggcagaacattatgcttctggaagacttcaacaaggcgaggctgccactcatccttttgttctctatggcccaacctatgcaaataacaagtggatggggatcagaccaacgatgctatcctgattatagtgggatattgggttatatgacatcagtgtctcaccttccatatccaccaaagccccatctgccagggccaaaagaaaagagaaacgatattagaaaccataaacagggaactgaagaaaacatgtattattagatattgcagataggaaacggcttgatagctgatacaggacagatggatactatcatactagcaagtcaaaataatttaaagttggtaattgcataaaaaattgatgaataaataacatacgtgtaaacatagccacttgaatcaactgcaactgcagcacacaagtaaatgaacagtgtgagattggtgttaatcctgaaaggttagaataaccaaaatatatatctgtaaatataacagaaacctgtatgatttgttccacatgcagctttgacgatagttttcccagataatgaagctattgccctgggacggggctggggatcatatgccagctttacagatgagtctttaatattgtactgcaacagcacaaatcaattatcagtgcattgatatgaaataaatgaacaggttatctgtgttaatagagtagcaaacaacctcattgtcggttccatgaccaagctgaccgtactggggaagacctgctgtactgaatagcacagaagaataaaatactgcctcaaaaaagttcacgaacaacactcactaacaagagcacaagcagatataattaaaagggttgaaaatatattagtgtcgtattataagcaagacatacagtatagtagagccctccactgatgacagccagacagtaaaatcagcaccacaaacagcattagttgcttcagtaacaagacagggcattggtgatgtctcaatttctgcagcaatttttgaaccaaaggaacaagaatcaaataatgtaataaataaaggggaaataagctgcccaaaacaagtaaaataagtttatcagttatcacacattgtgtcgcagagctaggaagaatttacgaaatgtccaacatttgttagcatatattataagaatatgaaaaactccccgtgaaacactgcattgcagcatcaatgtctaaacagacagatcacacatggaagcattaccaaaaaagaatcaaccatccgcgaagcagatatatccagacttttccaaagacagaatgatttgtctgcaggacatgtatttggtgtactactgatgtcagtgagttaaaaatgaaccaaaggtacataccattccttagggagcctgtacccaactgtccgtgtttattgtgaccaaatgagaatgacttcccgtcatcggttacaaccactgtgtgatttcttccaacacttgctttaatgactttgtacctgaaaacatttagcacccataaataattcatctcaaccagtgcacctggtcaattcatgaatttagcataccaagagctattgttaacaattgaagtacaaacaaatagttagttcctactttgatagttcagaaacaacagtcggcaggttacgctgaagagtatccccatgccccaactgccccttctgctagaaagtaacagtgttaaaaaatatagtgaagaaaggtggcgtcaagtaaatttcgtacctcatttcgaccccatgtatagcaacgtccttcagcatccaaggcaacacaatggcaagccgctggataaatgatgttatagagttattacaggagtactgaggatcaccagaagatcgaatttgcttgtggattacaggaaataaattaggaaacttaatcaaccaagcctaaatgcttatgacagaatgccctaaagttgaactcttaccactcctagagttaaactccgtccgatcacccaaaaccaaaattaggaaaacgacaacctcgtattaagtccgtcttaaaagcacacatactcgctggatggttgcatcagcagtctatctagaccattaagtccactgcattgtatgtttctcacacgtgtctgaatcgctaaaatccaatcaaccagcacccccgcgttagaactttccatatgtactatctgtctcgatgctatcaatctaataggtcatgacagcattttgcaacattaagcagtaagcacacgtgtctaaatcgctaaaatccaatcaaccagcgccttcgcgttagaattttccatatgtgttatctgtcgcaatacggtcaatttaataggtcaggaaaacattttccagcattaacttgatagtactaaacagagtggcgccgtttcggcattagctcatccagccactggaagagcccgcgaactttaaacctgaccaattccacctgacctggtttcacgcatccaacgaataaatataaactaaaccagcggcagttctcatccctccgtgacttgactctaggagaccatctgaaactgacagaaggacgaggggactcactgcacccggaggcaacgaatcgtatgtcgacgcccatgagcgaccgcatccgcgtcggcgacactaggttaccctgcgccccgcccaccaccttccgccccatggtctcgaagttggtcgcgccgcagtacagcagctctcccccggagcccgcggcatccttcgcgccgtccgccttctcctctccctcggcggcggcggggaccttctcgggctcgccgctggccgacattatcgccggtagtaacgccggcggcggtggaggattccgatccgaaaccctagatttgttcgggggtagcggagaggagaagcaacgaatgggggagatttgaaattagagattgcagatagaaactctttttatgtgcgggttagttatttatgagccagtgcggattcatagtacgcagtgggttcggctagtgggtcgactaatcaaagcggaccaggagatatttcctatcacgtcaaatgtggcactgaccagtgggaccgggaaaagtggggcccatttgtcagtgatgatcagttcgtggtccaagtggcactgggtttagttaaggccgtggttttaacttcagccttttcccgggcttcgttcctatggacaggccaagaggcccaagacgacgtcgatgggtcgtactttgcgaggtgatgagttactgacttgtggtccatcgtcatcgtagggtccacttgtcggtagatttgagcatggagtaataaaactgtaagtacgagcaaatgttgtggtcataactaatttttgctggctggccaggcgagggcaaggatgtcagaagtcatggattgagggcaactccagtgtatgttcgattactatatgtgttagttcgtgaatggcgaatgcaactttggtttggtggctgcagtgtgcacatctatttatgtgacccgtttacaataagaaaagttgagagaaattgtaaattatttgatttggcttggatgtgttcaaccccgtcagcaacaattaaggccctatttagatcccctagtaaaattatacaccctatcacatcgaatgttttgacatatgcatagaatattaaatatatatgaaaaaataactaattacacagattgtgtgtaaattacgagacgagtcttttaaacctaatagcgctatgatttaataatgtggtgctacggtaaacatttgctagtgatggattaattaggcttaataaattcgtctcgcgatttacaaaagcggattctgtaatttgttttgttattagactacgttaaatactttaaacgtgtgtccgtatatctgatgggacacgtcaaaactatacacccttggatctaaacacggcctaatactttaattgtctaacatcgactcaagtttggaggtcgattctgctatctcacacaacgatcgactctctcagcgtgatgtgttcgatacttttggctcacgattcgatttctccacacactggagctgctctaagaggatagatttccttgtgaggctaggtcatgaagtaatatggcgagtggtttcgggccttcaccttgctaagcctcaaccttagctaagagagtggcttcattgagcatagatgtctagcggaggatataggagtatggaaagggaaggtggatgtggagcgggatatgaaattataggaggaaagtgataaagaggatgtcatttgaagaacaaatattgagctgagcaccacgacgagccatgtgtgcgaagaagaaagctagccacatgatgatggccttgacaactctagcaataaggagaccaaatgagtatagctatatcgcagtggctcatgaaggaatcaaaggtcagtagacacgggctgcacatcatctgccctcgtcggtcggtcgtgtcatatactttacgaacaacctaacaatcgactcattgggtggataacaaaaactagcgctgtcagctagaggggtgcgaggaatgatgatgactggagaggagagggggcaaggacaactgaacagcagatgaatggtagtaactagagtgagggatttggaggcttcgacgtcaagatgataaaaaaggcggagaagagattggagataggatgacatctggggctatatgaaataccatctctcttaaaaccgcaccacgagaacgcctgcattgtaaatttatgaagcgtataaatttattgtatgtgactattatatgtatgagtttattttgtgagatattatttaacaaaagtaatattttagtttcgcctcgcgaagggaaaacaaaaataatttttatctatgacaaccctttggtatcaataaaaatataaatttatgaagtatattgatggagtgtataaatttattgtatacgactatcatatttatgagtttattttgtgagatattatttaacaaaaataatttttatctcgcatagcaagatttatcttataaaaatttccgtacaactataacaaaatatgcagtttttaatggtaaaaaaaaactacgttttgttttatctaaaataaattttgccatagataaaaattattttgttttcccttcgcaaggcgtaaaatattacttttgttaaaaatatctcacaaaataaactcataaatatgacagtcacacacaataaatttatacactccatcaatatacttcataaatttatattttcttgataccaaagggtaaaatggactttatgatatgaatttaacggtcaactgacaaaaggggtatataagagatccaaattgaaatttaggggtatggaagtgaatgcgcaaatctcagggatataaaaaggattggatgaactttcaggggtacacagggaattttctctaaatgtttctagtgatagcgttttcaaagtaaatttggccatatattgctttaggaaacaagtgtgacaaggaagcataaatatgtgctaataggttccttgtggtggaatatgttcactcgagtttaacctaacatggatgctcccatatgatgttatttcagtggtaggcgatatatatgtcaataacggaacgttgtggtgacttcattaattttatgatacaccggtccaatttttttagatacacatgaggatcgagtgtgtgtatgtatttatagaggtgagctcatgttgttagaatccgcatttatacgtactccatccgtccaaaaaaaaagacaaaccctaggttttcgtgtccagcgttcgattgtccgtcttatataaattttttttataattagtattttcattgttgttagatgataaaacatgattaatactttatgcgtgacttgtctttttaattttttaataattttttttaaataagacggacggtcaaacgttggacacggaaactcagggtttatctttttttaaggacggaggaagtatctcttaaagagattcaattccaaaaaaattatccggtataaaagcagagataaacggaagaatatacccacctatcatttttattatcttttctactaggagaatcatttttattctctcgttgaaatgcggggatggatatagcttgcagccacgggcaaccacaaaaaatgtcaaatttcaacgaaagcccgaccctcccactgaccctgttaccgcacgtttgagtaacccgaccgcaacgaaacacacgccccaattttcttggttcgtgatgactctcccataggttgatccgatccgtaggttctcgatccaacggtcaccgtgacgcgcagctccctgcagccgacctggccacccacaccttcgtggtcgtggcttaccagcaccacccacctaccgctcgtaaagcaaccgccccccacctcaccaaacaccgcatccggtgcacgagacggcgaccggtcgaccacccccgcctcaccgcgagtcgtgagactggagccgcactttttttctttccggcttgtgggccccacaaatcctcaaacccccatcgtaacgcgtgccactggagagcggggcccaccgccccactttatataagccttttggaattcggcccggtccaaaaattccgggacgcgctgaggcctgtgaaaggaaaggaaaggaaaggagaggagtggaggcgaggcggcggcggcggcgagatccacacatgacacatctcgaggcgcgcggtgggcatcaattctcctccactccaccgcgtttttttattatttatctatttttgcgcggccgcaagctcgcgcaccttgtgctatctctcgccgccgcctaataatagctcgagtgaccaggcaccaccaccgccatgggagcgctcgaggaggcccacctcgccgccgccatctccgcgtgcgagtgcgagtgctacgaggaggaggaggaggatgacctcgtcgagggggacggcgaggcggcggccgccgacgccatggagccggcggtgcgcgcgctgctgctggggctcggcgaggacgcgcgccgggaggggctgcggaggacgcccaagcgcgtcgccaaggccttccgcgacggcacccgaggtacggcccagactccctcctccggcctccggagttcgtggatccgtttttgtgtgtgtgtgtgtgctgtttgtggagtccatggcataattttttgatccgtgatttgcgagctgcgggccgcagctgtctctcttgcttgtctagcaccgaacctggtgaagcagaacaaagccgtggggcatttgaactcgtgtggtgttgtttggatctcaggacgatgggtcgggttgtctgggaattattcctgaatgattgaattctatctcggtagcccatcatagaagtgataacttgatgtaaatggttttgcccatcggtcataatcattgctgttatggtggtgttaggctattacagcgctattatgcttgtagtttcagcaattaactcccctctctttaaaaatttagcaactggccaccaaacagactttgatgcaagcatgaatgaccaaagtatgcagcaggattgtgcaaagagaagttggattcggatggttacaacgaggatccgttgtatgtagttactaggagtcttatgattggattgcatacttgcaataagccattccacagtttcttatggttatgaaaattgtttatttcagtctgcaatactgggaattcctgtagtaatcacaatggctgtcctttatttattagtctacttttgccttatgggctgcagcagcaggataatgctgtgccatgtgcttgggtttgtctttttggattatttaaattatgttaatctattattaccttccaaagttcctgctccgtacagactaattgcaacttcaaccggcagctcttctacttagtacttaaaatgtaatctattttcttttagttctcatcctagccacactttttacacaaactcgcctgctccttgattaaattagaaatatgttctttgtttcattatgaaatgtaacgttggatcgtagttatgtactgttccgctgttttgacttttgatacattactactacgatttcaaagagaaaatttggaaataaaagttactttaattatttcatagctgatgccatgccaacttgccaagcattagtatccttttttgtgaccagctggcagttaccatattcttggagagctttctgtatcaatctgtcttacgcaaccattttttaatttaattgtgtctacttgtccataaaacagtgcttctcatttagtttgagtaccaattcatgggatttggggggcattggaattgattacattgttcttatatttgttttatcaaatggttgtactctggaaactagccacaaaaaatgactgttttttcatcattgcttgtttgataaattactgctgtcaatgagagaccgtagtctacataaagcttaggggcaactgagaagtgagaactaaccaccaaattttatttgtttctcggagcattcttttggccacaatcaacacttaacaatgatactcttacaatatttccaagaagggaaccctttattgctggttggtttacagcataaattataccatgaaaagcctgttcttgtacatttattccatactcgtattactttagaacacaatgccatttttacctgtgatggtaaagaggactgctgatgttctgtggtattactggattactggaccattgtcagcgttggagcgttgtttgagtatgctgtttctcttataatctcttttgaaagaaaactgttattttatatttattttagtggcttaactcacaagaacagaacccttacaacagtagcatggtaatagcaactttgaatactcaaactggtagggctagggagcttgtggttcttgtcttctcccaagttgtgcatgcatagatgacaaaataacaagtcaacttttttggctactttgttgcagctgataatggtcttgtagaacttaatcaagtgctggagttatacagtatagccaatcagcgaacatttgctaactcttaccattgctttggagtcgaataaatataatatttttccgtatcatctataggaccattttacactagactgctagtttacctgaacaggacagttttgagcttgatgtgtgcaacttgcagcatcccaatccaagctacatcatgctgggtctaatcttgaaaggtttgtgtgaagtcatggatagtcagcacatgcgttcatgtgcacaatctgtggtcatgttattcttatgcaaggcaaagaatcctttcagccccatcagcaggcagtggtgccaatatatttactttgttgtatcagcgtctcttctttgttgttacaatgtttgggctgctaacaattatttgtttgtaaaaaaaaaactgtaatgcagttgctttatgagctttatttgacatatagttaaaactaatattacaggttacaagcaaaaagtaaaggacattgtgcagggggctctctttcctgaggttggtgttgacaagaggactggttctgctggaggaactggagggcaagttgttgttcgtgatattgatcttttctcatactgtgagtcatgcttacttccattcagcatacaattccatgttggctatgtgccctctggtggaagggttgttgggttaagcaagctttcgagagtagctgatgtcttcgccaagaggttgcagaatcctcaaagactggctagtgaagtttgtggtgcattgcatgctagcatacaacctgctggtgtggctgttgctctgcaatgttggcacatacctttgccagaaaacttgaaatgcaagactttgcaaggttggattagcacttcacattcatctcgctctggagtttttgagggtgagagcagctctttttggaatgacttctcagcccttcttaagcttaggggcatagacatggagagggacagccattctgcctccatagcttggtgccctttaaggtctcatgatgtcccagtctgcaatgggcactgcaagaaggctacaaccaacggtgcaatttcacccaaatcagtaccagctccctctaatatggtttctgctgttagctcaatgctcttatcccttggagaggatcccttcaggaaagaacttgtaggtactcctcagcgttacgtgcaatggctgatgaagttcagagcatgtaacctagatgtgaagctgaatggctttacactcaataatttgagtgtataccagagtccagctggagatgctgctgaccatcgagcaatccattctgagctgcatttgccattttgtgcgcagtgcgagcaccatcttctgccgttctatggagtagtgcatattggctaccttgacggcggagatggtgaagtgattgatcgatctcattttcaggccttggttcatttttatggatgcaagcttcaggttcaagagagaatgacaaggcagatagctgaagcagtttattctgtttcgcattgtggggccatagttgttgtagaagctaaccacatttgcatgatatcaaggggaatagagaaaatcaggagtagcactgcaacgattgcagttctgggtcagtttttgacggacccttctgccaaggcacgctttctgcagaacgtagtagatacaactggtttggcagtatgaatcacttagatcatacaaactagaatatcagctaagaatacatgattcagagaagtaccgcagccactttaatatggttgaaagttggtacccagttcggtgtgttaccggcaaacattgcccattggttcgagaccggggctggtgccacgtctctctggaaggaaaatgtccatttgcttggtgagggaaaattttcgtcacatggaagattatattgaagctgtcactggaagcaccaaaagggtttggttttctctgtgttgtaccatttttcatttgcacggcacttgaaatctatactgcactaattgcagatgtgccgagaaagatatatacacagaagcaatgtttgtcacatcatttttcactgtagcaaattttgatgagatcaatggctccagctcctgtgaaatgaatgtgattgttctcttgagtgttgacccgccaatgcactcgctgtcttcttctctctttttttcctgagggcatcatatgcatatttttggctcgtggggtttgcaccaactggcattttgcccttttggtgcttgtagattgcagatacgcggggctagcgatttactggtattttgacgggctgttgcgacaggttggtggagcacgcgacgtctccctccccgccgggagaacgcgcgccacggctacccgcccgctcaccaccaatcgttcaaagcggccgcgcgaactaagcagcgggaccggatcttacatcactgttcactcatcgcgtgccatgcagacaaacgagacgtggtactatactacctcattcctaaccgatcccagtcgaacagttgttagttcatggtagcatgatgtgatcatcccagaagagtgtgtttttcctcgcgtagttgcggataatgcttctcctcgaacgtctgaagtaaggagaaaagtcggacaggcagcctctgacacacgtacacctattcaagactatatctctatctccaaccatataacatacacttttaacgatatttaaaacgaatttttttcttaaattacttagctgatctacaattcgatcacaccgttatattcgttataattaaatctttacaacaagatatcgcttgattatattccgatacaaaataatcatatgttttaatccattaacattttttttcttacgtgatagggacatgtttcaatatgtgtcttcagcgtgtttcacaaaattcactcacaaaactaactgttactactctctcctctctctctccacctcatgcatgcatgcatgcattttaactagtttcaaaacgatttttctcttaaactaattattcaacctacgatctgatcacaccgttgtattctttgtaattaaatctttaaaacaagatatcgcatgattatattttgatgaaagaaaaacatatgtttcgatccattaacattggttgttttatatgtgatagtgatatgtttcaacgtgtatcttcatcatgtttcataaactttttaaatgtttcagttgctgatatttttgtttcaccatatataacttgatgtttcacttgttagttaactggaacatttgactgaccgatttttttttgcatgctgcatacacaggtggtgtgatgacgtgtaaacagtcgggcgtccgatatttggtggaatatcggacgtccgatgcggagtcatctcccgtagttgcccgttgccaatttttttctacagtaactacaacttctctgatatggacaaaaatccaaactatttaggtgagtttctgtttatggaagaagctgcagctgttaaaaactctcccaaacatatccaaagatatttcctacgctcatctctaggatatttgtaggtattgtagggctagtttagctcccatagtcccattgaagcgtacgtgcacacaaccaaaaatgtttgctggagcagtggagagcacggaatgttagatagcacctacccttcaccgtcaaatcggaactacctaagcttatcgatcgggtgatcagttatgctaaaggcctgcagctagctagagaacacaaacgcatcgatgagtagtagttggaacgtgccactgcccactgcacgactttagttcttcgaccctgtgtgagtagtagcgaacccagcctctctatgtagcgtgctccacccgtacagtacgcccctccctatatacggatgatcacgcagtacacgctctccctatcgtaaaacccgcgaaaaccacaaccgaaacgcaagggtcgatccatccacgcctatcgcgcgcgcgtgcatcgggtcgatcgatcgagatggcgccggtggccacgacgttcctcccgacggcgtcgaacgaggcgacgctgcggccgtcgttcgtgcgcgacgaggacgagcgccccagggtggcgtacaaccagttcagcgacgcggtcccggtgatctcgctccaggggatcgacgaagcggcgcgggcggagatccgtgcccgcgtggccggcgcgtgcgaggagtggggcatcttccaggtggtggaccacggcgtggacgcggggctcgtcgccgacatggcgcgcctcgcccgcgacttcttcgcgctgccgccggaggacaagctccggttcgacatgtccggcggcaagaagggcggattcatcgtctccagccacctccaggtacgtcacgtcacgtcacttcacgtcgttacgttcctagagcactcgaagtcgacgcacgcgcgggaacggcgacatgtcgatcaccatgtctgctctgttgcttcgtcagagcagtgatcaccgaagatattcctatgccaatgttgactaggttgcaattccaatggtttgtcgtattggcctcggctgctatattttcaaaagaaaagaaaacgaatggaatccttacacaatcctgaattctccaaaaggatctggtaaaatattcttgtgttatatttcccttcattagccgacgaacagtttggagagacgaactagtcatgaaggacgaagacaacaggagtatttttttttttagaaaataggagtagattactgtcttcaattcaacaaacaaattgacagatcccatgttgcactctaaacttcaaattaatctcatttatactgtttctgtacagtctttgtgaatggacagacccgtacgaccaatgagaggccaagaaccttaacctttcaaacttccaattgtttaccaccgtttctatagctgcataacttcctattctttgtgcaccaacgtttctgtagctatcatcttcgttgaaacaattaaatatatttcggtaaatctaactcaagagcatctcgatttagtcctaaccagcgacacgacattgaccggaagaatttacttaactatagtaatactagtccaacaagtaagtagagaaatatatttctatcacctatgtttcaaataaaattttctcttagattactcatcgaatttacgatccgattacactgttgtgttcataacaattaaatctttataacaatatctcacatgattatatttttgataaaaaaatacaaattacttttataatatatctaaattacttttagattttattaaattaccttttagacatataaaagtaaattcaataaagcctaaaagtaatatatatatataaagtaacttaaaacaaaacgaaagtaacttgtcacgacattagaagtaaatccgttgtggggggtaaaaacatgagtctatctaaaaattaaatgtaattagcatacattatggaattgattaaaaatggtaataaaacaaacaactcacaaaagtatttttttatatatgataaaagtaacttacatattaataaaagtaattcatagatattttttaataaaaaaaatataattatgtaaggttttgttgtaaatatttaattgcaacgaatacaatagtttaatcggattatagatcggataagtaatttaagagaaaattttataagaataaaaaaaggcatacattgttaggtatagacgtaaaggtctctcattaaaacaatacagtgtacagtctctgtgtagtcacgtccaatatatttgtcagtttcaatttacagttttacacgtttagagtttactgtaacgtgcagggtgaagcggtgaaagactggcgggagatcgtgacctacttctcgtacccggtgaagtcccgcgactactcgcggtggcccgacaagccggcggggtggcgcgcagtggtggagcagtacagcgagcggctcatgggcctcgcctgcaagctgctgggcgtgctctccgaggccatgggcctcgacaccaacgcgctggccgatgcctgcgtcgacatggaccagaaggttgtcgtcaacttctaccccaagtgcccccagcccgacctcacccttggcctcaagcgccacaccgaccccggtaccatcacgctcctcctccaggacctcgtcggcggcctccaggccacccgcgacgccggcaagacgtggatcaccgtccagcccatccccggctccttcgtcgtcaacctcggtgaccatgctcacgtgagtactacggccacactgtatccttggtgattttgttttagatcatgcatctcttaggcaatgtgaacttgcagtatctgagcaatgggaggttcaagaacgcggatcaccaggcggtggtgaactccgactgctgccggctgtcgatcgcgacgttccagaacccggcgccggacgcgatggtgtacccgctggcggtgcgcgacggggaggagcccatactggaggagccgatcacgttcgcggagatgtaccggcgcaagatggcacgcgacctcgagctcgccaagctcaagaagaaggccaaggagcagcggcagctgcagcaggcggcgctgccgccgccgccgccgacgcaggtcgccgcggagttggcagcacagaagcccaagtctctcgacgagattcttgcctagatcgccatggacgcagcgcgatcgatgtgtggagtactgtggactagatataagtataactatgctgtctatgcatttgcagcacgaatgcttgaagactgaaataatgtgtatcttccgtcgaaaatcgaagcagtcgtaatactactaatatagtagtaaacgaagtaaggactctttacatgagaccttctttacattttcagagttgtcttttctctatatcggctaagtaatagctagggacagacctcccgcctccctttgtcaaagagagcaaaagggggagaactttatatgaaacatgaccaaattcacttatgaactgaaaaatatctcacgctcatgacctttaaattttgataaggaacagggcaaacatatgcagacgtgataattaactggccaattgcctaccactcggcaagaaatgcaggctaaatggtcctcatcatgcggcccaatcacttggtgcatgcaagtggaacaagttggcccacgagcacaagcatagatcgctgccattggtagagatccaacctgggccgtccatcccaacgcccgatccgttcgttcgccgctcacgaacccaaccccatattccgtgatcttttcgatctgggtgacctgagcactatcggacggctgtcatgaaccaaccccatgtcagcttgtcaggggccacaaaataaaaattacactgtcccgttcttgaggacgcgatcattgcgacaactcaaatcacttcatcctcccatgctttgcagtttaagtacacacgacaaaagaagagataaaaaaccaagctgattactgaagcctctatcagtctgtcaccccaccgtgcaccagccagcagtaataaatcaaaaaccggcagacgagcccccggtttcgaggtgcacgagccagccaggatccccggaaatgtggggcggctcaggtgaggcacgcgacgacgacgcgatcgatcgatcacacgtacgcgcggtgggcgccgtccccgttgcgcttgtgcagtgccctcccgcgcaggcaaaccatcgcatcgcacagggcagcgtacgcgcgcaacgcccgcaatctcgcacccgtacgtcgcggtcgcttgctcgccatgcacggcgcgcgtcgatctcctccggaaaggcggccgccccgcgcccgctcacgcgcgcgagcccgtgacaagatcgagcaggagtagtacgctcccatgccgcagcgctgttccatccgcgcgcccgcagcaaaaaggcaaaggcgccccgcgcccgtcccgactctgtgtgcgcgagccgaaaccgggcaaaactttccaatatcccttaattatacattttatacggtgtgctatgtgtgtgtgtgtgtgtatgtcgtgtgtatccgtcgtcgatgaactccgttgatcttaatttaaatattgtggttttgcatgcacgcatggatgtgcaggcggcaagttgcaaggcgtgacgaaataattcggcagctgatatgctgtaacgtggttcctgtagaatatgtcatcgatttcagtttggaggctccaaattaatgggtgatcgtactgccacacctgcaaaaccgtgagcatagcatagcagcagacgcccggtattttgcaatctgttggctgaacagtattgtcgcgcttgtcatcacggagaagccagaattattccggcccagtagagattatggacgtacaggtttcagtttcactgctgaagtgctcatgtgtgccggtgatggcgagggcccaacggtatgagatggtgaatcctcgtatcgtatcgtcacatgcagctagccagctacgccgaaaaaaaaaagaagcctctctttatcggaaaagaatcaacatagtactactccacttcctagtgtcaaatcatcgtgcatggtgacagattacctgtggtgagaactcaatgacctgttaaactcgacacgatgcaaataaggccgatgtttagttacccaaattaccaacttttcatcacatcacattacattaaaaacttttctacccacataaattactaactttttcctctaaactatcaacttttttctaacttctaacttttccaccatctaaacacagcctaaaccgagttacggcgtactctggatttagaacccgttcacaagtgggcgacctcaccatcaaaggcttatcctgaataatccatacaccagcctgttctggggccacgtacgtgcccagttgagatcagtagatcacctcgcaagggtgcatgctctgcatgacagatcagggtgcacatccaccgggcagacacgccgccggcagcacgtacgagctgcgaggaaagcaaaataaatgtggtgtacccctcgcccgacgacataagaaacgcatgtttcaacactgcaggtctcacgcgaacgcatccatgtatgcgtggtgcaggctgcagccgtgcagctggtggggaatcgaagccaacgggaggactacgtcgcagccgccttctttataaaaaagaaaaagaaaacaagatttgaaaggagatatatccctaaattacgagagtgttaagatagtattgaaactaaatattacttatcactgcactatcaagtacatctcgatgtagtcgtcatctcgctggtagcgaggaagattttgcagggcacgccggtgtgaatattttacattttaatcatttttaaaaactttgtaaatatataaaaaaaaacttattttaaaatggttctttttctcagcattagtgaccttcatgttcaacgtcttggtaccaacaacactaatgttaataccctcattttcttaaaatacttatgtcatcgatgtaaaggggatcgatgctaatgataatggcaggatctatttgtcagtcctggaatctagcacaccgatgatgactgtgtcttaattctgagttcggcgcacgagctgatatgcacgccagcttcgcgaaggttcggcagagtcctcctgccgtcctgcgtggtgaacgtgcgcgtttgagcggttgagccggatttaacggtgaacaggcagtcggtgctatacctgtatagctatgtactcctagctgaatagctgcgtccagtttcggggaaagattgttgatcagtttgggaactctccgcatgtacctgcccattgaaccaggggtaagctatttttacgtttgattccaacctccagaactgagaatactggaacaaaaatgatctatagtaaaagatccagactagtaagagaagactgtaagaaggctaaatgctgatatggatgagagaggagaggaaagagaggagaaacgggtaataagcttacagccggcttagatacataaaaataaagggcttgtttggtttggtgccaaattatgccctaccaattcattggtaattttgaatagtgcttctatatgtttggattggtgccaaattttaccaacaccatttattaggtagtacaaaatctgtccacccaaatttggtagtgccaaaagttgcctaaactttggtactaccaagattttggtagggcaccaaaccaaactggctcaaaaatttgtgagagagataggtggacatatattaatagttaagagctaatcactatgtgagttggttaagaggtaaactgtaaagatctactagtatacagtaaacaactatttactggctatattattagccatgttctaactcgatacgttgattatgctccaggaactgagacaaacaatatcttttgcttttgtttcagactttcaggtgtgctaatgaccaggttagcatccctgtaacatgtgaaagtgaaacatgggattgtaagcattcccaatctcgtgttttcactttacactcagcagtcaggactagagcagtactcgtacggtggtagcacagcaatcagcagcacccagacttcgagaaacgacacaaaccgcttaccgatgccaaagtatcgcctcacctgcgaaacatacacgcacagtcacacactgacacacacaaaagaaagaaaaacaaaaggtgacacatgtcgatgccattcctgcaattttcgcccaactccagtggccaacacctaaccaaactgctatatattccaagtccgtcttgccctcctccaaccaacagctcgcgcgccaagcaaagagccaaagagagatcgaaaagccaccgccgagcaacaaacacagctcgctcgttccgccattggccgccgctcaatcgatcgttcgatcagcctcattctcgccgtcaaccatgtgcaaggtcatcacgatccagtcgctcgtctggctgcgccgcacggtgcggcggtggcgctcccgcgccgcggcgcgcccggccggcagcaagatggagcgggacggcgacgcggttccggcgggtcacgtggccgtgcgggtgggaggcggcggggaggacgcgaggcggttcgtggtgcgggtggcgcacttgaaccacccggcgttccgggagctgctccgccaggcggaggaggagtacggcttcccgtccggcgcctccggccccgtcgcgctcccctgcgacgaggaccacttccgcgacgtcctccgccgcgtgtcctccgacgagcgccacgacctggccttctgccggcccgccgccacctgcggcgtcacgaagcgccgcgccgagtcgtcttcgtcgtcgtcgtcgcgggcgccgctgcttcaagggatggacagcctcgtctggtgatccgcgccaatccgaaagcctcgtacctaagccaccgataagcaaaagcagctgcaaaccgtgcacgcgcgtccatgtcgtcgatcggcggcattgcagctggtcgttcgggcgcgcgtggcgaccgcgggacaagaaggccgtgcacgacacgtacgcacgcgggcacatgcaagaacgcgcgctggggcatgcatgcgacgtctaaagggcgccctcccgtgctcggcgtaatggcggcgcgcgcaactggggcaggcggccggcacacagtactgtagctagctaagctagctagcatagcaagtaggctatagctatctgccatgggctgacagctactacaagatatactaatctgattgagagggtggtgatgattttaggtattcttctccctgtaattctactcggaaattaataaagaatcgatatatggcttattgtgtagtgcatgtatgcgttttgtcgtcgtttgtcatgtgctcgtgatgttgatgtggcaaacttgtctcaacccaaaatggtttggatctttggatatgccatgtattagcctttaaactagtggcatgcctttgtcctagcttctagcagccggaagtccggcaccagtcgataatacaggaaaaaataacagcaaaacaagagctgcagtgaacacgatggacgacggatgaacagttaatgcggatagtttagctagatcaaagtcaaggcatatggacacatatggttcaatatcaatgctagtggatactcacgcgttgcaacaggccattagaacttcttttctttaccgagaattgatttgatgattgatgttttacatacactttgataaaatggttagtatagtttgatggctaaaaatgtgaaagctgctttataacaatcaataatgcagttagtatgttgtaacgatgtaggaaaaaaaatatcttcattccaaaatataacaacatatgatcagatttaaagtttagaaaagaggaagtaaaaaatacaagcggcggagctaggggccggtaaccatgggcaattgcccgggctccaccgccgcacacatcattaaagcaagtttaatagtatagccaactattggcttcaaattatctatagtcaatttaatagccagttcatacgatagttacctataaatatatattacacaattaatatctagtcccacatgtcatacacacatatatgttggagtccgtgctgcagctggctacaaatctgtagctcgttgttcttctctctcctcttttatcttcttaaaatgtgtttatagctggcttatagtctgctattgtacctgctcttagagtagtcttaaatcatggtgcttaaccacaacatacagcagtataagcacactacttggttgggacactttaataatttgtataagtattagagagcatgcttagccacaacatgcagcagtataagtacgttttaataatctgttaatagatgttagacacacaatcatctagagtaacctgaagcaccatgaatgtttactagatcgttgtacctattacttgagtgcaagttattagatgtctacaacctgaaagcaaagtaaattttctagcgtccattatattttttttcattttcaagataataaattactaagtcccatagtctgcaaaaacacaaccatcgttttcctctaaattagaatacggtaaaaaaaattgttgtatggtgcatagtctatggagttatatgagatttgttatatatttgttggcgttgttaataaggcttgcccaggctaacaaaagtttctagatccgccactgcaaaatacatatgtgcatatgcatacctacactccattcttagtctctccgctctcatcttttgctattgctgtctaagggcagccacaatgtgaacataagggtgggttttaagactctaaagtgaaccttatatattgtgagagtagtctttataggtggcatttatttgagctagccatatgtataaagaccacccacaaggagtaaaaaaaatatattattctttcctctctcataatagtgatactctctctccctctctcaatggctaatcttgggtttgtggggtccaccttaatatccactctttccatatacattgtggacatgataatatattttagtgtgatccaccataatagcaatgtagttcatatacattgagcatgccctaagacgtgtaagctagcatagtaaataagtaatccctcctattctaaatattaaatatttataaaaaattgattaaatttaaaattctgtccatcagttatatagtacaaaatctaataagtttatgaattatgataatatttgtgagataaatctacatgtatcatttcttttattttgagactaagtatttaagaaattatcgatcgatagtaagttggtcttggaggagacgaaataccgtttatttgagttgcttcgtatgtgagactagggttcaatttgttggtccaccacaaagtgtgtttccaccctcttgccaacttgtatataagatctgaggttgataacgctggagtcacataatagcagagttggtatgacaattcaatttgtagggaccagattaaactttaaagcatgcaattcgaaccacgtatacgcttggattcggacgtggcaggttcctgtctttccgatccggatacggattaatggtctctccatccaggcatccatttcggcaaatatcaagctcgtccgcagcaaataagcggatgtgctgcagctgtccaactcccaaacgaactgcacgcctgagaaatagcagggctactgcctcatgaaattaatcagctaatttcaacagttggtttaactggtttgatgtaattttggagttcttaggcctgtagtctcacaaccttgtttgttgtacgtaatctatattcaaactcttctttgtcttaatgaagttggccgtcgtttcgtcgctggcctagcggaaaataaaaacaaaaatcaagctaatgccatcatctaggacatgcatcctgccaccgtgtcactgtcaattccacactggattgatcagagtactctgggaacagtgtcgcatacgccccctcgttgcacatttcagctgcacaaagttgagtacatgcatcttattatgctcctaattactaacacctgtcgatagggacttctagtacaatacatttaactgattaaagcttggtctgatcatccagggtaaggcagatctggttcagctgaggattcataggacaaaacctcgttccagacaagatttgaagtctgggctctggaccaactgatcattcagaatgctgtaggattcatgggacaaaatctcgttccagacaagatttgacaatgctgaaaacttcactgcatgcatgtttgcgacctctgcaccctgcaccggatatcactatactaacatgtgtcacctaaatagaacaacataacaaaattataaaccataaatttctgcacttgccatgtctatatactactactagcacatggatctttttgtttcaagataaaactaataattagctaattgaccatcgtatcgtagccacgtagcgagctgaatcgtgtgtaccccagggcaattccaggatggatttcagccagttacactgcactttcaggttcgttatctctgaagattatatccttcgctgccgccaagcatctgcgctcgtgcacgacgcctaaggctcagcgcacgatcacgaaggccgtgtacgtgtcagctcgccaaggcggtgaacatgcacaacccccagaatctttgtgaaatgatgaagaacccccgtggattgagcgactgttccaaccgaaattggtttttgtccttttggttgcgagatcacatcatctagctacacgcaatattatcatctaataaaatgcaaatgcattatgcatgagctagataggagctagctgagtgctgagaggctgagacaagagagagaaaaaaggttcttatttttagagtgttccggaataaattaactcgtcactcatagatgtatgcatacacatgaatgaccagatgcatgaaccgggcattctggtgcttagttgtactaatcgtgactaacaattaccagtgcattcctgcattgagtattgttcttcagattaattaggaaagaccctgagtttctgcgtgttcgctagtgattctttcatattggaagtctatgtgctatccagctgagctgaaaaagaaatgagtttttttctaggcatgttttatatatgtagtatatatagattactttgaaattagctacgagtcacaagaatctagtagttaaattgctatgcagagtcagccacatgctcccatgacacacatggcaccaccacatgtatcaccatggtcatggagaatcatcatttgcaaggcatccagtatgctacttaacaaattgcaaggacgtcaagtgcgtacttagcgttggtggttgacacgtagagcatctgtgaagcacaggacaaaggttgatttggtgacatatgattagcgaattaggaaaaggacgaatagactcatttggcttataagcctacatataaatctcctcctcgcaatgttcccttcacacccttttctattggcgagatcataaaagagaatctctgttcggtgaagcgatttagaaaggggaaaacggatgaaaaatatgattatattttggtacgcttaatcatttggctaatcatttatcgtcaaacaaggttgatagttaaagacgtctaataccattttcaaatgtgtacctgcagctaatcatgctactccacacacaataagattcagtcagaactgggtagttttaactaaaagtgcaaaacatgtcaaccgatcatgcaaccaactatcctacagtagtttatactctgctaaatattcaggcttctttatactctctaaatatttgtattcgatccttgcacgcaataatttttttcagtaaaaatatattttttgttattacatagaagctatgcatgtgtacatcgttgtttataaccacgcacacccaactcacacaagcaaaaacatttctcgagaaacaatatggtgatactgtaatcgcaccagcagtcgacagtagaccaaaattaaaaatttgttcacagaaaagtaatagttcacgtcaaatcgtttggatattgtggaggctaagccttttatgcggtacagcgagaatgctgaatgcatctagacaaatgacactctgtctaaagttagaaatttgaaccgttctttccaatgcatgggcactacttaggctctgttcgttacagagtgacaggggagatatgtctcattttccacgcgcacgttttttaaactactaaacgatgtgttttttataaaaaaaaattctatagtaaagttgctttaaaaatcatattaatctatttttgaaatttaaaatagttaatacttaattaatcatgagctaatggctcacctcgttttacgtatcttctcaatctcctcaatccccttctccttaaacacacccttagagtacaatataacgcaatgtacgacgttgcacttaaattgatgtgaaacatatacaatgtttctgttctatctctcttttttcgcagcttcgctggcgcaaatagcaaaagatgaaaaggctatgtctgctcctttttttttttggttgcacgccctgctgattctttcttctttggcgctttatgacgagacagtcctatgataatattatcaggaaaggttggaggatgcactactagtgcgtaaaaaatgtatgatagtttatgcctgcaaatatatattcttttgtttgatacttagtgctcgcaatcttcctgaatcactggctcgatcgagagaagcaaaatgcagtagcagataatgatcctgcaggccagaaatgaaaaaaatcgaactgacaagttactagtacaccggtgtttggtcaggtattgtctgctacgttgcatatacgtcaaatttcgattcgttttgctttggctgtttacgataagtgccatgttaataagcgaaaattaaacatactagtcatgaacagagaaaaacaaaaacagtggttagccttagtttgtttcatcagcatgattaccggctagagctaaataactactccctccgtactaaaatataacaacttttgtttggatgggatatattctagtattataaatctagataggaggcactatgatgcattccattcaaccaaaaattgctatattctggaacggagggagtagctagcttacttcaccagttgattttctaaaccttacataatctttttttagataatcttaatttagcaatttagaagtatgtaccaatacattacattccttggtgttgacacttgacatttcagactgaaagcaaacgatatatcctacttattgcggccactctgcatgctaattaagctcatatactttgagcagttcttatttttatggtacactttgtagcacgtcatcgtggtcctttgatcgtttcccgtgcatctatggcgatcatcacttggttgacaacagttaacacgaattttaaaaataaatggaagttaagggtgtcatatagttagtcataggatgcaaaagagaggatggcatggaaagtaaaccgtcatcctcatcattctgggctgcaacaaccgttgtagacagcagccaagtatgaaattcctaaacaaattactagtagaagagaatccttactttagtggttcagacttcagaccatttctccttttgttgttgttttatagctttagaaaactagagatccagcctgaaaaggcagaggtgtgagtactttttttggacctcttttgttaaactttcaccggccggaatggatcaggatttattctttaaagcaagttatccttactgctactaaatttgtaataactccaaattaattatgcaagcctcaaaaccaccggaccaaagtacactgtatgtccttccaagtacacccacttggttgccacttgccccggtggttatgccaaaacaatacgacttcagaccattagacgctaaccaagtttggcgttcacattcttatgccctctgtgacctgtggaatggaacatcacctcagctttcctctagggtctaggctcaactggctgaaagagcaccaatgcagccagtcaacgtgatgacgtaggcaggaaacttgaacatatgcggatgggtttttaattggatttagtgagattaaagaaatagcactgatataatcgtgtgttaattgatgtattcgtaggtgtgtcagtggtgctgtgtacaaggtggtgcatgtacttatgcagtcctgtgatcgaaaaaaatagtgaatttaataaaactaaaagtactttgatcaaattattataaaactatagatttgacactaaatttaccataaaactaaaatatcacaaaactacatatttagtaacaaattttgttatcacaaaactataagttttggtgacaatttaatcacaaaacatgaacaattataagtccaacataacattagtgctaaagatttaagccccataattttgtgataattttattattaaacatgtagtttatgatgcttagccttaaacctatagttttatgataaatttatcgttaaatctatagttctgttatatattaacttaaatatatagttttatgatgatttgaccaaagtacctgtactttcgtaaaatttactaaggccctatttagatccctcttcaaaaattttcaccttgtcacatcgaacgttttaacacttgcatgaaatattaaatataggctaaaaaataactagttgcacagattgcgactaatttgcgagacgaatcttttaagcctaattgcttcatgatttgacaacgtggtgctagagtaaacatttgctaatgatgggttaattaggcttaataaattcatttcgcggtttactgatagatcctataattagttttttttattattgtccgaacactctacgtgacatctatataataactgatgtgacacgtcaaaactttacccctagacctacacaccccctatgtgttgacgtagcaggcatgtgactgacaagacggacgagcagctatctcgctcaaactctgaggagatggaggcggttagtttgcgacgaaaagaccaactggtggcgcatgggcgagccaccgtttttccaatgctcgtcgcgcaatcggcgtgcccactgcccagctagcggccaagcacgcggctgcctcccgccgcaccgaagcgcaaaggaaattcgcggcccggctgcgccgcgcgcgccgcaactcgcgacgcgagcctctccgttcattggccaccgatcctccatcatccatgcgtattcctgcgtgacaacttgcggttcgtttttgtttaatctatcgcggaatctgtgggggaaaagacacggtacggaccacacgtctcgtggtacttcctgtcctttctttttgggggggtatggaacaccgttatttggcgcgtactagtacgtgacaaagtgacatgcccgtctcgatgtaaccccgtttggtgcgtgtgtgcacgtacgagtgagtgtatcacttcacacgtacgcgccgcccgtggttcgaacagaggatgttgtcctgatcgacgcatatgcagtatctctatgaattgttattcttggtattttctggggcgtctggttggttggtcgacagaagcatcaaccatgatgaaagttttttgctctcttttggtgtacgtccatgcgatcgaaggtgcgtacgattcgggtgtacgatgagaaaggaaccgttggcttgtcgcgctagtttaattactcctttgctaatttatgcataacaacaaatacgtacgtgcattaagctgtgaatttgcacgtatgctcccttttgttgtcagtggaacgtgctagacgaagacgagtattatgttcgtaggctagttgctggttgagtcaatcggtaacctctgccctctcgtggcaactggcagtgcgagatgtggacttggcaaccaaaacaaaacaaagcccaactagctcgtgaactactatggccaacgcaaaatgtgaccccatatgatcatcaaaattactgcagtattaaactttgcactgcattggttggcagctagcgctgctccagcgacgttgcctgtacgacaccactacctaggcgcccaggctcaggaccagcacgcacgaaccaggggacaggccacattccacgaggtgcacgtaatgcacggcagggcgatgctactggatcgcgcaatagatgaccgggcgaacgtacgtaccgaccgacgtacgctcgtaccctgcgaccaaccacacccaaaccggccggcgaaaactgccacaaacgccgtagcatgccggctcgcgcggcctcctccccgccgcctgcacatttacttcgcgcgcctactacggcgtgccgcggcaacagccacggcacatgggtgttggtcgcgcgcgcggtgtgtggggatcacttgcgcggcgcggcgtttacccggggccaaatcaaacgcgcggcgcggcgcgccgcgccgtgccgtgccgtgccgcgagccgcgacgcgagcatattccaactgcccgcgcgcgcgcgggcgcaacggcgacgggctaacgaacgacgacgtacgcggcgcggcccaatccggcacgaaatcctcctctcgtcgccgcgcgcgcggcggcatgcacgtggagagcgcgccgcggccacactctctccactgcacctgggcgagcatgcatgcggggcatcttgctggtattcgtatcgcgttatctacctagcgaatcgtggagtccgcggcggccggtcggcccagccgggagcgtgtacgacgccagttttatcggagttctttttgcatgcaagggcgagcttagctagtcttttggaccatatgtacgcacgcagagcaggtacacgcatctgcgtgatttcagtgtggcacgtgcaacagtagacgctgcatgctgcgatcagtgactgacgactgacgagacgacttgggttaacttaattagccgaggtcttagctaggaaaagggaacggaagcatgcatgtgtagtctctagttgcttacctgggaagcatgtcgatgcttcaggacagttaaccggtatcacggcttttgacagggatcagattctggacggacgcacgactgaaccgcccggatcgatgcttaattttgtcaaagaagatgtaccagcgctatagctagtaagaatggaacaccctatatagtataacaaatccttactcgacaaaaggcttaattagttacactagtagagtgcacatggcggttagggatcgttaaaatgtcgtaatgcacttcctacccactatggatggcattgccaaacaattgtttatcgtactgcaaacttactgaactttttaattgaagaaggaagagcatggcaaccagttagtaagggcccgtttagttcacaaattttttttcccaaaaacatcacattaaatctttagacatatgcatggagtattaaatatagataaaaataaaaactaattgtacagttaggggggaaatcgcgagacgaatcttttgagactaattagtccgtgattagccataagtggtacagtaacccacatgtgctaatgacggcttaattaggctcaaaagattcgtctcacggtttcccgatgagttctgaaattagttttttcattcgtgtccgaaaaccccttccgacatccggtcaaatgtccgatgtgacatctaaaaattttctttttcccaacttaaacaagccaagatgaatcatcctcattttagccaaaatgaaatgcagtatcaaaaagggtggaggcgtgtgcaaataattaagctcgttaggtgcgagaggggacatgcatggcctgaaatctgcggtggagatctttgacaggtacaggaccggcagggattttttccatcacgcaggcgcaaaatctgatgagagatcaggaattcagacagaccaaattcgggcacatgtagcccgattgactgcccgctcagccccggacacagccgggtcacatgcacgagcacaccagtacaccaccaagctaagctaccctgcatgctcatgagttgcttggccaccctgaccacctcactgtcactggccgcagggatccaccacttgagcaagctgatctttttagttcccaaaaacattttcctaaaaacatctatcaaatgtttagatacatatatagagtattaaatataaataaaaaaaaattaatttcacagtttacatgtaaatcgcgagatgaatcttttaagcctaattaggtcatgattagccataaatgctacagtaacccacatgtactaatgacgaattaattaggctcgaaaaattcgtctcgtgattttcaagcgaggtatggaattagtttttttattcgtatctgaaaaccccttccgtcatccggtaaaacgttcaatatgacacctaaaaattttcattccaccaacttaaacaggcccaaagtaaacgattcctcctagctcgtctctctgctcgacacagggacaccgccgatgtgatgggacttcgcgatgatgtgagattgtgcgcccagttaagcttaagctacagcttagctacagcgacccacgttactatgtacgacgccgctacgctagcttgcgcgagtcgagtcaccgatgcagcacgacaaatgcgcctcctgtttcagatttgtagcggcgaaataggaagtgagctttgctatagtggccctgaatgcgacgggcattcggctacacgtctgcaagatgccaaaatgtgctagacactgccttgtggtgcactctgcaattcctgtttcagaaagttcacaagcagtccgtggtttgtccttgcatctccaccatttttcaatgtgtgtgatgagcttattagaaaacataagaaatattaagttttgatccttataattgggctcatgttatccacgcgaaaagggagtttgttgataagttggagatggaatgccgtggtgcatgagtaggatttcttgcgagacagccaattcgttagtacaaaaaaaagaaagacaatatgtacacatgacatttggcgccctgtttcatcatgttttaaaaattaaaacacactgaaaatgcaagtgaagtcatcaattcgtttttatgcatactatcatgcatgtatgatgtatcgctgtgaacataaactaaaaagtgacacacaaaatttaatggctagtccaaggtacaaacaagaactatatcatggctacagttttcggatcctattcttagacaaaatagctacagcactctagaagaaaacgttcagatcacagatcgaccttcattggagcgttgtgaaagaggagtaatgagcaatatttatagatgacttacaaaattttgaaatgaaaaaaacagcacggctatatcatcaaccacatgtccttttccgatccttttcttctaatatgttgtacacttttttccagctggaattatttcatccaaccaaaagctcctccctccacatataaatcaaacctcttcttagacccaactcttgcaaattatgggaagaatgacaaaaagacatgcgtgaatgtgctgaccccgtgcatgcaaacgtgtcctattcccttttgcaagcgattttaagctttaactttcagcatatatatttttataggtagaaaattttgttatataaactttatatttttatagtataaactttctacaaataagattttaaagaaattataaaaaatcaaaacatttctactcaaaatcatgaaagtttatttgaatagttgaaagtttctactaaaaaaatcaataactttcaaccaaactaaaaaaaatctactcaaaatcatgaaactttcatatgaatatttgaaagtttttacttaaaaaaatcagaaaccttcaacctaaaatagaagggtgctaagcttatatgtgggccagatctaaggaagaaggatgtaaggaacctcatcggggttgcgatcatgaagcacaagtctagttcgaaaaggaggtagaagcaaatgcttgggatctttatcttggaggaagatgaagaggacctcaggctagtcgttgtctcgccaaagacgacgagaacctctaatgtgttgtggcctacaaggcgtaaacctggttgacgacagtgaagaaggggatgcaacgggaaggatgaagggggaataatgggagaggctagatttggtttcactctcttgtgttcacggagaggaacaaatagaaagagaagaggaatatgaatatcaaagactctagccttaatagatcacaagttggaagttaatagatcaccaagttggaacgtgttcgctcgttaaagtgacttgggtaagttcggcaattagctatcccaaagaatggtgcatctgtgggaggctaaaaaagaatttgattgttagatgtgacttaagtgttatagagaaaaaatttattgaccgacattgcgagtcagtctctaggaaatacaaacttccaatttaacaagcagcaaatccatacacatcaacattccattccgtcacttgaataatttggtatgtacaaacgaatatcaaaggagggtccaacaaaaaaatgaatatcaaaggagggagtgaactaaggttcattgtgacacatgttacacataattattatgtgagtggtaaattatatgcacattgatggtgatatacatgtgatagcttcgtctcaagatacattgtcctagttcctcaaagatagttataaggacatggtataaaagtgtatgttcataagactaacatatatataagtgtctgtgtttatactatgtatcgaaaaaaaggaaatgataaaaatgaacaagaaagcttacatttttttcacctatggaggaatggagcataccgtagaactcaattgaaattattttccttacaaatgggcttccctaccatagatagacaacatatgcatgcatgggcaaactactaatccaaatgaattttccaatgtttgtttcctatacataccaaacgatgattcaaaaatcccaagataaaaaaagattaaatacagttttcactttatagtaatatatcatgtgttacatcactattaaattaatttattttagggacgaaaggagtataaaataggagaataaagtcacatctcgccgtagtattaaaaaactttgcgagccaactggacgacccaaaaacattttcccagttcgtctgtcccgtcctataaaacgtcccgccccgcccactcgaaaagccagctcctccatttcaccaactcacacccccacacacgccattaactcacccaacagcagctagccgagccgagccaaccaacggacgaacacctctctggctctctcccccaccgcgtcgtcgtcgtcgtcgtcgccgatggccaaatgcagcaagatccgctacatcgtctggctccggcagacgctgcggcggtggcggtcccgggccgcggcgcgcgcggcggcggaggcggtgccggcggggcacgtggcggtgtgcgtgggcggggcgtcgcggcggttcgtggtgcgggcggcgcacctgaaccacccggtgttcagggagctgctccggcaggcggaggaggagtacggcttcccgtcgggcgcctactgtggccccatcgcgctcccctgcgacgagggcctcttcgagcacgtcctccggcacctctcctcgccgtcctccgccgcgcggttcgtcaccctcgaggacatccagagcggcgccctctcctgctgctgcgccgccgccggcgacgccctcccgctcctccgcggcattgccaccgacaaggccgtgtggtgaatgcgatgtgtgatcccacccctagctagccgctccgctcgccattgcgcgtgcgtgcatgcgcgcgaccgttcttgccaccattttttttttctcttctcttcttgtcctcttttttcccctctccctccatggccatttgagaggagctgagactcgccggagcaagagaaagagagagaaatcggcgaccggccggcggtggcggtgaagtgagatggctgagaaagtcttaggattttgagacggccaagtctagtcatccattcccttgtcaaatccgggaaaattatttagcaccggagatttttattctttcttcttcttcttcttattttcacttaataattcgccagtgtaaataactgtactactgcgattattctgccaccatttcaagtgaattgaaacattctttctttacaaagcctcactgtctcttaattttctttctactgtacggtcctgtatgtacttgctgctactactactacatttctgtgtgagctgaagcttcttactatttggaccgtacggattattagggggcttaattaaaggtagcttaattagaaaaggatttgacacggtatcttctccttttgtgggaaaattaagaatggagcaggagtagtgcaagcttagtactggagtagaatatatgttcaagctgtcgctaggctgtttgcaatggtttaggtatgcattatcatggatgcatcgaccagctaccgatcggaattatgggctgataattgatactgcaacttaagtattcctagctactgctatcaatgttgtgtgcggtagtcaactattttctgttcttttctctgggactgaaaattaagcgacttaaattatccctgaagcctgaagatatcgtcaagctcttagcaacagccatagttcagaaaagctgtttttttagaaaaaaaaaacattttgatctactactttctagtcgaatctcaacacataacggtatggccgtccactttgcaccgaacaggcgaaacactgaacctgaagagagcagcttatcatttagtggtagtcagtaaacgactttgtatattgcactattgctcctagagaagatcaggttaattatgcagtggtagtatgcaaacacctctcaaagattcccctttcgaatgttcttcctcctctctctggatgattatttttgtccgtctctccttaagattactagattttcagcaggttagcctgcaaaaattcggcaatcagggaggaaaccgttttatccagtactggcccccggctaatccagtccaattattacgtggacgaaaaaaaatatcgtaaagttatgagctactcctgtatgtggggatggagagagagagagagagagtgtgtgtgtattcagtattctactgtgtaggctccgattgttcgagctataagccacagaaaaataaacatggtaatataaataatatatgaaatacaatttatatttgtgcgatccaaaagtaatgtcaaaattagattattgtaagacaactttcaaactaactttatagttaaattttaaaattgaaattttggttgtaattgacaataaactaataacgagaccagaaggagagggtcacttcagtactgttaatacggtagtaaaaacactgatgtgtggatccggagtggagaggatctgcatcccacttggtctacgtactccagtagtactcctattttttactgtgctgccgctgccgctgaaatggatgggtgcgattcggtggtgggggaggggaggttgagagggagggaggggcgcgcatgtgggccgtgggccccgctgcatgtgtgatgataccccggcccgggacggcgcggtgtggaccagcagccgcacgccgttgccccatcatcacctgcttctgcttgcctccgagtccgtagtcctttgcggccttttcttttttgcggtttagtcctttctcctccgcctttttgtgccccgtcctttctcccgtcctcccttcttcttctccgttgcccgatccgttccgttccgttctcgcgaagcaaaaatgcaaaactgcaagagtcggggcggcagccggtacgcctgcggcgctacacgtgcggctctggacacgtgggggtaggacatacaggcggcgacgttcctctccgggtaaatacggatttacgggcggtgaaatcctgtatgacgtcaaatttatttatttactccctccgtccgaaatactccctcctttcaaaatgtttgataccgttgagtttttaatacgtgtttgaccattcgttttattcaaaaaatttaaataattatttattcttttcatatcatttgattcattgttaaatatactttcatatgcacatatagttttacatatttcacaatttttttagaataagactaacggtcaaacatgtgctaaaaagtcaacggtgtcaaacattttaaaacggagggagtataagggattttaggtggatgtaaaatcccttatatttcgggacggatgaagtatttgttatggcaaattttatcaaaatgtactcaaaatttatataatttatccgtggacatctaaaaacctgacacggttagaggacaccatataaaattaaaaactagtaatttgatggagaatatcataatcattattctattattgagtaaagcacatgaacgatatctaaacttgtacggatgtattatgtagatccctcaactttcaaaacgtatttttggtaccgaacttgttttgggtgtcatataattctaaacgggttccaacccactctatgtactaacgtgacatgccatagcggtttctaaatgacattttttttgatagattaggaatctaaatgacatacccgcataattttaagaaccgtccgtgcacttcactctttactatttttatccaattggagagagatttttaaaatacaaaaaacacccttgatccatgagcttctaacctgtcacaagcaatatgatatagttggggtgatcacaggttgcgaattgcataatgtacggtttgaaatttttgggaaaaaaaagaaaatttcaaaaaaaatttgaaaatatagataattatgctaatattttaagaaaaaaacttttcatcctgcttttgattgaaagcaaataagtatgatatagttatatttaaaaggtttgaaaaaaactgtggaaagttgtatagctaatcccacattaaaaccggcataggattccactaaaaagaccgacgtaggaaaagaaacagaaatctagcaaaacagaactgaaaaaaaaaattcaggctcacacacggggcccacaaggcacgcaacgtcacggcccacaaggcccactcagcccacgccacaacacacacaagctcccacaagtcccaaccaaccctagagccgcgccgcctcgcttctccccgactcccgcgtgctcgccgcgccgcccaccgtcaccgcctggagcgtgcgaaagctcgccggtgcggtttctccgctcaggtaagtccacctgctgcttccgcccgcaccctgtaatcttcgtctccgtcggttcttgctgaatcgccggccctgccttgcagcgtgaaggatgaggaagctcaggttccacgagcagaagctactcaagaagaccaacttcctcgacttcaagagggagaaaggccaccgcgacgccatcgtcacgcagcgctacctcctcgtcgagagagacgactacaagaagtactaactcatctctctctccagagtatcaactcgtaccttatcggttggttaaaggattatctgtgtgttctttcgcgttttactgttcatcctgtccatggacatggatttgctgcaaatttgtgattttgtttttgggtggtggcaggtacaatggcatatgcctgatggtgcaaaagctcgtcaacattataaagcaaatggacccgagagacccttacagagcggagatgacagacatgttgctcgataagctgtaagtagcctgttgcgtggtctgcatacaaatttagagctggacagttacgatctacaattccacatgacccatcaaacacgttaggcacacaaatttgctgtttgctgaattgtcatagagtcagaatcgagattgctcagggaaattcagttcctgtatataatgtttcagagaattttatagcatgtcaactaattcgtgtgtttgaggaggggctgtgtgcctgtgtctatttttgaattaccaaattgattggatttgcaatcgaggctataaagtatatacacatgactagtttctcagtagttcatctgcttcttgtccagggacataattgtttcgataatcctgccaaagatttttcgaataattctcgctcttatgtttggatacgaacctcggtagtcctcttcttttttactcccaacattttgagcttggactggactaaaagattgatagacttgtgctaagcagaacttataatctaatgttactttctgcaatggattgcctatgcttgggtacttcatatagaactgtgcactcttaattttgtatgcttttcttgtttccagttgtctagccatttccagattttgtactactcatgtgtagtttgatgaagttcatgaaatttcaggtacaacatgggtgtaattccaacaaaaaagagcctgttaacatgtgaaaaactttcagtgagctccttttgcaggtcctttctctctctctctctctctctccatgtatatgtgctgtgtagccatcttttaccatttagtggcaaatgtttactcatctcagttcaacaattgttaaattgcacgtttcattggtcagctgtatgttaaagtgttgttgtaccactgcttcaacataaatgagacttaccatggctaaccacttaacaaacactataacctcgattagcacacaagactaaagttgtaggagatcagacatatcgtacatcacttattgcgtgtattggcaaattattgcaggcggaggcttgcaacagtcatggtgaagctcaagttcgcggagcaccttaaagaggccgtgacatacatacagcagggtcatgtgcgtgtaggcccagagacagtcaccgatccagcctttcttgtaaccaggaacatggaggatttcatcacctgggttgactcctcaaagatcaagagaaaggtccaggagtataatggtgaattggacgattttgatgctatggcttgagaatatcgttgagcagaatttctgggtccatcggtgtagctactcgtgtatgattttttttttggaactttttaaggtgaggtcgtgatttgctgcagagctacttgcatgtgcattgttgttgtcaatgttgtgtaatgcagctcaacgcctatgacagttcattcacttactaatacaattttgtagccgtttctctattacagtagcgctttgcttatgttcttgagtgtattttcctgtcacattacaacctgattatgcaggataattctcatggtcagattcatcgactttcatgtcagtgcgtggccaatctaggctacggattacggatagatggcccttgcttactctttgatgttctcttagttgtgttcgttgggatgtgttgcctatgtgcactatagttgtgtgcacaattttttcgctgagttcaaaaaagctttcattatcttaaaaaagtatgtggagactgagtattatacgctatatgaaccagtagcagatggcgcatactgcaaaaaaagaaccgtacttgattccaatcttcagtatttgtttactgcacattcaggcactataaatttacaatggtgcacgttatgccattcagcaagaagctgcatgcacattcaggccatgcataggtgttacttctaatacagttttcaagccgacattcaactggaagcatgagacccaaagaaagaatagatagctcctcacacacaaaatggattttatactaccatcatgtcctaaatttcagttcacaacactaactatgaatcttgagattcttcatcacctggtaacgtttgagaatccctactgcattttgattcttgcatctcgacctcaacagtagtcacatcttttgccttcccattttctgtctccatccttcttaccttctccttttgtatggctcgtagctcatacctacaaataaaaaaaaaaacagaacatatgtttcaaatgttgatgctgttaaattgtctatggtaatagggactaggagaacatgtaaatatgaaattcatagacttctgcggataacatttgaaatagcagcctaaatctatgaggtctttgcacatcaaatatcagcctatctcgattgcataggtggaagcagataatgagcaaagctgattgcaaagtctcacgaggctacagaggagttaactgtatatttggtctagtgtttacatgcctgtctataattttagcctggatcctgtaacttcagcactcgcaaggatgaataattcattttacctataatttcacctatttgaagtatatgcctacaatacctctaaatcttaggacatataattcagaccaaacaaggatgaataattcctttttttcaggataggtcatttaggtaacttaagttagtgaggtacaatggagaacaataaccttccaacattccatgataattaacaaaatcacaggatgtaaacggcaattatatctggcagaagcactacttcaccaagaagatagcaattaatgggcaatctcatgtttttgcatactcatcacttcatcaggtacagcaaacccaacttcttaaatatgtacaagggctcacatttgatgtaacttatctgatgagatataaattggttgtgcgtaatgttaagtgcaaggtaatgtaatgtccatagtttataattatgtactgtattaaattggattagaaggtaatgcataactcattgaattatgaaggaaaaagtgagatgctactctgatgttagcttgtgttgcatatcaatactcagaaactaaatttacatgacgataatcgaaataatttcagaatggaagcttacggagaagtgtaactcttagcgagcagaaagtatatcctccagaactgcttatccttcatgtggcgcgggcacagatcgtaccggatcttggccaattcctgcgcatcaagcacgcatgcgtttgctcaaacttccacaacatcctcatcacagacagagagaagcgagcgatacagaaccgagatccgccgggaagcgtaccttggctttggagagcacgagcacggcgtgccgctcctgccagccggtgaggtcgccagcttccacccctgcgagaagcacgcacggacatcacgatcgagcccggatcggagtgggaaggatgaaatcgagatggagatggcgagtgtgtggctgttgccttggagctggagcgcggaggacttgaaggagtccggggagagcgtccggaggaagtcgagcagctgcggcgtcacgcccagctcctcctcctcgttcccggccgcggcggcggcggcggcggcggcggaggacgcggagggtttgctcgggccgcctccgcctccgccgcctcggcggcggaacggccacgagaaagaggagaaggccataggggggacgagctgcgtttgcgcctcgcgatggtgaattcggcgatgggttggagaggatggccgcgaccgcgacgattcgattcgctacggcttacgaattcgccgagtcgtaatcagcagacgcacacaccacgcaaaccgttctggaatctggaggatgatttcgacgaattttgtcttgtgccttgtgccgatggagtttggaacgggtttattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattattatttattttacgaatttggccgtgtgcttttatttttcagagaacagtaacagtttcaaagtaggaattgggaaaaacgttcgactgcaattcatttcgaggtagatttacaacgaggttcagtaagtttcaaagtaggaattaggaaaaacctgcaactccaattcagccgctacatcaaggttccaaaaccgttcgctgatcaagtactcaacggttgtccatttttatgaaaacgatttgaaaattgcaaaaatagatgaaagataatccagggcagtttagtttgacgtcatgaattgaattagttcaccagggtagtttttgaactcgagccgaagcgaaaaccacctgtgtgcacccatcagcgctccattgacagccgccaactagagaacacatacgataagcctcgccaagaaaacctgtcctagcaacttgttaggtatcaattacaatgttgccacaagccgaacaaactaatggttttgcgtcaagtaaacatttactagaagttaatcgtacgacaatccgcatcacaaaacatgatgcaccccatgaaacattgtatataagatcaagatgaaagctcaagaggtagtatgacctaagctcacagaatgtaaagtttgccgttgaccttatcgtacatgaaataaacatcgaaagtgtaaaaccaaggtcaaagacaattggttcaaacgccatcatgctaacatgtcacaattcttttggcttccactgggtccaaaatctaaggcaaataaagcacattcagctcccagcagcactaggtatggcggttggcttcgaatcctcggctttctcatgctccttgtttagcatctggaatcaaataaaaggaagtcttacaataaatgacaagtatctcctaactcccgcatcttctatattcaatagataagacagaaacaatttaccttgttattgatcaagttatggagtgcgatgacactccggataagagaagacaagtatatgaccaacatcatatcgtttgttttaactgcaggaaagaacattagcatcgaaccattttaagataagaaacccagacgacaggttcagctcaattatagtaaattggtgagaacatgtgttattacctgcaaaggctttaataagctcgtttacattgagattggggagcagattaaacacatcctgtgatttttttaaaaaataaacaggttattaactgcatcagtaaaattgtttcagcaacagaactttgaattatatttaaattttgtttggcaagttacatgtagtaaactgtcatgaccttcattagtttttttagacatgttgtgtcacagttttcttattaaggtagtgacaagctgagtaaaaatattagacaaaaaaccaacaaatcataaaaaacatacataaaacaaatttggccatccaaaagatcccttatatctcgcgtccaatgtattgtgaaaactaccagtagcatcacagggaattaccagtggcagcatattccactttgtaagcaacttttaagcactttttttatttgatttgggagtgatatttagtgatactgaattccgaacaaccacaataatggaggtgtatatctcaaaggcacaaatattccataaaaccaaacggcggtagcatgagatagctttcaagtgctgacctcaataatatagcaaatgcaagagaattggaggtatatgtaactcctaagaataccatacagaaagcaatgagtagaaggcgaacctgcaagtggtacaaaatctcatgattcagtgggagcttcccttcaattacaagatctaagtacccacggatctccctgagccttgcgtccagtcctttcaaggctgcaagcttgctggttacctttaatgacaacaatgataaaggatatattagggcataataaagcaacttgtaggctgaaaatgcatattcttgtgaaatattacctctgtcgcaagcgtgcttattgttgtgtccttgacatccctcagaagatgctcaactcctataagtaggatgaacatacatcagtcaacaatcctttctgaaggaaaaagacttcaccacaaaaatattctttcctcttggtgaagaaacctcactagcatcaacaacttaatatatttaccgctcaaacaagctaactattatctgtaacttgcaaaatacataaagcatccctttttcctagtaaaaacagatgagacagacataccgatttcctcaacctcgtgggcagctatttctgaaggaacatgaacaaacaccttttgacttttttgagtagcattctgtaaaagacaacatgtacattaatgaaacagaacaagacaatggacaagcacaataaacctccagcttcttagatcacatgctaacctctttaacctcctccacagcatagtatgctttggtgggtattcctaactccttgggttgaacatcaataatcaccaggacagggttaggaacatagctacaattg

SEQ ID NO: 80492 - DNA, 9963 bp, Oryza sativa
tgtgtgtgctgagtgtgtgtatttcctatcacatgaattagtttaaatcgttcacgagaccttgtattgttgtactgtttaagattctcaccatggttatatactttcagaggattctaagcggtgacaacagttatggagcgaatcttgtctagagtggtcaacgacaagatgcagactctggggtgtttctgtggtcctaagggaaaacacaaatgaaaaacattaaggatattcctgaatcatggaatgttcatccaagaaaagatcagtttgatccaactggatgagacatcgagatccatcttcgaaatgatcagaagaccaaggataaggtttgtgaattaatgttatatgttgatcaattatatttgttccataaattttcatgattgattgaaagagttacatgtgttctttctcaaatttatgagtgtatcacaaacaaagttttttttaaaaatgtttttgtcgagattatggataccccatatctacacgacagttatagtttggttgggtatatggtaccaaatatagatagaatatctttatgaggactcgggttagtttcgaacttgtatgacaatgaaatacccaagatcctagtcggttacgattgtattttatctataatcacatattccgttagggatatagactttattttgtaatacggaccccttcccctatataaggaggggtccgggttcctctcgggaggacttttttctcccagattatacaatcaataatatactcggcggaatcatccccggacaggagtagggtattacttcttgaataagaaggcctgaacctgtataaaattccttgtcttcaaacccatccacttttctagcttgatagccacccccttttattattgccgtaatcttgtttcgacagttgacgcgccaggtaggggtagcgtcagttcttcgccgattagtgcgatcagttccgtctccggcatcgatgacttcgtcttccctcccgggcaggcgtttcggttcggcggcctcgacttcatcaccaacgacttcggcaagatctctctcctcgactcggatccaaaccagtcgggaaagaaccaggtctcagccccattcggtattccgaactcggccaagatctactccaagcttatctcgatcaagtcggcttcaaaccactcagacgagatcccatctactccaacatcaccagatcaagatgatggggcctaccctccaatcctgatgaaactccccgacgatttggccgccgtcttcactacaagggcgtcttctccccgtaggcctaggcggaagtcggcttcaacaccgatcatgcctagctccagggaagtcggcgtcatactccagccactcggcacgatttcgacggatcaactggaaggctacctcagctcccccggcgtcgactcacgaccaaccgagatcgtggagtacgacgaattcggctaccgctatgacaaccgcgacctcgacgacttcgacgaaagctttgaagacaattacacccctctattcttcggcgtcttcatggccgacaacgagatggaagaacaacgccaagcccgagaagcagatgcacgacgcttacagcaggaagctgagcgatgccgactggaagaggagcgccaagcacaagagcaagaacggctgcggcgagaacaacaagatcgcgaacgggctgcaaaggaggccgaggaccgacaacaacgagccttggacgcaggacgacgagcgtgagatctcatcggacagcaagacgtcgaggggacagcagttttccgcacccctcaacagaacgctgtcgctgcgatcacccttctcgacaccctcctgaaggaagacgcacttaatcaagccgaccacgtcgtcaacatcttgaaccagaccaagaccatgatcgccgcttcggtcccggttaactccgacagtgttcgcacaccgactggcagccgggctccccatctccgatctcatgattatcaccagccaagcctcagcatcgtcggcacaggatccaatcgtaggagcagaggccaagacgagtgatctgttcactcgcctcctgaacgatacagggagcgccgagttgaacggcctcgttccctaccttgtcaacgtcccatcgatcttcgcgatacgatcaaccagtgccgtgcaacacgaggtcaccgccgtacgccagaccgctatgacgacgacgtggatggagtagctgcctttactaacgacatgcgtcgagtggattggccggccggcttcaagccgactggaatcgagaagtatgacggcaccaccaatccagagtcctggcttaccgtctacggtcttgcaatccgcgtagcaggaggagacagtaaggccatggcaaactacttacctgtggtcctagcggattctgcttggtcctggctccacggattaccccgtggcacgattggatcatgggcggaactgcacgacaactttatcgccaacttccagggcacctttgaacgccccggcacacagtttgatccctacaacgtcattcagaagtctagagaatcccttcgagattatatccgacacttctctgaacagcgcaacaagatttccgacattaccgacgacgttatcatcaccgctttcaccaaaggaatttgccacgaagaactagtcggcaagttcgggcgcaaacttcccaggacagtcaaacagatgtttgaaaaagccaatgagtatgccagagccgaagacgccattgccgcatccaagcagtcgggtcctacttggaagccaaagaaagatgtgccgactacgggagggggtggaagtaacaatcacaaggaccgcaaacgtaagcccaaggaacttgttgcgactactacacacttctcccgacaacgttcgcgtgtcaacacttttgacaagatcatgaactcccaatgtccgcatcatcccaactccaacacgcagctaaggattgcttcgtctacaagcagtttgcagagcaatatgctaagaatgcacagaagacctctgacggaggacaaagcacgtcaaaaaagatagatgatgatgatgatgccccgacaggttttcaagaccaccgcaaggagctcaaccacatctttggcggccctctagcttacgagtctaaaagaaagcaaaagttgactgaatgggagatcaatgttgtccagactgatacgccgcagtatctttggtggtcggagataacgatcaagttcgaccgttcggatcatcccgaccgagtggtccacccggggcggtaccccctggtactagacccagtaattcgaaacgtcaagcttcgcagatccctcatcgacggtggcagtgcactcaatatcctcttcgccaagaccctggacgacatgcagatccctcgcaccgagttaaagccgagtaacgcgcccttccatggagtcattccagggttatccgctacgccacttggctagatcactcttccggtcacttttggtactcgggagaacttccgcacagaaaacatttgcttcgaagtcgctgatttcgagacagcgtatcacgccatactcggacgcccggtgttagccaagttcatggccgtccctcactacacctacatgatgatgaagatgcctggtcctcgaggagtcatatccctacggagcgacatcaagcaagccgtcacatgtgacaaggagagttgcgagatggctcaaacccgcgagatcgcgattgctcgagaagacatccgactggctgcaaccacggcaagcgaaggagaagtgcctatggccaagatctcaaagagtggagaaagcgaagccaagaccaagaaaattcccctagatccttctgaccttactaaaactgctgtaataggcgccgagtaagattgtaaataggaaagcgcgctcatcacctttcttcgaaacaataaagatatctttgcgtggaaaccatccgatatgcctggtattcctagataggtgattgagcactctttgcatgttaaggaagatgcaaaacctatcaaacaacgactccgccgctttgcacaagacaggaaggacgcgatcaaggaggaattgaccaagctgttggcagcaggcttcatcaaagaagtccttcatcccgactggctggctaacccagtcctagttcggaagaagactgggcaatggcgcatgtgtgtcgattacaccgacctcaacaagtcttgccccaaagatcctttcgggctgcctcacattgaccaggtagtcgactcgaccgccggctgcgagctgctcaattttttggattgctactcgggatatcaccagatccgattgaaagaatccgactgcttgaagacttcgttcatcacgccctttggggcctactgctacatcaccatgactttcggattgaagaacgcgggagcaacttatcaacgcatgattcagagatgtttcacaactcaaattggtcgcaatgttgaagcctatgtggatgatgtagtcgtcaagaccaagcagaaggatgatttgattacggatttggaagaaacctttgcgagcatccgcgctttcaggatgaaattaaaccctgaaaaatgcaccttcggagtaccgtcagggaaactgcttggatttatggtgtctcacagaggcatacaggccaacccggagaaagtcaatgccatcctcaacatgaaaccgccgagctctcagaaagatgttcaaaagctgactggatgcatggcggcgctcagccggtttgtctcacgactcggcgagcgggggatgaccttcttcaaactgttaaagaaaacagacaatttccagtgcggacccgaagcacagaaagcctttgaagatttcaagaaacttctcacactccaccagttttggcctcgccacacccacaagagccactattactatacatatcggccacctctcaggttgtgagtgcggtcctggttgtcgagcgtgaagaagaaggccatgttcagaaggtccagcgaccgatctacttcgttagcgaggttttggccgactccaagacgagatatccttaggttcagaagctgttgtatggtgttctaatcaccgtcaagaaattatcccactatttccaaggccactcggtcacggtggttacatcgtttcctctcggtgatatactccgtagtcgcgaagcaaacgggcgaatcgcaaagtgggccttagaattgatgtctttggatatatctttcaagacgcgaacttcgattaaatcccaagcttttagccgactttgtcgccgagtggaccgagtgccaagaagacacgcccgaggaaaagatggagtattggactatgcactttgacgggtcaaagagactttcaggcactggggctagagttgttttaatttccccaactggagaaagactgagctatgtgctatggatacatttttccgcatctcacaacgtggcagaatacgaggcactccttcacggactacggatcgcgatctctttgggaatcaggcgtctgatagttcgtggagattcacagttagttgtaaatttgaaagagtggtcttgcctcgacggcaatatgatcgcttatcgacaagaggtatgaaagttggaggataagttcgatggactcgaactcactcacgttcttcggcacaataatgaagcagccgacagactagcgaatcttggatccaaacgcgaagcggccccttctgatgtgttcgtcgaacatctttatgagccaacagtgcccaagagagaaacgggtgaagacgcggacattgaagacatacctatggtcgaagccgactagagagagcctctcatacgatttctgacctgccaagaactccgtcaagataaagacgaagccgagcagatttccaggcgtagcaggctttatattattcatgagaccgagctgtacaggaaaagtccatcaggaattctgcaacgctgtgtatccttagaagaagggagacaattgctgaaggacatacattctggtatttgtggcaaccatgctgctgcacgcaccatagtcagcaaggcgtaccggcaaggttttttctggcccaccgctgtgtccgatgccgacaagattgtgcggacatatgagggttgtcaatttttcgccacacaaactcatctgctagcccaagagttgcaaaccatcctgctgtcctggccatttgcggtttgggggcttgacatggtcggcccgttcaaaaaggcagtcggcggttacacacatctctttgtggctatcaacaaattctccaagtagattgaagctaaaccggtcatcacgatcacggtagacaaagctagagattttttcatcaacattgtacatcggttcggggtacctcatcggattattactgataatggcactcaattcactggcggagtatttaaagatttttgtgaagacttcggcatcaaaatttgctatgcctccgtagcgcatcctatgagcaatgggcaagttgaacgagccaatggcatgcgactccaaggaataaaagcacgagtttttgatcgcctgaatccttatgccggcaaatgggtggaacagctgccatctgtactttggtccttgcgcaccacccccagtcgggctacgggtcagtcaccattcttcctggtttatggagcagaagcaatgttgcctagtgaagtagaatttgaatcattgcgttttcgcaacttttgcgaagagcgctacggagacgaccgagtggatgacctacaccgactggaagaggcccgtgaagcagccttaattcagtcggcccgatacctgcaaggtttgcatcattatcataatcgtaacgtccgatcgcgagctttcttagtcggcgacctggttttgaggaaaattcaaactacacgggatcggcataagctatcccctttatgggaagggccatttatcatctctgaagtcactcggccaggttcctatcgactcaagcgtgaagacggtacacctatcgacaactcttggaatatcgaacatcttcgtcgtttttatgcttaagtttgcttctgtgtttccctgtcttgactgacaacatcaagcttccccttgaagttatcagtcgggggctattataataataatggagtgctgggatttggtcatcgccaacgccagactttgatgttcttgaaatatgtatccggagcaactctcagcttgtcgaagatttcggaagcatcaagtgtactcgggccattgttattgaagaacatcgcttggacgtcctttaacgctgagtccctctgacttgccagctctactttatcgttctccagagtctgaattcgtttctccaattgagatatcttggctgcttgcactgcatttgactccaattaattgaagttacaaagatgacaacataagttagtcagacagattttgtgtataccttttgacgagccacttagttcgaagttagactcctggagctaggcaattcgatctcttagatcgtgctcggttttcttagctagttctttggcctcgtgcagttgatctctgacagcttccagggttccaagatgaggaactagtttctctagggttgcggtctttgcctcgttcctaaggtgaatcctctgcaaaatggttttatcggcgctcaagctagatggcaaacaagagggctgaggtcaggcgtcaaggaacttatgtttacaatacgagttgcttggctgagtgcctttttcagtaggcaaacctcttcgtcttctttttgcaggtttattacaattccttgaggttgcaagtcatcatcccaccacttgaccagaataggagggcgcgagtcttcagccgcgcgtatccggggaacttcctcttcctcaccaatcattggtcgtgatgtatccatggataaaggtcaaacgatcaattaaagttggctggattaatacggtttcaggcaaggtgtttacccgtgatgatttctagacgaggacgagtgggctcagatgcctttgaaggagatccagacctccggtcattgctagcatcatgaccgcgagggctatctgcttgggcttcaacttctggaatctcttggcttggccctgggtccgattggtttccagtcgagggctctcgactcactccggcttcagctttggccgactggcttctagtcggggtttgatcgccggattctacattgtcggttgccgactgattgtcactcggatgatcctcagcagtcggcccggcttctttggaagagcttgttttcatattagccggatcagagtcctttccggaaggatctatatcagatggtttcctgcatgtttttgttatcagtattacttccatgctgggtgcgcattaatacaaggaatatcgttatatgagttgtacctggaagacttcctgatcttcggcgcaggacaactagatgttttcttctttggaatagcttgttttggcaattttctggttgtttctctatctccaggcttttcaacgtcgtcgacttcgtcgtcactcagcactaatttcctcagcccggaatctgactggccggctggattagaggtgttgggctgggtttcaggccgtatctttggtcccccgctcccctgaccagtgtgacggcgaggtgatcggcgctgagcgattgggggatctgacttcatcagagcaaattcctagatataatatctcccactgtcaattgatttaacaaaaagacaagattatatttcgaggaagattgaagtgtttgagcacataccggtggaggggggttgaatgcattgaatggcacaactggcagcagatgtgaatagctgacgacaatcgcatttgagaagatcttgtacattctttccttcatgaccttgaagtcaaagggagtctggatcttcacgatttggatcatgtttgccgtcaaactcaaaagtcgtgcgggatctctctttgattggagctaatcgacttttgatgaagtgccgagtgatttgttctccctgcaagccttgttccttcagctttagcatacgttccatcaactccaccgcctgagcagcttcatctcccataggcaatgaattccatgtgtcctggtaaactggaggaagacaggagtactcggggagtgcaggttcaggattttaaacgtaaaaccagtttgcgtgactgcctttgtttgaagtcttgaaggcaaggagaaatacttttggcttagtgttcctctgagttagaagccagcgcccccaaccacgcatggtttgctcttgttcggttggggcttgaggaagaagattcggcggaataaggcgaaatgaggcctaatgcccagaaaagcttcgcaggcatgaatgaaattggcaatgtgcactatggagttttgattcagatgatgcagactaattccatagaagctcagaattcctcagaagaatcttgaagttgggagagaaaatccaccataaaagaagtgagaaaataccacgacctcgtgtgtatccggggttgggaatgcttcgccgaatgccggtcgccacccgatgatctctttcgccggaagaacgccgtgcgccaccatttccttcagattctcctccgtcacatcggagggcgcccactgactctcgaaactttctctctcttccgcgatggatgcaagtcgaatggtatgattcggtctgagaaatagctagagaggaatgggaaattggtgcggtgggcgcgtggagaagtttcgtggatttttgagattagattggggcggattgatgaacccttgcttcgtcggcgcggttttgaactgtagcaagaagtggggaaatggcgagagtttcaacggggaagacgaagcgtcgcttggacttcggtgttttgttagggtatcgggagtgctaatgggcttgggcctatacagtacttca

SEQ ID NO: 80493 - DNA, 5764 bp, Oryza sativa
tcttgtttcgacagttttgttttacttcgttagggtagatagttttggggaaagataacccgccctgtcaccaatataacaaataatatgtaggattttaaatcttagcaggttgaacgtttctgaaagtaccggtgattgtacacatgaaatagtaatcttagagattggctgaaaatgttaaatgcacaagtgttttttacataaagatgtgttatatgtttaccctaaaagaatggtgcatgatcgaaaaatcagctatatatatattatttatttctttgtgtaaacccaaacatgtgttactcttttaaaatttatactttgtataactacagtataaaaacctgacacatggaacaattgaaatccaacaaacatatttagtgtttaaacaatactgttggttgggagtattacccacatttagtcattcattaaatctgaatattaaatctcatatcgtctagcaaaaatacttctcatcctacaattaaataacggtaatcaaacaatttgcattcatagaatatatctggtggatatgatcatatctggccaatatgtaacacggaagcattaattggaatggatagttctttacctagtaatgacatctggcaggattggagtggtttgcaaagttacattcctttttaaaaaaacatattcttgtttatataacatgataatttgtgtgcagtcaaagtaatatgtacaaaaccaaattattttatgatagctacctttagtacaaatggcattcagaaaacatatttgacttttatttttcaaatataatcactatcagaacacagtatgttgcatatcaataatatatctcttgctaattcattaatctcacttataagttctaacattggaatgcgagaacataaaaaattaatttggatcaaaacctgtatactgtgaatccttgcacctttgggtggctagctagggtcatacatgtgatgcagtattgggatctattgagtttttccctcccatatccctttccaaccaaagaaaaaagaaaaaaaatgcatgttggttatttgtaaaatatacatatatatactaaatttattttgttgttcatatgttaaatgaaattatttttttgctcacattgcagtactaccgccacaaggattacaatcataaatttcgctcaaagcctgaagttcaatattttctagatactggaaaggttataattccgtaaagttccaggcattctacagaaggtgccatgctacaacagtgtttcgaacattgtattctgcataattttccccttccaaatttgatactgattcccacacgttctttttgtacagtgatcagttgatgcacgtgttcctagcaggggcaagatttcatcaaactgtactgcagcttggaatatttaactccagaggaatacggaataccttttcattatatatgggaatcatatgcacgtgttcgcggatacgaattatgtttttagatgaattatatatgggaagacctgcacaatgattaaaatatttgattaaactgaatcagtacaactgacagaaacaataaatagaaaaaatatataacaccattcatcattaatatatatgtatagatatatctaattttatagacaatggaatatcattgcggcattttctcatatatataatggaatatatatccatacaagacattttagattattttcatcttgctagcttgtatatattgtcaaacatttcttaactgctatagagacattatattactcactgaatcgaactgctatgacatgtgcacacaggtcacgggtgccacgcccatacaacgtactccctccatcccctaaaaaacaaatttagaactagatgtaacatattctagtacgatgaatctggacatatatatgtccagattcacagtactaggatatgtcacatccaatactaggttgattttttatgggacggagggagtaaatgctcttctcgtctactacatgacgctcgggtgtacgaggtgtacctgcttgacgtacggaaggccaagctggatcagcggccggtcagattcgaccactgccactactactactagtacgccaccaccaaggagtggcaggtggtgcagccgcgacaccaacgccaccaggtacatgctggtgacgtagtctacaccctgtcctcgcactacccgcagcctggtggcgctcgacacgaatatgatggaacgatccctcgtgatccctagttgagctaccgaggttggtatctgcgggtgtcagaggtgtacaacaaagaacggagcttcaaagccatggagatggccggcgtgatcgggctgttcgccatagacgacagacgcctcatcctccgtgtctagctccggcacagctctggaaggtgacgctatgggagctggcaaggcaaatccctccctttgcctcccgccactgcccccgccgctccttccctccatgagctgccactgctccctccctccacgagttagcgaagccacaagagagagagaggcgggatacaagagatgaatggatagagttaatatgaacggataggattagatgaggatagggttgcttcgaggctattctggtcattatgaaaagttattatatttcttttctttttgaaaagtaaggtcaaaaaaagcaaactaaaaaagtaggataaattagtagttaggcttcgaaacagagtcaattaaggaattgtcccatatatctggtatctttccataaaaggcggcaagatacaactcaaaacaacacatgcatgcttttcatatcatgtttgaattgcatactttattaacagtgcaaaccctcctgtaccaccaactgttagtaaaaaaaaaatatcacacaagtacttgtaccagtactagtactacttcactatgccacccactccactcacttttcttcaccctggagtcgaattttcccccaatcttttccccaagaaacagagaagccgcagcagcgatgagctcatggtggtcttggctcatcctcttctcctccttgggcaacagagggggcagcaatgccgacgctttctccggatccagcacctcgtcctccccctccccccccatcccttttccccaacaagcagtagcaggggcgcctcgctggcgaagcactcgcacgatgaagcctcgggacgacgggccgaccgatgcctaagccaaaccctctcaatcgcagccgcagcctgtgccccacaagaatcgtccttcaccccgaaaggccacgcccaaggcatccaaggcaaaggcgcagctgcacctcggcgacggtgagccaaagaaaagctagccccgaccccgtcttagaagcacaacaacaagaggaagcgggtggcgagatttgagcgctcgtggtccagggccgatgagctcaggattctggaggacatgtccaaccacgccaaaacccatcgcggcgctctgccggataccagcgatctctttgccgcccttgccaacagcctcgacagaggagatgccgaccaggccaagctcgctaacaaagtccacatgttcaagagatgatatggcactgcacgcctgcagcaatgctgctcgactgaccatgatgatatgcgtcgattgttagatcatggaacagcaccagctgcatctgatcggcacgaaggtggttgcgcagcgtgctgcacttgagcctggaggcagcgtcgccgccgggggtggcagtggagcttctccaacgtgcatcaagttatttctctacaccatgccatggcgatgggagccaccttttcttcctccttcggaacacgagggaaatgcagtttaactagcaatcttatataatccaccatctcccagcattgcaacaatcgcatgaagaaataatctagttttctttttgaatgtactatatagccattggaagggtgtttttactatacctcccactaacgggtgtactagtgtagtaagaataaataccaccgttgattttggtattaaggtggaagaataattaagtaattatacttctatgataggctgatgcttgccagctgcctagcctaaaagcgttcagcccttagctcacgaagcagaaggatggtcactgtaacgctcctggccagcgtccgccatcgatcgttgcacttcccttcttcgcgtaaacacggggatgggcacacggcggctcccccctcccaactgcgctgccaacaactggcacccgtccttgcgtagagtgactattataaaaccagccccgcaatcaacatcggtagttaaacatggaagaaacattataggagatccaaacacgatgacatcaccgaggcacgatatttgataacggagttcagccgaggcctacatctccggggtactgattacaggcgctcctccaccatccagcatattacagtgtatcagagttacaatgagacgccgccgccgtcactagtcgagagagagagagacgagatacgagagatgaatggatagggttaatctgaatggataggattagatgtggatagggtttcttggaggatattctgatcattaggaaaagttattatattttatttcattttttaaagcagggtcaaataagcaaactaaaaaagtagggtcagattagtagttagattaggcttcgaaccagatcaaataagaaattctcccatatatatggtatctttccacaaagggcggcaagatacagaacatgcatgtttttcaaatcatgtttgaatttcatacttttattaatagtgcaaactttactgtgccaccaactctcacgtgggagctcgagagcacggtaaaaaaaatcagacaagtactactactatttcactgtcccacccactccactcacttttcttcaccctaaagacgaatttcccccaacattttccacaagaagctgagaagccccagcggtaatgagctcatggtggtcttggcacagcgtcttctcctccttgggcaacggaggaggcagcaatgccgacgcttcctccggatccggcacctcctcctcccctcccgtccctcaagctcaacaagcagtagcaggggcacctcgccgttgaagcgctcaccgaagaagccttgggagggctagccggccgaagccaaatcccaagccaaaccattgcaattgcagccacagcccacgccccgcaagaatcatccttcaccccaaaaggccacgcccaaggcgtccaacgcgaacgagaagctgtagcttggtgacggtgagcctaagaagaagccagcctcaaccccatctcagaagcgcaataacaagagaaagtgggtggcggcattcgagcgttcgtggtgttatgaaaatagatgcacaacggagacacgaatttttacgtggaaaacccttgcgggaaaaaaccacgggcgccgaccggcaatgatcactatagaggagatgattacaaacgtaggggaatcacaatgggaacgtcaacccttcccgtacggcttacaagagtatatataggggataatagaaagacacctaataggactcctactaggaaactaatccgaatatattgtgggcccaaaattcggatcacatatttaacaatctctaccttgagacgaatttcctcttgtagcataaaaacatcaatcaccaaaaatacctcatgtaggtaaaatcaccgcgcgccaaatagtctctaggactatactgtaacacccaccaagcttg

SEQ ID NO: 80494 - DNA, 7521 bp, Oryza sativa
ggcggccgaactcccaactagtggatccccacaaatttcgcaattagggtttttaggagataattttcccgctaggcgccacgacggaacgggcgctacagaccaacccccctaacaagaatctcgaccccgagattcagcacctaagggagcagctccgggaactcggcgcggagaagatcttctcgctcccaggttgcctcatcttcagaatgattgctctattggactttgtagaacttgatggtcttctttcgagtctgacgttctgcctcttcaagaaccttggtcggtctttccttgtaagtcagattcttttccagctcgatattacccagagggacttgctcttctggaactcgaagacatttcttcaactgagacacgtgaaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcctccgattgtcagcgtaattcttctgacggttttgcgctgtctttaaacgttctcggattagcttaacttgttcttctgctgccttgagtatgtcaagaccgaataccagcgcttcgcccacctcattccagcacaagggagtacggcactttcttccgaaccattgcctcgttcggcgacatctgtatgctagcctgataactgttgttgtatgagaactccgcatacggcaaacaacgatcccaggtgccttcgaaatccaaggcacacgcacgtagcatgtcttctaggatttggtttaccctttctgtctgaccatcagtctgcggatggtagcccgtacttaaatttagatcggttccgagggcttcatgcaactgcttccagaaccttgaggtgaactgagtgcctcgatctgacacgatcttcttgggacagccaaatctacatacgacatgggtcatgtagagttctgctagtttctttccatcaaaggtggttttcactggcacgaaatgagctgatttcgtgagtcggtccacgattacccaaatggagtcgtacccgctaggggttcttggcaaaccggtgatgaaatccatcccgatctcttcccatttccactcgggaatcggtaggggctgtagcagaccagctggcctctggtgctctgccttgactctttggcaaatgtcacacagggctacgtattctgcgacatctcgcttcattctagcccaccagaaatatgccttgatatcttggtacatcttcgtacttcttggatgaatggagtaggcggactcatgagcttcctttaggatgagatctcttaactccttcttggctggtacacagatgtgtggaccgcaccaaactgtgccttggtcgtctatggagaaattggtgtctttcttttcctgtattctttttattaactcttttatcccttcgtcatctttctgagcctcccggatttgcgattctagggtaggctgtactgtcaagctggcagggacacctgactgtaccacggtcagccttaacttctccaattctctgcacaggcgatcttggtcaggccgtatttgagctacattgcaataggccttgcgacttagcgcatcagcgaccacgttagctttaccgggatgataatgaattcccagatcgtaatccttgattagttccaaccatcttctctgcctcatgtttaactcggtctgagtgaagatgtatttaagacttttgtgatcggtgtgtacttcacatctctttccgattaaatagtgcctccagattttaagagcatgaatcacggctgccaactcgagatcatgggtggggtaattgacttcatgaggcctgagctgtctggacgcataggccaccacctttcgttcttgcattaggacacatcctaagccttgtcttgatgcatcacagaagatctcaaaatctttttggatatctggcaaggtgagaactggggcagtggtcaacttttcttcatttcttgaaaactgtcttcacaggctgcagaccattgaaatttcctttccttctttaatagctcggtcataggtctggctagcttagagaatccttcaatgaatcttcgataatatccagctaagccaaggaagctgcgaatctctgacacattcttgggcgggttccaagcaagtacagcttcaaccttgctgggatctacttcgacaccgttggaggagatcacgtgtccaagaaatgctactcggtctaaccagaattcgcatttcgagaatttagcgaatagttgatgatctctgagcttttccattatcagcctcaggtgttcagcatgttcttcctcattcttggagtatatcaggatgtcatcgatgaacaccacgacaaactggtccagctattccataaagattttgttcattaagttcatgaagaacgctggagcattagtgagtccgaaggacattactgtgaactcgtatagaccataacgcgttgagaaagcggtcttcggaatatcttcaaatctgattttcaattggtggtaacctgatcttaagtcaattttttagaaaactcttgctcctttaagttgatcaaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttaccctccaattcttcgatttgtcttttaacttctgctaactcattagctgccattcggtagggtctttttgcaattggtgcagtgcctggcgccagttctatggcgaacacaatctctcggtctggtggcatacttgttaattcttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggacttttcagcacaatctatctgtcctttgtgcttagccaaccaatccatccctagaatgatgtccaagctttgcgagtctaggactatcggtttggctaggaagtcaacttcctcaattctaaggttaactcccgggcatacttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagggaacatacctatcacaacgtctggagcatcctaagcggtctcagcttgaatgtggttcacccggcctcgaccaaagttgttggacgcacgagaaccttgtccacttgcctgagagctaggacgagactgagctgccgctggagtaggagttctggcagtgctgccattagcatgccctaagctggtgttggtaggattctgagggcactgtctggcatagtgacccatctggttgcaccggaaacactgaactgctgacggtccctgtggtgacttgaaagaggtaacactgtttggcgcagtattgccactaggggcacgctgctgtggctgaggtgccggacggttcatttgaggacgaggggcgtagcctggctggtggttagcctgagtgaccgactggtggtattgcatgggttgaccgtagcgagggcgaggtacgcctcgggaagaatttccctgatggttagacttgcgtttcttgtattcttcggtagcctcttttctggcatcctcaagtagaagcgccttgttgatcatatgttgaaaagtggggaaatcatgagcaagcaactggagtctcattccaactgcgattcctttcaagaatttcctgatcttcttcttgtctgtgtccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgatggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtgggaaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccatcttcaaaaccaaagcgggctggtgcacgagctgcacggcgggggcggctagccatctaaactcccagaagagggcggggtaatagtcagatagcacttaggagggcaaggagcaaagtaaatagcaactcagatagcacacactaggcataaactggatttttcaaatcatagaaacacctaatacaacgggtggggacaaatcacaaaactaccccgagcttgactgcgcgcgccccccctaagaaaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctgacgcgaagggaccggcggaacctgtcgagggctggcagcagcacgggccgctggcggtgggggagctgggtagtggaaacggaacacagtggaagaaccaacaacacgcttccgcgcagtgcggataaagcgtgggccacggcgggtggaagcaactggggtgtgtccgggggtgtaggaagggctaactgggtgtgggtagggggagtacactggtgagtacggcgcacgcgagctgggggagcgcgggccactggaaggcgtggaagctgccgaaaggcggagcccccaagacggtggctgtagtcatgggccaggcgacgaagcgcagtccaggagaggtcctggtactcgatctggagagtgggcctggccacggtgaagtggtgtggacgagggccagctccgtgtatacctccacgggggtaaaggtacacagagagctcacagtgagggggaacacggtccacggagtaccccgtgtactcgggacacgagaagccaaggaaacgggcgaggtcacgaagctaagcgacgtggtgaccctcaccaaaaccgtgggagctgaagctggcgctcactgccatctacaattttgaaaaagggagaaaggatcagtaaccatttttagaaacaaactattgaaaataaagaaaacaaaagaaaccttagcttttcgcaagtagtttggaacttagtatccttagggtcgtcctaggcgtcgggtttcgtcctagggccaagcttgtgctctgataccatctcttgtcacgccccgaactagtaccgatcggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggcttagaccaaacatcacaggcgcgacttgggaactaggccgaaaccctaaaactcaacgtagccggcttgctcctggaagaactcctcatcagccggatccgcttcatcttcttcagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccaagaaggcggcccaagtgcgcgcgcgcgggaggaaaggagagagagggccggtggaccgggctcaccgtgcgcggtcccgggtgggacccgcttgtcagcggctcggctcaccgtgcggagggagcacgcggtgcggcgctagggtggggaagggacgcggtgcatgcgcgcggttcgcggtggacgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgccggccggaacggacggcggtcgacagcggcgagcgacggagcaaaccatggcgatacaggcaaaagcgagtacaccgggtggttgcacgtgacgaggggagacgagccaacggctcggatttgccgggggttgctcgacggcggcggattgcggcggcggtaaccggcggcgggagaaggggaaaacggcgacgaggtcacggggggctaattcctggcggcgagagcatctacgcggctacgggaatccgatgctagcgtcggattgggcggagctacgccgtgcgaggccgacgacgagcgggtgctacggagcacgggcggcaacggcggcgagcacacggcgagcgacggcaacggtcgggacggcgccggctaactacggggaggctactcgagctactaccgaaagctaagggggggagatggagcgaggaggaagaacggagggaggcactaccgtgcgggacggggcgcagtgacgagaggccgacggcgcgggagtaatctctccggcctcaggccggggaagaggaaggagatggcgcccccggagtcccctt

SEQ ID NO: 80495 - DNA, 852 bp, Oryza sativa
tcccgccggcgccattgatggagcccgagagcgccgcgccggtttccttccaaccctatttgaaccctccccgcacctcctccgtccgtttccgcctctcggcgcccttcctcctcgccggatttgagctcgcgacgttgctctctctctccgcctcgccgccgagctccggtccgtctcccacctcggcgccgcctccttcggcttcgccgcatcctcgccgacctcgtccacctctccgtttcggtcgccgaccgccggagcgccgccgtacccgtcgacccgagccgcgccaccgcctccctccgctccggctgcctcctccgtcgccgccgtcgccctggggtgagccgtggaccgtcgcctcctttcccccttccctcccctctctcggccgccgctccaccgcgccggtggtcagcggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgc

SEQ ID NO: 80496 - DNA, 4968 bp, Oryza sativa
cagagatggcacgttagtcctggtcagatatatgccaggcttcatcctaaccattacaggcaagatgttgtgtgaagaagggtgagcatgtaggttgctaagctgacacgtggtggacaagaatgaccgacgtgactggtctgataccggtcatgtcgtcagcagacagccacgattccacgtcgtgcctgcttccggcggaagtggaggtaggtatgggccgtcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgtcgtcgagctcgtactccaccgccacctccacgccaaagtcctaggcgggagaaggcacttgagagggccgaaggatccgcgacttcgacatccacaggaggtggagaagggcggcgagatgaggagcgtcgcctcctcgtctacggcaacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcagtcctccgccaccaaggcctctggtgctgctgccaccggctccgcatcgtcaagacggagggcgcggcgagcggcagccgctgttcgccattcggccgccactccttcgtcaatggctccgacccgggaagatctgcgtggggaaccggatgcccgcatcagtatcgagcgtcggcgtaatggccgacgtgctccccacgcaaaggagggcgcctcctcgtccggagtgtcgcctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttctcatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaaggacgaggccggcgctcccaacagggaacgcccaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaggtttccaagagcctggggccaccattgctaccgtcgatgggggagcgtgtgctcacgtttctcgccggagcttcaaggccatgaagcgagagcttctggccacggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgaagccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggagacccgcgttggtgaagttcatggcggcggtccactacgcctacctacagatgaagatgtcgggccccggtggccccatcactgtccatggcgacctcaaagtcgcgctcgcttgtctggagcagcgcacggaccacctcgccgctgcatccgagcccgagggtggcgacaagaggcttggcgcctccgcccccgccaccccgaggcagcggatgatcacaggcaacgaggtcccggtcaaggaggttgccctgggcgacggcccgtccaagaccacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctatatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacatggttgtgaagacgcgcaaccaggaaatgttactctcagatctagcggaaactttcgagagtctccgctccgcccgcataaagctgaaccccgacaagtgcgtgttcggtgtacctacgggcaagcttctcgggttcttggtcactgcccgaggcatcgaggccaaccccgagaagatacgaggctatagagcgtatgcgcccccccagcaaacttagggatgtgcaatgcgtcaccggttgcatggccgccataagtcggttcatatcgaggctgggaaataaggcgttacccctatttaagctcctcaaatgttccgggccgtttacttggacggaggaggctgaacgggccctcactcagttgaaggcgtacctcagttctcccccggtcctggtcgccccgaaaccagatgaaccgttgctactttacctagcggcaaccccgcaggtggtcagcgcggcgttggtcgtggagcgcgacgaggacaaccctcgctccgcgcacccccaccctgtatcgactcgacccgggagagagcaaggaggagagggccccgagccgaacggcggcccgaggcccccgacggccggagctggccctctgcccgcttgtctgacggtgccaggcgcccccgaccctcaggatggccccggggccactgcgggaaggccgcgcttgtcgccctctgaccccgaggtcgtcggcacagaagccgagtgcgccccgcgcggcctctcggacgaagagcaccctgtatcgactcgacccgggagagagcagggaggagaggccccgagccgaacggcggcccaaggcccccgacgaccggagctggccctctgcccgcttgttcgacggtgccaggagcccccgacccccaggatggccccggggccactgcgggaaggccgcgcctgtcgccctccgaccccgaggtcgtcgacacagaagccgagtgcgcctcgcgcggcctctcggacgaaaagcaccctggagatgcggctggcgaagaggatcgccccccccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctct

SEQ ID NO: 80497 - DNA, 6023 bp, Oryza sativa
acgccggctccactagggacgagtgtcaagaggctctcatcattcgaacgggacggggcgaggcgtgtaccaggccgcctgctgccaccataacccgcgatctgaccggtctgtgaccggtcacacactgcgaccggtcacggaccggatatgcgtgcgccgtgctgcattaaatgcggcgtggcgcgcttgtccattccgcaataaaagtggtttggtgagcgccgctgtgcccacctaacccacacccgtggcgccaataccacagggggtcggggcgccccagccctcggggccgaaacaggagcggctcgacccctcggggagacagaggagggggtgggcacgtccccctcgggcccgaccctcccgagggggttaggccacgtgggtgaccgcagctgcccaagcctctagtcatgatactcccggtcccatgtcaccgacagtagcccccggcgttatgccagggcgatcgcccccctcgagggaagcgctcgggcgtgacgccactctttagacctggtgacaggtggggccgctctctacaggcgggcaggaacccagcggtcgcaaatcgcgtgcatcggctagggaaaaacgaccgataacaatgagtggcctcttcaagaccgttacattactcgagtagcgcgcgaatcgggacgagcaggttcatttcgcctggagatatgatgatggcgcttcggtcggcgagcgtagttaacacgcgcacgatatgtcccatcttgactgccacggccgcacatccgcctcgtgcgccgcaaacggacgagtaggattagtggaggcgtgggcgcgagaaacgagggggcgagatagtgggcgcgagaaacgaggagccgggcataacgttggcaagggtataaaggcgccaaggaagagattcgtttccttcctctcgccattattccccttgccttagccgcttgcgccctaactccttgtttcctgtgccctacccttgccgcactcactcgttctcaagctcctcctccgccggcgtcatggtacggggctccgcaccgctcgacggtagcgtgctgacgccttcccgcatcgtgagcgagaggcaggccgggctgccgtgccgattcatgccggaatctgccaccggccgggaggtggtcgcgctgggtgagggacgcccggcgccacactacccggggcggtccgtcttcttcctctctttcgcaatggcaggactggttccaccattctcttctttcttcatggatgttctggaactttacgatctccagatggcgcacctcacccccaacgcggtaatgacattggccatcttcgcgcacctgtgcgagatgttcatcggggtgcgcccatctctccggctgttccggtggttcttcaccgtacagccggtgtcgccgccgtcggtagtcggtggctgctacttccagccacgggggccggtgctgaaccgctacattccctgcgccctccgcaagaagtgggacgactggaagagcgactggttctacactcccctcgccgatgaaacgcgcctccgacttccgagccagcccccggcgcaggcctccagctggcgggcgccggtagatctgggggatggctatgacgccgttcttgaccgcctggcaggtctgcgatcccaggggctcacaggggccatggtgtacggcgactaccttcgtcgtcagatcgcgccgctccagcgacgcgctcggggcgcctgggagtacaccgggtccgaggactacatgaggacccaccaggggggcagatgggattgggctcctgaggacttcaagatattggtccaacgggtgctgaatctcaactccgtagaggcggccctcattccccaaggaatcctccccctctgcagcgttccagaccgcgcctccatcctgaccattatgatggcggtcggggcctcagaggagcgagctccaaagggccacgacggcgcaggcgggagccgcaggggggaacaatttaccccgagagggggtcgtgcttctgggtcccgcgacaggggcccggggagcagccgccctgccgacgcccgggggaagaggaagcagggaggaacacctcctccatctcctccccgagggggcggggcggcgcgtgtcagcagcaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtgactgtattctcttaacgcgagttttcactcacccatcttgttcgtcttctggttttttcttttgtttcagcgagatcccgtcgcgtccctcccgccattccaagtccggccagtctgaggccgaggatccggcggccgtagaggccctcaggcgggaatctgaccggcgagaggccgcggatcgcctacgggaagccgaggaggccgcccaggaggccgcccgggctcgccaggccgaggaaaccgctcgggaggaggccgcccgggcccgccaggccggggaagccgctcgggaggaagtcggatttcgccaggacgaggcgatggcgacttctgaggcagctcgcgacgaggccgcgggcgcgtcgcttgggcccactccctcgggcgacgctcaggcgacaacttctggggcagctggcgacgaggctgcgggcgcgtcgcttgggcccactccctcgggcgacgctcaggaccaaccgggtccgggggacatccccgagtccggcacttctatcggcggcccgaaccgcgtggcatcctctccaaggcggctctgccccacgccttctatcgccccactgaacgcagagccccttctgcaggccttggctgccgcaaacaccacggtgttggatgggttaagcgcccaggtggaggtcttgcaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatatgggagctgggaggcggagctaaggaagaagctcgacgccgcccagggggtgcttgatgctgctgctgcccgagaacagcggcggcggagaccgaagcggcgtcccggcagcgtgaagaggcccttgaggcgcgcgccatggcgctggaagagcgcgcctgcgtcgtggagagggatctggcggaccgcgaggccgccgttaccatccgggaagcaacgctggcggcgcacgaggctgcttgcgccgaagaagagttcacactccgcctccgcgaggacgcgctcaccgagcgggagcgagctctcgagggggccgaggccgcggcgcaacagctggcggttagcctgtccctccgcgaggcagcgcaggaggaggaggcacgccacaatctggaaggtgcccgcgccgagagggccgtactgaaccaacgggccgctgagctcgaggcgcgggcgaaggagctggacgcgagggcgcgcagcggcagggcggccacgggcgaaagcgacttagccgcccgcctcgcagctgccgaacgcaccatcgccgatctgcagggcgcgctggacttgtccgccggggaggtcgaagccctccgcttggcaggcgaggtagggcccggcatgctttgggacgctgtctcccgcctagattgcgccagtcggcaagtgggcctctggagagggcggaccgtaaagtacgccgacaaccagggaggcctcgcccagcgcctctagaagatggccggggctctccaacggctccccgaggagctcgagaagacaattaagtcatcctcgagggccctcgcccaaggagcggtggagctcgtcctggcgagttaccaggccagggaccccaatttctctccatggatggcgctggatgagttccctcctgggaccaaggaccgcgcgcgcgcgcaggtccgggattcctccgaccatatcgtcgacagcttcgagggctcggcccctcggcttgcgtttgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggctcgtgcccaggttctggtcctcaaaaggcgcgggtcggggctagtgcctggggagatccacatgtcgagactggccaggccgggaacgtggtgaccgagggttatgggtgacccgattgtgggtttttgccgattccccccccggagttcaccacgcctcggggcacggctcggttctgggccccgttcggcgattttagccgacccgagcccccgagggcaggattgagcacgagtgacctatttcaagtcaagattcttcaaaaggaaaaaacagtacagatacagcctttaggaaattgaaactgcttttattgaaatacagatgtaagagaaataagaatatgcatatgttgtaggccccggccaaccctgcacgcccgaggggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcatttccccggttgctcggcttggtgtagttcggtttgcccagagcaccgctggcaactcctcgatccatgaatcgccatacttcttgactatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaaagaatttaagtgcggagtgcttatcgatcttgacgaccggataagcctcgggccacttagtgaacctgtcgatcgcgacatacagatactcaaacccgcccggggcccgcctaaacggtcccaggatatcgagtccccaagacagcaaatggccacgaaaggggtatggtctgcagggcctgggccggctgatagatttgcttggcgtggaattgacacgctctacatcgccggaccaggtcgaccgcgtcattaagagctgtggggccataaaaacccttgcgaaaagctttaccaaccaacgttgccgaggcggaatgggctccccattccccttcattgatatcggcaagaaagcacaacacctttgttcccgaggaatgcacttctaggaggattccatta

SEQ ID NO: 80498 - DNA, 4686 bp, Oryza sativa
tgcatgtagtttatttagctgtcgttctagcataggcgtccacgccatatcgatgttgtaaagtctgatcctttagtcataagttgcttttttttaatagaaaaaggtcagagacctggcttctattgaaagcccgaaggttgtgctgggaaatccagacattagtttacaacatagggagggcgagacctctaacaaagtgcaaaaggactcgagcaagctaccacctctaagaccaactctaagacaaaagagacagtagggactgctgctaaacatagcagacatcagataagaaacacacaaccaagacaaaccaagacagaagacaggcagaactgtggcaaccaagacaactctaaaaacaaggaatcaacctatccccaatctattacttccagtattagcagcaacgatcttcatcttctcttctaaatccatcatcctgtcagcttcttcagcacgccctaaaatcttccactgcagtgaataagaagcaattcgaaaaggaagcattaggggagagtaaaccaactggaagatataactttgactgcataattctttgtataaattgaaaaaaatgttatacaagtaatttatatatttaaatgtagcaaatttccaaaactacatgacatatgtatcgcaaaattactgatttaagttccactgttacaaaactacgtatttaaggtacaatatagcatacaactaaagattcgattgtcaatttagctatgagagaaccgcatattttagatattagatctttggcattgttgttcttatggaacttttagaatatatatgtagttttgtgaaaaaaatatcactaattaaatatgtagtttctttaaccaatattttcatgtgtagtcttgttataaatttacttttaaagatatggttttgtgatagacattcttctaagtttgtagttttacgataaatttgcttctaaaatactcccttcctttcatattataaagcatttgactttttacctagtcaaaccaaacttatagaaaaatgtagtatttttcaatacaagacaaacttatgaaagtatagtcaatgttagatttaataaaattaatttgatattttagattcttctataaacttttttttgagaattacacagtacaatgcagacactcacaacgcacgcacactcacccctatgaacgcacgcaaactctacccctatgagtatcttcgaagactgggccggcaaatccatcctatagattgataaagtcaacacagacgccttgctgtcgacgggtacatcgcctaccactgaaaacacaaagccgttaaagccaattcgttttcatggggagtcgaacacaggacaatcaaatatgtacattatagattatgtcaatatcctaaatgatacgtaaaaagagaataggagagtatatacgttatactacattttcgtcataaacatttgtgtttggaacaaaatttggtcaaaattgtaaaacttaacatccaattttatatcagaataagcttataaagtttaataagttgtgttagtattcttcaacacaaatttatgcgcatattttctattaaaactacgccatttgagaaagtactaattatcaaagtttcaaattttaaatcaaatcttaatcatctaatgtttatgactagctaataacatgagttctttcacacagtacctacaagtcccaacaattggcaccatcgagtactagtacccaaggtttaataaaccgttttagatggggttacgaccaccccgcggtttggcggttatcattggcaccatcaagaactataacacagggcttaataaaccgttttggatagggttaccgtcacctcacggtttgacggttatcacggtaaccgcgaaaaccacacggttatcgtgaagtataccgtggctttaaaaactgaaaagattatcacatataataaccacagtgaccgtacggttttgttaaccttgctagtaccactatactacgacctacaacactcagatcttcagtaaatacaactatatatcaatcgataatctgtcatcgatttttgccgacaacggtgtattgaagatcttttcagcagattgagtagcgccatttttatttttatttttaccgtcagaaaacaaccttcttctattaggtgttgtggtgtaatatgcctcttatactcaccgataatgacccaaaaactttatttcctttcatccatcaaatctaacataaaggagagtccaacgttggacgtaacgcacgaggcaggttgcttgggcgttggcttccacaatgcatcaggagggggcaatgggagtattccgttgagaaatgtggacagatttgagatcagatcatgcacgcagcatcagttgctgcaggttgtaactcaagcagattcgactttcgatccacgagaagattgccagcgtacggtatgattaagtatagctttagtggaccattcgatatttcgattggtagtgctgttagtgtgtatctggttgtccagcctaagcctccgtaaatatccataacctgtcttccacttaattctccccctccccccccccccccccttttgttttttatctctactattataaaaattgaaaattgaagatgtttttaccggtattttgatacgtcatctatgagtcggtttttaagttcgtttgcttttgaaaatacatatccgtatttgagtcaatttataagatattcacttttggtaatacagaaggaatcatataagaaatctatttaaaaaaactagtatgctaacttgaaacgatcagactcctaactgcagctcatgattttctaaaaatatatatatccaagagatctcacagtgaatttcatcttaactaaactatataacaataataagattaaaatagatttcacccgttacaacgcacgggcattttttctagtaatattaaataaaagaacgttgtcagctttggctcttatgtttcccaaaacaattcagattatattaaataaggggaccaaaacaatgcagattatattaaataaggggagaatataaccctattaaaacatgggaagaaaataaggcctgccacctgccaaatatagaaagaaagaaagggcattgcaagatatatgggctgatgagcagatttcaatgttagccaactccgccacatgcaaaaatatgctaacaagaatcgggcattattttcatcctccaatagaatacaaaacaggcataataagggattattcggtaaataggattttcatataaaaataagaaaaataaagatagaatgtcacgtgcactccattccttatgagttttcccaagaggttttacttcatgttaagaatcatatgaacttagtttgtaagactacaatccttaggaatttgggtggatccattactatgaaacgaattatacatatagaaaaaaaatcctaaggattcaattcctataataatcttatgaaaatcctctaaaccgaatgagcactaaaacttcgtccttacttgaggtaaatatgaaatatgcatgattttgagagttaaggggacaatacatagcccaaattaattgcaggaatgaaaaaaagacgtaatagaaaaaacacatgattctgataggaatggaaatgtaaaacaaaggattataaaaaaaggaaaaaaacacaacacaagaatgaacgtttgattggaccacagaaaaaacataggaatcggataagagagataaactccaaggaaaatttccaagatcctttgtataaactaggtttgacccaacccaatccataccgtccctccaaccaaacacatgcttacagtttcatggttgagtaaaaaaacgaactaaagcctgggtgttctttctttctctttcctttgtataaaggtagactactaaaatgcctaaatataccagttcgtggcactaacgtactaaaaggcataagcaacaaagctaaccgactttaaatcctacaaatctaggctacgatgaaatgggacgctagtcatccagcatcattgtctaaactcaccattactgagtaatttttgtccatggcataaaaccgtatgcaatagcacttcttcaatcgcattttgcccaggacagactatagagcaccagggatcaacaacaaggggtactctagtcgttcggtccacaaggacacagttcacgacgctacgagcaatatccacacaattacgaactaaagtatgcgcacatgccccccttgaaccgtgtttctttttctctgctcttggtccagtggagtcatccccaattcctaagtacaaattccgcatacttcccagaataacaggtgtgtagcaactaggaagggtatttcacaacccgctggactaactaaacaaatgccttcacaggagcaaatcatggatcgtacgttcttacattgcatttacagtaccggtgttcttcctgggtgaagcacagtcactccattttagtctcacattaatgctgcaacaagataaaaagaaattgagttagctatgaatgatgaggttgaagaaaacttcagtcatgaaaaatactggtttggttcagaaattcgttgcttgaactaacagagtgtaactacttctacgaggatgcaattttgataaaatttac

SEQ ID NO: 80499 - DNA, 11521 bp, Oryza sativa
caagcgggggcggggcggcgccggcgccggcgcggcggcggtgctcggggcgctcgggctcgggggcttcgcggggcttcgaccttccaccgcgcggcgcccgcgggcgaggccgagctcgagcagctcgccgcggcgtacgaccgcgcctcgggccgcatttccgtctccatccgcggcgcgggcgtctccgcctcgcccgcggacctcgcggccgccctcgggctgccgctcggcccggccgcgctgggccccgaggtggacgcgtccgtgttccgctccgaggaggcgatcgccgccgcgagggggttcctccgcgatcgcgtgctgctgggaggcggtggtggtggtggccgggagttgccgggggaggctgcggtggcgctgcggctggtggaggaggggaaggcttacgcggtggattggtgccggttgttttgggagttgctgaagatggatttggtgagcgggaagccacggcgctacgcgccgcacctcctccgtctgatcgagtaccaaaggcccgagcttttcgccgaggttgatgggagttcgcctcttgggaaaagaaggaaaagcgcggcgttttcgcggcaatgccagtgggaagatgaaaaggagacggacttgattgacgcagagtgtggagattctcgtacccaggcggctgaagcagaggtggagaggagcagccagagcattggagacttggaggagatgccagttttggagagcgcaagcaattcaatgctgttgatcttgtgggttacaaaagttcaattgttggattgggggaatggatccatggagtgaacgagggaaatgcggagcttggatctcagaaaagcttgccttcagaaatcgaggtttcgggctgtgagatgggaggtaatgctgctgctggtttgaccgccaaagatcagagctcgaatgattcgtctctccttagccttcttcgcacaatggatgagcaagatgactcctcaagccatcagaatgtgatctccggggccaagccccaaccagggccaaatcagcagagcataattgagatcgaagatgaagaggatgacgatgatgatcaggtgggtgttggtcatgtccctcccaacattcaaaatggacattttggcctcaacaattattttgtgcaacagagggcaacagaaggctttcaaaatgatcaaacgcttccatctttccttgcctgcacacagcaaattaaagcttgcatggatgacaacttcttggataagatgaaggctctcatggatgctcgagctgctaaccagcgcatgattaacatgataacacaaaaggattatatgattgcagccaccaagagggacatactggaggatcttggagcaaggcacgttatgatcagtcaattcgaacatgacattgaattgatgcgtctcaccattcaacaataccgaaagttgtttgagaacacttctgctgcatatctagagtataggaacaggatgtcacgtgaggagggtgatggttcatctctggaagttattggcatagctgatgagacggagcaatttgttaggatgcagcaactggacatttatcagaggcttaataagtttcaaaagctttggctcacgaaatattcagatcttgttgggcatttgacaagagtagcagaatgcatgacatacctcagtaatggactgcaaagactgaaagattcaacaacaattcccgaccttaacaatggcaagcctcaactatgaattatgtcttcatatttccattatcctaaaaactttagtaaaccaactcatttttgttctacccgcaggcttggaaggcgaagaattgggcaaagaattgctgagtaagacaaaagatgcagagcgggaaggtgaaggggatcattgcagtagcgctgtagtggtgagtttaggtcttgtgctgctgaattttaaagtacattgaacgattgctgtttgagcaatttgtttagccaacgcaacaaatatttgccacgacttggaaatttgccataaaattgcttgctacttccatcaaaagtagatggccctgaggttttttatccaatatgacactctagctaattgcactgaagcttcgaagcccaattactatcaaccccctcgtttagcctcagcttataagcataagcgcagatttaaattttaaaacttaattttagagttgattttagggttttccgtataaattatttttaatggctaataagccatttcgctaatattaagttagtataagccaaacgtgtgtttcgtatctttcttcagtttttctttggcacaatgccggagcataacatgtcatgatgctacggtgctggaaggaaagcagacatattcagatcctgacattgcacttactttgcagatagatgaattagcacaacctgatcagaggaatgataaggagagcatgattgtcaatggagtttctggaatctgcaacgaagatgaggtgtagcttcacagggcacaagttagacaagaatgttctgttgatgggtttaacctagagtcagttaattgtctagggtttggtcatgtgggcctcaacagttgccctaattaattactatgttaaaatggtttagccgtggatattggatggtactgtgactatggtcaacaactttgtgcatgaatgacttctggcaccttgctatttttatctgtttcgagtcctatggacaagttcctctgcatgctggataaacacgcacgccgttgatttttctgtccctaggaatcactgtgggatctcttcgaaacctcataaacagtcactcttgtcttgctcggtgattcctttataagatattttctcttaggctattcacagtgtaagcaccggtggtagggtcttagtccaaaaaattagcctaaagacaccattccccacggtacaaggatcctattttacgtgacctagttggatttagacactgtacaaggaaaccggcacccacaacgctcgtgacctggtggagggtagcgaggggaccgaaggaaattaatttcctctcctacccccgtcttctcctctctttctcctcctccttcgtcttcttcgctgcctcctcccactccgcctcagcgcctccttctcctctcccacgccgcctcctcctatcgtcccaagcagtagttggcggcgtggtcttccagagttgcggcggtcgtcggtggcgacttcggtggtcttccggaggctcgccggcacctcctctccctcgatcttggcggcggctcgccggtgcgcgagcggccgccggttcttggcggcgcagggacgccggtgcgcgggcggccgccggttcttggctcgtccggatccgagttgtggtggcggttgtcggcacggggccccggattcgccgccggatttaggggtcgtggtggcggatgtggtggccgcggcgggggcagcggcaggagcggacgtcgcgacgccgacgggaagccgcggcgaggaggaagcgggcacgcggcggcgagattgttgattgttgtttttgtgcatgtgagatgtgatgcttcttggtgattcctcttgtgttcttgggacggatcgagttcttttttctgcgttcttgcttgaggtgtttcggtggcgggaagaatcatgggcgaatcagggttttctccactcgatgcggcgcgagggcacagcgcggccaagaaccacaccccacagcgtgcgcgcctcgtgtcttcctctccttctcgcaccctcgttttggcgaggtttcgcgcggctctacttgggggcgaggaggtttgctagggtgcgattccttctgccacgtatgcttcaatccgagctggcactgtgtagcaccggtccagctcaccgcactgtgagaggccttacactgcaggcagtagtatcaattggttgactatggaagaaaaccgtcttcttcagacgtcaatggcctgcctgtggttccattcatgcgggaccccttgtaggcctgtatcttcttacttctccctccattccctaatataagatattttgatattttgtttgcacggtttgactactcgtcttattaaaaaaaatggaattattatttattttatttgtgacttactttattatccaaagtactttaagtacaacttttcgttttctatatttgtataaattttttgaataagaggagtggtcaaacgttaaaaaaaatagtaaatatcccttatattagaggacggaggtagtacgagttgctgatacaccagatgagatgaggatcatgttctctgtaaagagaaaacgagcatacctggtttggaaaatggcatgaattttgatgtcatccattgggcataccttttttaaaaaagaacaagcctaatcatatcagatttttttgaataagtttactttaggttacttaatttatcgtcaagactaaaattcgtccataaaccgtgatacctgatatgacacgttctcaaaatcaatgcaaatgaggtcgcaaggcagttttgacggcaatttcgattgacgtgatgcctatgtggtgctgacaaaatcagaaaaaatcataggacccacatgttagtgagtgtttggctaaaaataaaaaattacaatgtgacccatgtcatcaaccctctacagagaaatatgtcatgacatgggtctgactgtaattttttttatttttaatcgaatactccttgacatgtgagtcccatgtttttttttctgaatttatcaacaccacgtagacatcacgttagctaaaaccggcttaagatcttattgcggtttatagacgaacttattcctttttttcccccttgcaagggttaccgggaaaaaatgttggactgggctttggcatcagcttcaactggcggcttgggcctggcctgtgcttaggttggcatgcattttggcaaaattttgagcaaggttccatttgatattttggtgattcatttcttgcgatgaatcttatgactttgtttgatagctaattttaaatcttttcagtttggctaattgtttttcttcaattgtaggttgaaatgatgtcaacattgtgtttgaaaaacatgaaactactgtgagagaattaacagttagataacatataatgtgatgtctaaagataatttgatttcttaaataagttattatactccgtaatgattacaaattcatttttcaacaactttagaaataaacaaatcacaacacaacatgataattgccaactaggcccaagtgcccaagttgaattttggattctctggcccactttttccaatatacatttggattctctgtcttgcaagaggcgagtcaaagaagcatgatagggtaactctcagctaatcttggccatccaattaaagatgaacggacaagataatactcctctgtgttcaggtgcataaccagcaggagatagtagaatcaatatatatcgaatacttttcttgtcaaatgtatcacgtctatttgtagtattatctataaacaattgattattgatagtagaaacattttttttctactagcagtagaattataataaatacctcaaatcatttttttactggtgatagtaccatagtagaatattactaacatggatcactgtaaaagtactacggtcattcttgttaaaattaagtacccgcttaaggattgtatgtggtcagactttttagacctgcgctacaacaactttataaatatgtaaactatacttatcaaatgatatgttagccgtctgaactttcgtaggaaaaagtgcgtgtacgagcgtgttcgcttgatgcaaacattgcctctggatagggagtgaggggttatccagaatcagatcatcgcccatagataagcaaatctcttctgattgtgaaaaagatgtctgaaaggacctagtcggctactccaaatgtggtactatcattatcctcaaccatgctatcctatggcttcgtagcagtagcactgattaatcacgcgatgcttctatcgaataaccttatcctgttgcttttgatcatccacctatgggcgaatcaattccctctaaagtcctattgcctagtgccctcgattggcccaagctgcagcatcttagtataatcatgatcatagttgggagcatgtttggtaaggttctgcactcactcctgatgcccctgaaacttgtataatccacaaagctcaattaccagccatccaatttaatatgtgagtgcgatgctagcgacatcggcatgtttatctcgcccccaacacatggatttgggactaccctatattcaaaggcactgggggaggtcataagcacttatatgcacacatgtaactcgagctgaatcgcctgtctctcgggttggtgcttgcttgctcatccatggccggagtcaggcagcgatccaaccaaccaccgctcggttaatcagtcggctcgacggattgctagcttgtgtgtgtatgtgtgtgtgcacgatctttttccggccatccaaccggattcgccaggccggccggtacggcaggcgtcaccggcgactttccaagtcacagatcgctgctttcgagttggagaacaaatctgtgctcccacttttccaagcttttgagtcggaagaccactcactctctccctcccctcgcgcgctctgctcccttttgttttctttctttctttctttctttcttggcagcgtgactgcgcaaagaggcgaggcgggaagaaccgatgcgctcctgcaatgcaagacctggcacgatcgcgatggcgacgccagcgagagcgagaccttgactgtaaatatatactactatatatttcctctccttgcgccagtggagtagctagctggagcagtggagtgtggagctgactggtgcttgcatttgactcgcgcgcttcgggtgcgtgcgtgcgtaactgagcagtgaagagcactgttgttgttctctgcgttgattgggagcacttgcgatcgccacggcgcactggtaccacgttgaaatttgaaatagtagagaaatgtttgggtattgatcggttgacttggagatgcagatgcatgccatgccacccatacgcatatgtagtgcactagtgcgtacagcgtacctaccgtgacccaaaaatgtttgttcgtccgaaaatgacatgttagagcttgtaaaaatcgctgtagtccaaaaatgtgtgattttgttcctgttggtatttatgaacatggtaattggggtagaatattgtagcagaagtcaatagactggcccatttgatctgtatgaaaagtataagaaatttaaagaatttccatcctatagaagaaaatcttaagaaatctttgaaataaaggattaaatcatattctccccattgaaaacaagcaagagactctaccacgtattttcatcttcttatggttgttaattcctatgttactcctacgtgtttatcaaactactactacaatacaattttaaagcttttctgtgtttttaattttatttctagagttttttcaattcttatgttttttacaactatgtgtttcgaagagggtttaaaactaaaatgcggggaaacgtcttttagtctaaaaatcataaagatgtcaatgacaaagaaaatataaactttgcactcttttcagtgtcccaaaagataaaggtattcccaggtccaactttgtaaatctgggagtactttatcttttcagtgccgtcttgtttgctcgtcctcttctctcatctccctaaatgacaggattacctagtgtaattaaggcgtcgtcaccgtgatcatgctgtttgcagttcaaaaatatactactaggatttgtctcccttaaattgagtgaacagccgttgaactacaaaatcctagttaaatcatcctcatccaaacaagcactgaaaaggggaacacttgggcaaaaaaaaatctatgggtctcaaccgcaactcccactttgcctagagaaattccatcagagctttatccactttcccttctttgtacaaatacaagagacgggtctgctcctttcctttgacagctacaagcaccaaacacctaatggagaactttcgttctcctaataaagaaaaacacttacacacttatgtagttcatactgaaccaacatggaacgcttgatgtataaacgaagcgaaaaatgaaacaaaaaatggcttaaaaatggccgctgattattcgccgcatatgctactgctgttgcggccgcggcagctggctttccaagtcttccatttccacggcgtggactcccggctgcctcctcggcgacggtctctccctgctcagcatcttcattagcgacgcgccgagcacccgcaccggcgccgagctaccggcggccgcctcctccttctccgcgtcctgcttctcgtgcacgcacctcgccgccgccgttgacggaggcggcggcggcggctccaccccggcgcggcagaccgggcacgacgagctggacgcgagccacttgtcgatgcaggcgacgtggaacacgtggcggcaggccggcagcacgcgcaccgcgtccgcctcctgcatggcgccgaggcagatggcgcactcggtggtgccgcccgccgcgtcgccgcccgccaccttcccgtacgccgcggtcggcagcgccgcgatggccgacgggtccagcccgacctgcttgggcggcgcccccgcgttcacggtcgccagcgcggccgcttccgccgcgcgcctgcggttccggcggcgtacgtggcagacgtagaggtggaggaacagggccagcccgagcacggacacgaacgcggcgacggcggtggcgatgagccgcacgttgcgccccggcccggccgacgagctcctctcgccgccgccgaaccacgcggaccccgggtcgctcactctccccggcacggctgacgtccgatccatcgatcgatactccgcttatccgctacacgcgagcgcgagctagttggcggagctaagcttctcccttggtttggtgagatggcgcgcggtttgggtgtgctaagctgagtagtactatctggtctctttataagctaagcagccgcgcctgcttggccttggctaatgatttgatttgggagggtttagtggtggcaggtttaggtttataggcctcggacgtgtgcgactgaccgtgacgctcgcgttgggcgcagcgggttggtgagtgctcgtccggttcgtgtgcctgtcaggttcgcggttgtgggggcaaaggcggggcctcgacggtgcgggtgtttgagtttcctacgtggccattagtcccccatgtccccacgacaagatgcgacttgatggcgactcgaatcgccgcggaacacgtcggttgctcggtgcggattttccccgggatttcttagccccggagggaagcgcgcgtcgcgcgagtgcggcacggcacggcagccgcgggccatgcagccaggtgttggccctgtaggcggccgacggtgcgccgacgcagcaaatagcccccgcgatggagagacaaaggaagaggatttcatgcgagatcttgcgctggttggttggtggtgacactcggcagctgtttggttggctgtttcgtgaaggtttgtttattcattgttcacgatggttacgggagtaatcgcagcagggtgaactgagcttttgtgaactgattaattggctctccttgtatggcaacacggctgtcaagtgcctctatgtcttgtcaactgtcaagttcgttgatgtggaggagtagtacttgattggagtacactttacttctgtactaaggttggatcaacagaacacatatccgtattccaaaggcttgttcacttgtttcgagtggattcattcacggcctgatacgaaattcaaggcttcggcgccgtaccgacgagtacgaaggaatccaccagtgagcagtcgtaggatggtgccccaggtggcccatggccaggtaggataggagtatgcctcagttgatgccaatttctggcgtcgagagcactagtagagcagtgatgaaaacctgctctcattcatccagagtccgcggacgagtccgaaggatgactgtgtgagtgagcctgggatggcatgcatgcagcatggcagtgctgcagtggcaatgccctcctttttggctcaaactacagagatggagtactcctagtagtacgttcagaattgaagacaccgtacactaaagttggtgctgctgccgcagagctgcttgtatagttaagcggcagaagattcttcggctacaatactcgacaacaaatttcatcgggtatatctgcaccttgattgcctcaaaactctagcgggaatggccaaattgtttgagctcccttttatcaggtgtaaagaccggagagatcgagccagagaggtgcatgcacttgcactttctttagtttccccgttgttgatgcttagccaaaggaatgacaacgatatctgtttctcgaacttatagcatgcgaacgactgaacgagacatggctgtactgtctggcccaatgtttaacttaagaattaagcttttaattactatagttggcccaaggtatagctttgcagggttattctttgatttggcccatatacaagtatacaacatcgcgtggtccaagcaaactccatctggtcggcttagcttcgtttaattaggcccgacaatcgccctgcctgctgggccgaataacggcacaggcgccgcctcaggcctcacccaaactaaaccagcatgtttcatcacgggcaggcatcgatacagcatgattcagttctcaacaacaacaacaataacaaaaaaaggatacagcatgattcttcgcaaaggggagagaagaggaagcaatgccgcatgatcgcgggaatgccatcttttggcgcctttggcacgagcatccgtcatgcatggactccatcgtcgacatgcgccgtcttggcgatcgacgttgcaggcgcgcgctcatctccgtgtacgtacgtgttgcgaatcccccaaaacgacgcgatgcgatcgatctggtcggtagctggttagaataaggtgcaggtttcctctcgtctcggaatggctataaactggcttggccgctagggcgaaccggcgaaggatcgatctaacctagcgcgtcgcccatgtcttgtatagtcatcgtggccacaggcgcgcgggcgcgcgcaacgcggacatacggtgacggctgggacaagctgaggtgatcgagagaccggccggacgcgcgcgcgcgaggggagaagcacagatacgtttttgcggcgacggggcgaacgcgacgtgtgctgcagggcgcggcttttctcatcgcgttggacgagcaaagcaaaggataccaatgagggaggcgacaaagattttgcctctttgaagtaggctagatctgcggcggcgcgggggcgccgcggggggggggggggggggggggg

SEQ ID NO: 80500 - DNA, 2925 bp, Oryza sativa
caattcaaatccacatcaaatccaatcatccaaccttaagagaacactatatcaatttctcacttcattctcaacaaacaaaaaaacatcaatacatgcatatatgaaacatcatacaaacataaaatggagaaattcatcgaaatcgtcgtcgcccgcttgccatcgccactggcgtgaccgccgcctcctccctccgactagatctgggagagggagagggaaagggagagggaagggaggaggaggccctccggtcgtcgtcaccggtcgctgtgatcgtcgtcgtcgtcgtggtggtggtggtggtcgctgtcgtcgtcatggtatgacggcggcggatccagcctccccgcctgcgcccgagcgccgccgccaggtccgcctgtcatcgctgccgcggcgggcggcggcccctccctccggctagatctgggagaaggagaggaaggggagagaggtgaggtggagatgagaaagagatagagaggagagatggatgcagtgggtgggtgggtgggtgaaattgcttttaaatgcgtgggtgggtgatgctgtgaaggaatcgatttgtgagctgtgcttttcgctggcggatccgttttttcgctggcggatctctatagtagccgctagcgaaaacgctgatttttgctggcgaacatttaagaggtccgcctcaaaataatatagtattttttatggcggacctcttaatatggccgccagcgaaaatcagttttcactggcgcccccccccccccccccgattttctacactggctgttttttcttatagccgccatgaaaaatattttccaaaccccataaaaaatcgtttttctagtagtgtgcgatggcgcctttgccgataaaagatggccacgtcgagcaggctagtgtgggggagaggggatccattcttctctctcaccctctccccatccaacccaattgcgtggatggagctagagcgcgtcggggttcgtgcaccttcatgatggctgaccaacggtgaggcgccagagcggtggccacgtgttgaaggtttttgaatggtggtggcagcggagtgtgacaggaacctttcttgggaggggcgaaataattatgagcgaaagctatgccttcaggccggcaacgacgatgcttgtgggtgccgttttcctattggggcgttgctgtataatctaatctcgtctctcccagttactttcttcaggtgaaaaccatgtcttggccccaggccaggcggcggcggcgcgctcggcgtcgtttcgaagatcgctagttcttgttttcgctctcgcagcagttgttgtcgtaaacgtatggtgtggctgttttttcttaactaccatcttctagaactatagacttatatttttctcctgctttatcaatacatgaaactcgcacgctatcagactttttggaacagaagtgtgctgttttgttttggacttgagagcacacttaaaacgggcggcgaatctatgtggcccaccataacgttgggcttatttccgtagtccggcaacactcgcgcccgcgaccgagcggcctagcacacacactacagtctcgcacgtgatgaacgcatggcccaaatggtcgcaggcagggcctagcacacacactacagtctcgtacggtgcttgggcctgttcctgttcgttgcttcggcctccatcaactcacaagcggaaaagcctacatagttaaggcccagaagcttctttttctggagaaaggaataagttcacaggatgtccctcaacttaacagtgagatttgtgagtaaattgcattagcggtacacaaacttgtcaggtgggtgcaatttagtgtatgaacttgtaaaatgctcgttttggtgtataaacttatctgatacatgcaaactaaggctaaaatagcacgacaagaccgatttttctatgttgaacattataaattataaattagtagatgagtagacgactgtgtgcacatagtagtagaaatattatatttataaacttagtttccactttatctttctttgtttctatcccttgcatcattactcggtttttgatttatgtaatcattatgccttattatatgtttatccttcttagacatatgtttacatagagtttaaatcaacaacaagattaacaagattaaccttgccgtgcaattttgaccttgttcgcacgcaccaaacaagtttgtgcaccaaacgagcgttttacaagttcatgtactagattgcacccacctgacaagttcgtgtaccacttatgcaatttactcgagatttttttagttcccttaaccacaaaatcagaaatgtgtatccctaaactcacataaatcgtgcactcaaggttctatggcagtatataagggtggtttcactaatgtggcatcctagacaacaaaaaaaaaaaaggtatgtgtggcccacatgtcaggtgcatatttttttcttctcattctcttctctttactttcttctcttctcttttcttcaagggaggttgtcggcgttagacagggcgaggcggctggcggttttgtactcttggtttgtggtggcggcggcaggcggagtggctggcgaggggagattggccgccccgggagagcggggtgagaggagggccgagagaggggcagagcagccggcggtggagggccgaggccgatccacgagctcgcgtcgggaggagaaaacaatgataggatgccggtaggagaggagggcgctggcaggatagtgttgacgacgacgagaggatgccggcgggagaggcggtcggcgcgaagacatcaccggcgacgagaggcggagggaataagtaggaaggaggtggtggcggctagaaggggcgaggcagcgagagcagatggatcttcatctatgggcggcagcga

SEQ ID NO: 80501 - DNA, 27843 bp, Oryza sativa
gcctcctgacaggcgtgatctgcggtgcctccagatgcctgaaccaccatattagcaaggcaggtgtccacatagccatgaacctccagacgaacacggtgaggaagctcgccactgagcggtggaacagttgagtactctggcgcgttggggtagcccaccaccaaggtcatgcaagccaattcagccacaaaatcatccatgccttctccacggtggttgggtgggtggtcggccatctagagaaggcaaaggggtaggatcaatgcatgctcaaatccaatttaaataaagcaataaaggacacaaataaaataagcgaataagagcggaattttatgcatagatcatttttgcatgagagcgaataagtgagacggacttacatagcgataaaataatgagaaattagatacatactaataataacaataacaataggaacataaataacttgcaacccacatctcttagttagcacctaatgcactcctcccatcaaatcccgactaactgttaaataaatctcaaataattttactaaaaccctagactgacctgatttgacaaatctcacttgaacaagcgaccaagatttttcccttgaaccacaggaacaaatccaattgcaaagaacgtgtgcaatgaaaaggattcagactcttaggttttccatttggcttgtactacaatcaaggtcggctctgataccaacttgtcacgcccagaaattcccgaataggattccaaacagaatgtgcgttaaaacccccgtctaggaccggccgaggtacacaaacgacaaagttgacaaacagatccacgtcttacaaacatcataaaatcttacataaatgcagcggaaaattaaaagataactggagctaagccttgacttggactgcagcgggaacaccactccacaggcatccttgacggcacggacgaagcctactcctcggagaagccaccatctaacgcatactcaaactctggggtttggggaaaatagagcaagactgagtactacccactgtactcaacaagtcataccggaataggggtatgatgcagggaattaacaagggatagctatagaggttcgtttgcatagagcgagcatttataaatagtagttgaaagcagtaaaacagttgtaataattaatcaatattaaccacccactgtccaacgctaccccacgttgcaacaggcccaaccatccacctagactattcaattccattagactagacttgggtgagaataatcacggtgaatctggttgaccgcccataaccgcgggcacggctattcgaatagttttactctgatcagaggtgtacaactgtactgtcacaccctaaaaatccaaaatatataaattgtcgtttaattggaattattagaatttattttaaaagtctagaagagaagatctaattttaattaataaattccaatataaaatgggaccagataaaatttcattaaatactttgcttaattctataattcctagatttttctgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgtccgaaaccctagcgccgccgtctccttccaaattcggccgcgtctttccgtttccggtgaaatcaatagaggggaaatgatcttcgggatctcgtctaccttttctcttctggaatccccggctaaaatcgtttggaaagtgttggtttcgaggtcgagtcggatcggtctctctctctccgagccctaactttccttctcgtcgccggtcgccgtgggccttcgccgccgcctccttgcccctataaaaggacccccggtgtctcctcgacccgccgccacccttgctttcgtctctcgccgtcggaagcgccctagcgccgtgcaaccttgagccgccgtcgtcgccgtcgctccagccgtgcgccaccgccgttccggtcatcgtcgtcgctcggggaggtcgccatcgtggtcgccaagtcgtcgccgtcctcgtccgcccctgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccgccgcctccgagcccctttaaaaggacccccgagctctcctctacccgccgccaccctcgcctttgcctctcgtcgtcggaaacgccctagcgccgtgtgccctagcaccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccgaagcaccgtcgccgtcgtcaagcggaagaccgccgccgttttaacctcgtcgccgtcgccgtctgttggtcttctgccgctcctttggtcaccggtgagttcgccgcgtcgcgctctacccgttggtgccctccgttcgtgccgaagcgtcgccgttcgccgacgagcatgcgcgcccgagccgccgagtcgccgttgccggtggtgacgtcaccgctgacgtcatcgtcgccctctcccgtgagctggtcgtggaccgatcgatctcggccgtccgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagaatttgaagaattccaaggccagcaaggcaagtcacacagatcccaaacaactctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcaactagatattagatataattgcttagctctgcttagaaacattagcacactattgggataacttatgaatcactataatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcagagcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtacctgggtggtattgaggcacatggtgacatgatgtggggttgtgtcttgtgggtacagtggtacacctctgatcagagtaaaactattcgaatagccgtgcccgcggttatgggcgggtctaacaatgtttttcgtgattagtctcacacctctcatcatgataacaaatgctttaaatggtaataatttgtttagctcctggtttggaatggtacattcctggtttggagataggactgtgcagccgggatggttgttcagaatggttgggcctatagaacagggtatgttgtatagcgttggattaatactgcttaattattaactgctttattaaattctgaaatgtttattaaatgctgtttatgcaaatgaaaccctactatgccatcctttgttatcctgtgcacctgcatatttgttgcgtggcttgctgagtatgtcatatactcaccttgcaatcattcatcagaggaggagttctacagtgaagctgatggtgtggaggattaggtgtagccctggtcaagttgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcagatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgacgtcatcggggccgtctgccgtgagccgccgtagacccgatcgatctcggccgtctgttttggatggatcgatctcggccgttcgtttccgtgaaccgtcgccgtgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatctactgttaaaaatatccacatgtactgttcatgcttgtttatgtgctgttttggtgattttgctcttttctgcttagattccgacgtttccggagagtccgttttcgcaggagaagaatttgaagaattctaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgactactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatctaggaatggtgcgttgcggtggattgtgttatgcaaggggtattgtcacagctcctttccgaggtaccgtggtggtattgaggcacatggtgacatgatgtggggctgtgtcttgtgggtacagtggtacgcctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcttatacaacagggtatattgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtgaagctgttggtgtggaggattaggtgtaaccctggtcaagctgcctgtggagtggagtcgtctgcgccgtttatcttatttttccgctgcttagatctttattgattgagaggaactatctacctctgtaatgacattttattcgcttattaattagagtaataatggtactctattatctttgttattgtgtgcctcggctgattcctggacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaggaaaacgatagagcatttgtaatataggatcaacatgttcaagtgacaagcatgacttgccttgctctgctgctggaggaacctcggcgactatttcaaagtacaccggagcggtgggagagccggaatctaagcgacatacaaagcaaacaatacaaacaggcaataagactactgaaacagagaacaaaaccatttttaatggattctatgcatttttcttgatttattgagacttgaatgggcttaaactgagctcggatgaattagatatgaattttagaagattcactgtgtttctactataacagaaacatgcttaattgatttattgcgcaataaataaatcccgggagagggaggggcggcgccgacatgcgggccccacaaggcagtgactcggggagggcggtccacggtggaccgggtccacggaccgagggggagcggcgcaccacgtggtgcacacgtggcgccgacgcggcgcacacacggcggccacgtggcagccacgcaggcggcggggttgcacggccccgatctaccgcccggtagatcggacagcggaggcggctcgcggccgggcgcgcacgggcacggctcaagccgacccggcggtcgtggcgcgcggcggcgcagcacgacgcgacggcgatgcaaggcggcgaccggcggcgaccggccggcggcggagggcggtggcgtcacagcgacacagacggcgacagcggcggctaagcggctaggcggcggcgcggcggctaagcggcgcgggagagagggaggaaggggaggaggggtctcaccgacggcgaccgacgacggcgagcgacggagggcgatggcgacggcgagacgggctgcggaaccacctaagggatcaaaagggatgagttagagagggagggggaaaccatggatggctagggcggcaaccgaaggcgccggccatggcgaagctcaccggcgcgcggcgcggacggggctccggcggcggattgctacggaggaggggtggacgggacggcccgcacgacggtgaacgcaacaacgtcgacggcacggctcggcacggtggctagcggcagctagcgccgccggagcggcggcggcgggcgccggagaggaggacgacggcgctagggcggtggagtgcactggagcaggtgattgcacaacgaaaaagagagaggagggaacgggggtgctttatttagacccacgagggtcgatcgtggtcggggagatcgcgatttcgccggcggagtggggagaggtggggaggagagagaggcgggattcaaaaattgaatcccggccgtctcgagcgcgggcgcgggcgggagagagggggaagtgggcgcggggacgcgggcacgagggtgacgtgggcgacgtggcccgggagacgcaggagcggggcgcggtgacggttgctgggcgcggcggcgccagctggaggagggagacgggcccgacaggagggccccacctgtcggcgacccggggagagaggagggggctcgggcggctggctaggccgtggcctgcggccggcccaacggggagggggagggggagagaatgggccagcggcccattcgaaaagaaaaaggagggaaaaagaaaagaaaaagaaagaattgaatttctagggattaaataatgcttgtgctcatttttagttggttaaaattatttctagggctctgaaaattccactaaaaatcttgttagcatatttcgacatgtagaactcaagaaaaattccacatgccaatcccgattattatttgcattaatttattagggtttctctcttgcttttacaccgatatttcctctaggtaatttataaattcaattttggcttgggaaagaacttcagggtgtgacaccgagttccttacgacaatccgtcttgaccatccaaccggggctaaatatggaggagtaccctccccaggaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaagtagtataaagaagaatattctaaataaagtacaagtcttacaaaagaaggaaaagctactagagccatacccgaattcttccgaagactccgacgactgaaaactctattctatttctattccactataccctagagactatactaagcatgaggatgtatgaaacttcttgcttgaggtgtgtggaagaagtgatgagaagagttccctaaatagactgccaatgacggttgtggagttggaatggttggaattgccctccaaccatcattgggaagtgatccacactgtccagggagggttcgactgaaccatgggccggctcaatccagcctatcatcggctggtgacctcctctcttgatatattttgcaggcttgtgaattttggcccaattgtccattcattgataagtttgattctcgacatcgtccaattgatcgatcacctgttttgatgtcgtttctccttcattttatgtacattctctgcaaaaggttagaatcctagtgctagtggaatatttattatttaaacataaatatgcatttcaagcataactagttcttttttatttaggtaatattgacaggcaaaactggtcgctaatgaccgtcaacagcaagcgtagcctaggagggagggaggcgcggtgtattgcaaggctaggagggagggcgctaccaggccacaacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtctccactccccagtacctttagctctaagccctaggaaaactgaggtgtttttttgttcttgtgttatttctttaatttttttctaagaaatttacgttcgcagcatgcggtgacgggaggagaggcggcagcggcgggcggccctctgctagatccggtgggaggggaggcagtggcagcggcggcggcccacgggcgacgtcggcgggctcacgtcttccagatccagcaacctctccgaccgcctctcctcctatcgcctacctcctccttcatccggtgagcagcggtggtcaacgctctgctgctttcaccctgccgattctctgatttggattggtttttaagatatctgatttaatgatgtgaagcactccatgaatttttgatcgtgtgatccaagaattgttgattgtgtgatggctgctgatatgcagttgtctttttggtagatttttggatgtttatatcggctcggctcaaatcgtatacgtcaattgctggcacctttgagtgttcttactagtgccgtcttcgtggtgccagttgggaaaaccgacatctttgtggtattcctaacaagcaccagtaaccctatctgggatagtgtattatgccaatttttgtttcgttggctcacaaaagtttattagatgttccatatcggctagaagtttaaataaaatacgtcagagaatctaccacgtctaataaactgaacccttattagagcggggcagctcaaattttaacattgacggtagaaacagtcagtaaaatgtagttcaatttttaagatgggactttacttttcagtgagattcgaataaacctgacggtgttaataacgtcaggaaaattcactgtgacggtcaaacctgtcagcactatttttcctgaagaatacacgtcaggcaaattaaaaatttcccaacaagccagttcggacagaattttcctgacagtttcacgtcaggagggttttggttgtcagggctagttgagtttttggcagtgttatacgcgtgattgcggaacatgaaagttcacacgtacaactcacagctatgcatttttgcatgtactatacctccaagtagattcatagtattggatatacctccaagtaaattcatagtactggatatacctccaaatagattcatagtactggatatagtactggatagtctatttttatccatgttttaccattagacttatttaaaatgttttgtaaatataaaataaataataactacataaacttttaataacatcgttgattttttatccatattttgccattagtcttatttaaaatattttgtaaatataaaataaataatataaatttctaataagacgaatgatcagttttataatacaatggtgtcatgcatcatgcattacaaaatgaatagagttagacggtgatcaaacataaaaaaaatcaatgatatcatgcattagaaaacgaacgtcatgcattagaaaacgaatgggcggaaaaaaaagaacagaaaagagaggattgagcactccatcataaaagaacaacctaaagagcatgtgcaaatttacccctggttttttctaatttagctaaacataccactcgaatgacagtttggttgtaattttctagtggcagtactgtaataacgatcgtagaaaattataatcaagattcaaagcagtagaaaatttataattacccaaaaagagggggaatctgtaaataccaaaaagagagggaatttgtaattaacaaaaagagggggaatctgtaattaccaaaaatttataattaccaaaaagagggggaatttgtaattaaaaaaaagagagtacgccttccgttccataaaaaacacaccataaaaaacacattataatactacgaatatgaacatacttataaaaagacacattgtaatactacgaatataaatataacacattataatactatgaatataaaaatacttcctagacttagcattgcccattgcccatattcatttagatattaatgaatcattagatattaataaatctagacatatacatgtaatactacgaatataaacatacttcctagacttagcattacccattgcccatatttatttagatattaataaatcattagatattaatgaatctagacatatacattagacatatacatgagtttagatatatgatgtttagattcattaacatctatatagactttttagcattgccatattaatgaatcatgtacatacatgtgtttaaattcattaacatctttttagcattgccatattaatgaatcatgtacatacatgtgtttaaattcattaacatctatatgtacgtggacacaatgctaaaaagtcttacattgtaaaacaatgtaaaacggagggagacggagggaataccttaaaaaaaatacattggaatactacgaatataaacatacctctattattcactcctatgttttttttaacctctattattcactcctatgtattattcactcctatgtagtatcatattcactcctatgtttttttttaagtcctattcactcctatggtttttttttaagtcccatgttgtttttaaggacggaagacgtaacattcagtcctacttcaaggacggaggagatactggataacaacattactagcaacattatggaaacattttaaaaggcaggcaggtacaaacttcataaatacaaggaaacattttaaaagacaggcaagtacaaacttcagaaatacaagaagctatgaccgatattaatattagcaacacattgaagcatgcaaccactcgtttttattcatccatacatcggagtattggttattctgaacagtgtacggccactccaaagctggagctaaactgaacctcaaaaagggctcagtgatggccaccaccggggagcttctccttgatcttctccatcatacccttcttctcgtgcgtcggctgcgtcgtcggtgtatacgccgtcccgccggcgtcggtggttgtaccagcggcggcggtgtgtcccgtgccggcaccatatccgccggtcgccgcagtggccgtcggctgctgctggccgcccttgttgccgccggggagcttctccttgatcttctccttgattcccttcttcctcctccctcccatcccgtcgtcctcagacgactgcacgtcatatataatacattgatgacacaggaagatacgtagacataatctagttacggttaatttacagtgtgttgagaaacgttaccgagcttgagcttgaactgccggagcggcggaggatgccaccggtcttgtgctcctctctcgccggctggaactggccgcctgcgtgcggatacgcgccggtgccggcggtggcgccgtgtggcgcccctgtgccggtggttccgtatgccatggtgtcgggtgttgtggtggctccgtgtccagccatgtgcctggtgcccaagccaccggcgccgtggtgggctccggtggttccgtacccggctgtgtgcccggttcctagtccaccagctccgtgctgagctccggtgacgccggttgttccgtacccggcggtctgccccgcgggtaaaccggcgccggcgccgtggtggactccggtgccggtggtaccatgcccggcagtgtgcccaggcattaaaccaccggcgtcatggacgccagtgccggtagcgccgtacgccggctgaccggaaccaccatagcccgcggcgtcgtgggtgccggtgccggtggcgccgtatccggcctgccggccataacccccggcgtcggtggcgccgccgaacgcatgctgaggctgcgcaacgttgccggcggcgccgtaccctccggcgcctgcctcttgcgtcccggtgatgccgtggccggccgccaccgggttgccgtactcgtcgacgcgcgccgccgggtggccgtgctgctgtccctggaagtgcgccatcttctcagcgtacgacgtcgctcgagcccgactcgatcactgcgtgttgtgtgtgctcgcctgctcgagaggcgatgagttgatcaactgtttcagttggaaatgatcggtgtggtgggtgaagcgaggaggagaacgaggcaaagcgttggacttataggcgaggcgcgcgcggcgcgagcgcgacacgtcgagggggcacgtgtgagcggggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctcttcctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgttactatgttttacctgtcttattgtgatctatgtagtgaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagcaataggccccgttcactgtttccttgcggtgaattcacctattaggaggggatggttagaattaattctccatggggacataaatgagaggaggcatgtccccgttggtttcacggggggcggggattgttcttcattccacgtccccgctccccgcgaagacccgcgtaggggccgggtccaactttaatgtattttagttatcctgtgtgattatattgtttgtagtctttgataaatgataactttatgtttttatcatgtgaattagtagaaaatattagtagatgtatgctaatatattcatataaagtacgaatatatgttgtattgcatatataatttgacatgtgtatatttttttaagcaagggtgaaatcaccgcggggatttattccccgtgcggggatggggatggtaacaaagcttcccccgctgtgtttcgcggtgacggggatgtctcgcgggggcagggatggggatgcattccccgaggtgaattctccgttgccatctcttgcactactaaacatgcatgcgttttcaaattttcttttttgtttaattgctcggtttatggcacgatttcttcactgtacttatcagattttgttggtgtaaaccctaccttctttaaatattatgaatttaatttccactttgttgtacgtatgtcaaacatattcgagaggtgattgtagttgttttcttaggcgttcggttttctccgagattcaagctaggaatttcccacgtctctgggttgtcggtatgtggggtcaaaatagagttattgcttttgtcttatagttaaaaattttagcagtaaatctactttgtgttttctctactatattccattgaatttgatttgttctatagtaggtatgaaatcggttcagatagtttccatgtctattatatattttttggcatgtctattatattaattaattattaattttattgttatatagataacattgaaattgagattattatgtggatacaacacatatttataattctgtgtttttcttaaaaaaataaaaacctaaagagtctaattttcaatggtatattatatttaacacaatttagtatattcttaattttgtaagcacggtacaaggggttttcctgttcccatagatattcatgaccatatttgttccaatacatatttactcagtatctgtattcgataatattttgcttcatttccttttacgattctgattaaaaaaatgaaaataaaatgatagaggtagtttctgttaagaaaccagtctactctactgatcagcacatgagcagataaacacaaacttatgttccccaaagttctacatgtgctatacatgtcagacacttataagagacatataggagattacttcttcaataaggttgtcctcatcatcgtccatatggacatcttcaccatccttagtgttgacaaacatgtcatcatagttttcaatgtgagcttcaggctcagtggtgaagtatgactcatattggctcattttctcattagagctcaaccagatgcttgggaacatggcagttacgagaccaatgctcaatgcctccacatctatagcaattatcatgttttccccagatgttccacatgtaactttcttgcattcggcttttgcctttgggcttacccttcccttgccccttgaacatgatacttcccttacccttctatctcttctccctgtggccccatttatggtcacgtgagtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccatagaaattaatttaagtaatccttaggattacagattgcgtgattaaatattatgaatcatgctaggaaattaattatataacattaaaataaaatgttacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgcttcaggaacctttcatcatctctagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaaatattatttgcatattaagaacaagatgatcattaggcattggtttctcagctgtttacctgtttagcttggtggagactcgtgctggtaacattttaagaagccattctattctactgatcagcacaatagcagacaagcacagagttgtggaacacagaaaatatggatgaatgaaagctttatttcatcggattgcgtacaagttacatgaggagattaagtatgaaaatataattcaaaatgatgttttagagaagattgagtatgaagatataattcaaaattttatttcaaagaatatcaaaaggattatgtttttcagtagaacatgaggtcaggtcaaactattttagcattaatgttttatatgttcctaagaagaaacatatctaaaaattttatgcttttgttatgctccgttttcatatttttggggcccattttacgttttgcacatgggccccaaaatcatagatacggccctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaaagccattaattatctggaatttactattaatttggtaaagcgtgattttctctttatatatactaccgggagtagctactcctgcatcatctgctatacgtgctttcaagccgatcgctattttcgtgggatacaaacttttgaatgcattatgcacgtcagttgtttgcattatctgcctgacggccgcatatatatatagagagagaaaatcctctatgtacccatgaaagttcacctaatcccttctatacccctgaattttgctcaatcccttacatacccctgaattttagtttggatcccttccatgccctttccgctagttgaccgttagttgactgttaaattcttttgaaaaagtccattttgccctttgctataaagaaacataataaattaatgaagtatattgttggaatgtaaaaatttattggatgagactattatatttatgagaatgtgatgcaccatattatttgtgacaaatttacttttacatatgatataaaaagttaatacttatttattagttattaaaagttcttttatgtagcatatgtgttttcatagtaatacaacatatttatttattactatcagaacacatatgctaaaaaaacttttaataactaataaataagtattatttttttatatcatatctaaaagtatatttgtcgcaaataataaggtgcataactatctcataaacataatagtctcatataacaaatttctatgcttcaacaatatactctattaatttatatgcttctttataccaaagggcaaaatggacttttttataagaatttaacggtcaactaacggtcagctagctgaaagggtatggaagggatccaaactaaaattcagagatatgtaagggattgagcaaaattcaggggtatagaagggattaggtgaactttcacattatgcccgttatgcccattttctaggttctgcattttcaagttctggaggagcagaacgtatccatgctggtattcaattacacaagcagaacttgatatggggaccagaacgaaaatgttctgctcttgtttctgctggagccttttgctctaatagtagattgaatcgtttttgaaggaacagaaactattccgtcacatattcataattataggaacagggagattagcttctgttgcatgcgtatacatatttctgttatgcagattagctgctgccatattattagcctgttttttcgtttgccggctagtatatatcttctgtcggccaggagcagaaaatcaattccaaaaagagcagaacatcagttagttagttaggagcagaaaatcaatttgaaaagagcagaacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagagcagaaggtattctgctttcttcttgccaaagcttcctataagtaaacggactttgttttttggagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgagcagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccgtcaaaaacggatacggagaaaaaataggtggctgttctgctaatttttttatgttgatgttctgtcattctttttaattcatggtctgccattttttctgttggccggctaatatatatgttccaccggcacgagcagaagataatatgtcaggacgagcgggtgggaggaagaaactgcatccgagaagttggtttgcatgcagccgatgatttagcaactatctgaactaacaaactatttaattaaacaacacgggtattcatcgttattggatcctcgtcactccactaactgaatccgatccataataggagggagtaactaccctcggtagtaggaaataggtgtcctatctatctatctatctataatataatagatagatatagatagatagatatctataatagatagatagatagagagagagagagagatttgagctcggcattgacaattttaatgtggagaacatccaggacgagaatagtcacgtgcaaggcattgtcaacaaattagatgaaagtctgaaaccatgttactttgttgaaatgttaccgacaagagatacttgattaatcgattttcttttggccaagttccgagagaatatggttgtgcagcatatgaaatttggttcgccatatgtacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtggttcacttgatttttttttatttcaatactagagtgccaatcttctttatgtggtctgaatgtgccatgaagaaaagtatgtcatgcatatctcattgaaaaaagataatgtggttcacttgaattttgatttcaatacaagagtgccccgagatccattatggcgagttgtagattcatgcatatctgtatagtatccttgaaaaaaaaaagtcactccgcagatgtgtgcagtttgtacattcaagcatgccattcagaaaatcattaaaaatgttcttctccaaaatgacattctggaaaatgatatcagttaaaaccaatgtaccagttaatttatattacaaaaacaatggatctccattcaccataatgagatttttacaaaatggtatgtctgttacatctccatactgacattataccaaaaaaatgcacatgaactaagattttttacacaatccaacttttctttctccaaatataacaaggtcagaaattagcatcactaatcactgatccggaatcaagaatcccagctcacttgctctgccatcttaatcagtcgctccagattcctgctcacgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctgttccttctacttcctcaccggcttcgtccgaccgtgggggatcgggagcagaagggcatttgagaactggagaggggtagagagatgattgaggaacaggggcgtccacactccacaatttccccatggagatgaaggggtcagtggatgaagggcattttgggaaggacacggtacaaagtgcaccatccatcagcaattccgcagcgcctaaagggaggaaagcaggcatggtacatcctattatcatcagtcccaagattcgtgcaggggaatggagggtgtagattgcgagtgcatgtgcactcgggtgcaaataatccaattcctatatatatatatatatatatatatatatatatatatatatatatagacataataatccaattgtgagtaataactaaaacactccccctcacaccctacccccacctagggatgaaaacggagcggatagtttccatccgctccggataaaaacggatacggatacctttcggatcggataattctcggatatttcatatacggatacgaatacgaatattttctcccggatacgaatacgaatatggtatcagggtttccgtcggatacggataataattcggatatccggtgaacagtgttattcggatatccgcaggacccatgagacataccccatttctttctaactctataaccttcaatatacctttatagattttaatagtagtttatctcttaacattagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcaagataatccgtatttgtttccatattcgagctatccgtattcgttttcgtatccgataaaaaatatgaaaacgaatatggtatgagcattatccgtccgtatccgctcctttttcatccctacccccacccccacccccacccccctcctaccctgtgtccccagcagccacctaccccgcaacccaacctttccctgtagcaaacaattagtaacttttttactgtcaactttacctgatatatatattac

SEQ ID NO: 80502 - DNA, 31428 bp, Oryza sativa
  unsure (1)..(31428): unsure at all n locations
tgacgacgacgagaggatgccggcgggagaggcggtcggcgcgaagacatcaccggcgacaagaggcggagggaataagtaggaaggaggtggtggcggctagaaagggcgaggcagcgagagcagatggatcttcatctatgggcggcagcgacggagctttattgccgcgagcaccccgttgagaccaacggcgccccacagccgaccctcggcctactttggcttcgtcgtcgacgccgcccccacatgccaccctagatctgccttgcctggaccacctagggaccttcaccaccacctcatcaaccaccccaccgtcggcacagccctccactgaccccgttgcctagcagccaacccacctccgtcgtctccatctcagactcctcccggcgcgagctcgcgctggcctcggccctccactgtcggccgctccactccgccgctctctcggccctcctctctcgccagcgtggccggccgcctctcccctcgccagctgctctgcccaccgccgccctcacaactgaggatgaacaacgttgtggccgacccaacggtggacgttgggcggggtggcagcgggcgagcgcggcagcgggcggcgatagagggggagagaggcggccgcagtggcgtgtgtgcgtcggtgtggcagtgacagtggagctcggctcggctcgccagccgcctcactcccgtctgccgccgacaaccaccgttgaagagaagagtagaaagaaaagagtaagaagagatgtggcccccacatttttccttctcacttaacttacatgtgggatccacatattatttttattttttttggctgactaggatgccacgtcagcgaaagcacccatatatactgccataggaccttgacctcgagtgcacggtttatgtgagtttagagctacacatttctagttttgtggttaagagacttcaaacaatctcgctgttaagttgagggacctccggcgaacttattccaaacagaaaacacgcatggcctgcttggcaaatgataacgaacaaatggcccagaaactttcacagttgcttggttgctgcttccgcttgtagcttccatcatatagatagtgagatgttatgatctcaacttaatgaaatgaatggattggccaattatattgtattgtatactgcatggttaccgtcacaaaagatgcgtgatccgctgatccgcatcatccagagttatataatgggagaccaaatggaccctgaacaggtaaaaggaagcatgtcgggagctgcacaatatttcttctctttcgttctcaagcgcaatacacatccgatttgtgctctaccacttacatcaatcatgcacacattcatacgcgaaaaggaaggaattgcttcgacgagcttgaacatgcctatattattctcgtcacacaaacacaaaagtcaatcatagcgccaccggaacaacgaggagccggataagatgacttcttcatcatttcataatagcaaacaggacgccagccaggcaacgtcaaagaaataaaaaacaggagcagacaatatcgtgcatgcatgtcactttcagttttggcaagcaggcaggcaagtattccagccttccttatttctcttcgaccacaaaaacaagctcaggtaaccgaagctagcaagcaacagacccctgatatttcctcccttttataaaagcattcgcacaattattcctcgttgcagccggagaaaaacggggccagaaaaatatcagccgcgctacggtacaaaccggcccaggcccggcggccgcgagagagggtgacggccgcgtgacgcgctcccgcgtacggaacggagcacgcgtgcgcgaagtttcctcctcatctcatccaccccctctcgcaactctcgcaagttgcgtgcggcggcctcgcgtcgtctcggtacccatctctcgtccgtcctggaacacagcgcggtgatgtgaaatctgggccttttgtctccacctgcagccgaagcttcggtcgctacacggctcacacgcgcacgcgcacgcgctgcaaagctaccagttgggggggctcgcgcgggcgcggcgcctgtcgcctttgcgggcggtggagtttttgtcatcaacttgagcgtcgtagcagcgacttctcggcttgggattcggcggggacgggaaatcattggagttccctgaatttgtcctggcaatggcaacgcgagggcgctgactactactactacgaaggggatgaatcaaggatcgctcgctccgataaggaaaaaaaaacttcctgtttgatcactatcatgtcaacctcttttttcatgtacatgtgcgccgtaggctgtagcttaagatctaagtaggcgcatcgtttcaacgccgcatgccgtttgtcaaagctgcgtagttcagcaagaggagagatattgttttcttagagcaggtttaatagatcctaatcagccggcgctagcacgcttcgcgtcagccaaatctgacgtggaggagtgagaagagaaggaaaagaatggagcgggcgttccgtttatcgttcggctgaagcgcaacacacgagaaaaaactgctttcttccaaccaaatgcgaggagatcaggtgtacatgcgaatattaaatatgtaaatcttcaatagaggtaaataaacagctaacctaatagccagcctattatattagtgatggctataggtgacatggtactaatacagaaccggcagctggctatattattatcattgctcttagaagtctccctcctgatcagcgaggaggaggcggaggaggatgaacgggtcatcaatcgtaaactagcgctaataattcgagggccgtgacgcgaattaaagaggcgcctgatccatgacagcctcccgaaaacaatttttttttgacaagccgaaacaattatttttatcgcgaatgattgagatcgatggatggatcgaacggccggtcgatcgataccgacgcgcgcggctgctcttctccgattcgtcgtcgtttttcgcctctaatcccatcgcgaaatccggagcaagaaacggtctacgcatatttggcaccggcattctcatggtagcttgcttgcattagccgttgcatttgttgatagaactgctcccgccacgcacatgacatcgttaatctggccagcacccgcagtgtcttagtactccctccgtttcaaaatgtttatcaccgttgactttttaatacgtgtttgattattcgtcttattcaaaaaatttaagtaattattcattgttaaatatactttcatgtacacatataattttacatatttcacaaagttttttttaataagacgaacggtcaaacatgtgctaaaaagtcaactgtgtcaaacatcttgaaccggagggagtactatataatcagattagttaacagttaacaacacgaatcacgaggctttggcacgttggtgctggccgaaaccaaggcgagggggagctttgctttgggttaaaacataaaagtactccagtagtaggaactttgatgctactggtactatttagttagtgatccggatcagtacttcagtaggccccgcgtgacggatcgaagaagataaggtgaagcaggtccctgctgcctcgactgactaattaaagaatttggcgtttggttcgtgattaagggtttggttacaccgtgtcccgctcacggataggctgcttaattctcttttttaaaaaaggttttagctagatgcgctggtgctgctgctgctgcttccagaatccaaactcatgagcttgaccaactgaaaagccaatccgtatcatctcaattactactccttacaagtactactagtactaaatatgtactgctgttagtagtactgctaaaaagtctaaagtagcacaaaatcagaacacacattttcagtattgcaggagataatgtttccagctaaaacacagcttcatcctcaagaagcttgttgcgccaaaatagcattattgggcacaagttagcgactagtgagccccctgaaaaggagcccaaaatagcgttctatagatacctttttaatttcatcctcccgtttggacaaaaggaaacaggtcttggattggagcacatcatgatcaacatctcaaatcagtgatgccgagatttctgcacgtggggaacgtatttctattcgtcagaacaaaaatgaaaaaaaaataaatccagctcgcacacaatacagggaccacttctcagtagcccaccacaaaaaaatctagtactagtatatggatcgatcgatgcccgcatctttcgtgcttgctgtactcagttaatcatacgggctgctagcattacaatatccagatgaagaagttaatgtataacaccatttgtgtcagacagagatatcaaaaatattagagcggtgtaaattaagctagataccgtgcatgagccactgacagcatttatactagtataagatcgaaacaactaattaacaagtaccccaaacaaagccatcgtctatgttttttattttcaagtgaggcacatggaccattgatggttggacacctatagctcgcaattgaggggaaaaaaataaggagcgcttcgatacaacttgcaccggctgtaccctctcccaggaggccggcttcttgagcaccacatggaaaagcttaactgccgtagtttcagatcgggtttgtacacctgtacgtgaacccacgtgagatgcgagtgattcgtgaggtagtatcatcgatccaagctatctcacgtgtacacctgtagtagcgtatcctccgccgtttgatcgagatccaacgcaccagacggattgctaacaaacaatacataatcttctatttttttgttgttgagatatatatgatcacgtcacagggcggcactggttctggaggttcgtctgtgaattaaaccacgctaaagtacagggtatccgtatagtattccttctcatgtacgatctggtgtgtattgtgtttccacggggatagcagcagaagcacggggatgattggccagatcgggttagggagggggtcgccatcgccgcctgcactagattaatcgctcgccccggcccagaacgtcgctctctccgtccgtccccggctcgccaccatctcctcctccaagacgcaacaacgagagtgagagagagagagaatcgagagatccaatccagtttgcgcaacgagtggcatggcatgcaaccgatctagaacgtcaaataaaaacaacgccatgcgtacatacacgttcatgtgccgcgcgccggtgtagcgcagcgtagagagagagagagagagagagagagagagagtatggtagtcttcctacgctcggtcagtgacagcgtcgctgcgcataaagaaaggcatccactagcaggagccagcatacgctgccgcatatacaaacacgcatgtagccaaggcgaggagagagagagagagagaaagggagatcattgaaagctgcacccatccgtttgttcgccaccatttccatcccctccatcatgagctccaattagccgcacaccgatcccctcctcttcttcccccccttctcctctctcctctttttttcctcatccgtgcgcgatactgcgcttagtttgtgggtggggggagtgatcatcaccaaagccacaaagggggcgcggagagatattatatattctttgggaaagcgttggattagtttttctcgctttgggctttttatccggagttggagtgtgtgtgcgccgggagtggtggtggtgatggcggccggagaggaggtgatggatcggtcgacgtcggccgaggacgggtactgcagcgccggcacggactcgccgcgggcggagtccgtcgacgagcaaggggccgccgaggagtcgtcgccccggggagggcagaagcgggagctcccctcgccgtcggcttcgccgtcgtccccgctgccacctgccgcgaagcgcaggtacggataatattatggctcggtctgcgattgattaaagccctaggtaggatttagggatagaggattgattggtgtttggttggtttgagcagccggaggtcagtggagaagcgggtggtgtccgtgccgatcgcggagtgcggcgaccggccgaagggcgccggggaggggccgccgccgtcggactcgtgggcctggcgcaagtacggccagaagcccatcaagggctctccctacccaaggtaattaggctttatattcagtttggttgatattcttgagcctgttgattagttaccgtgctgattaatcactgcaattagatcagttaaacggttgttgaagtggcaagatttaatttgggtttgttgcttgtgtttattatgctcagggggtactacaggtgcagtagctccaaggggtgtccggcgaggaagcaggtggagcgcagccgcgccgaccccaccgtgctgctcgtcacctactccttcgagcacaaccacccgtggccgcagcccaagagcagcagctgccacgcgagcaagtcgtctccccggtcgacggcgccaaagcctgagccggtggctgacggacagcaccccgagccagcggagaacgaatcgtcggcgtcggcggagctggaggtaccggagccggagccggagcaggaatctgagccggttgtgaagcaggaggaggagcagaaggaggaacagaaggctgtggttgagccggcggcggtcacaaccacggtggcgccggcgccggcggtcgaggaggaggatgagaacttcgacttcggatggatcgaccagtaccacccgacgtggcaccggtcgtacgcgccgctgctgccgccggaggagtgggagcgcgagctgcaaggggacgacgcgctgttcgcggggctcggcgagctcccggagtgcgccgtcgtgttcggccgccggcgcgagctcggcctggcggccaccgcgccgtgctcctgatgatcacctcctcttttctttttcctccccttttacaatttcccttttttttttttgcttttctttagttctccttggagtaatttggattggaggttagtacatagcttgggtgatcaatgggagtgagtggcttaactgttcaagagagcctcctattcccactctccaaattgcgtcgcgtgttcgtcatccaaagcccgtcgtgccgtttccgaagtggttggcgacgtgattccaacgacaaaaaagcagcgaaaggtgggcattttcaggcgtttttcctcgccgtctgtgtcgaatagacgcgcacatcgatcgctccaaggcccatcccgccgagtgagtgatgagtgagttaggtttctccgcacgcacgcacgcacgtccccaccggctgcggcttgcaagtgggggcctctcgtctcgtccgatgcggaatccaacggtaagcggcactggcattagccgggcaagcgttttcggcgtggtagttggaacttggaaggatgcgcgcgcacgaggccacatgcccgggtagtgtggcgctgccacggatccacccgcgggacgcgtgccgcgccttcccgccttgccggccacggcccacggccggctgccgccgccccggtccgcttggcgctacgcctacgcgcgagcgggggcgggcggagcaaaacctcggcgcagcaaaaaccgctttcccgctagccggctgccggccggaggcgcgaggctagcccggctacgctacatgtatgtacgcgcgctgccgcttgggacgtcgccgaattggtccctatcgcggcgcggtgcgtcgtgttcgtgccgtgtcgcgacaccgtccctgttactacgagagataggggcaaacggatcgttcggctcagggttccatgtatctagccggccggctgttccggctcgcgttctgcgtgtgtatgcatgtatcctgcgaggcaggggtgggggaagcgaattcgcggatttcggaattcctcgagtggtgtactagtactgttggtgttcggagaggagcttttgtttaattcgtttccagaagtaaatacaaggggacgatgctagattcgtgatgccatcttctccatgtggcgattaatttagaaccatcttatctcagcagcagttaagcactactacgtatgtataggcacctcttttaactgctctagatcatgaacacactttttttcaggagagattctcacgttgtgcttgaaataaatatttcaactttccaccaatgacacgactaggaagtaggtaccaaagtttcgtcacatttttgcttaagcaattactagaacatttatttattcgtctgttagcttcgatgctaagagacaagctatacagatgaaaaaaaaaagcttgcaggactttccgatataatttccccatgacaatagaggggatagctaggactaaaaggtagaggtcgtagaaaaacgcatgatcagccaactttacaaacaaaagataaaacatgtgactttactagcctatttggagtcattatccacagtcggacatttcacaatctgaccacgtaagagtagatgataggaatcaaatcggcaggaaaagacaaaagagttgttgtcagtttgtcactgacgtaagggtggcatccatgacaaacctggcttttgggcttggctatggctacttgcatgtacttggaccaggccttgtttgctgatctattttagacaatgaatggataaggccttgtttgctgatgagtttctgagtttacataacagagcacacctgcaggaaattttagcatccatcaggaaggacacgcaacatgaacttaagatgggaggcctacattactactgttgcatgtgccactctttttttttttagaaaatggattaaaatccggcctctacatccacagtggatgtacacagtccaacatgtgccactctaaaggatgcagttaagcaactcagcacaagccatactgtcaaaaactctaattgttcagaaggctgtcagaatgccccgaaatattgccaggttcccactgtaaacaaatgttttgcagaattatgtcgaatacagtaaccaatctgacgaaaggagctgtcttgagttaagactttcaagaaatggtataactgaaagttggaacaatctaactctcaatatcaccacaacaaaatgaaaattaatggacctctttcaatagaagcaacatacagccgtacacctagtggaaaaaatcaacaagaaatgcatctctactctaatttgagcaacagccaattctcttcagcgcagacacgtcatctttcacattaatcttctctcctttgattggagcatttgatccatcatctgatgcctcaaccgtcttcttgctgacagtttggtatatctgagtcaaaacttctgcaaaagcattctctacatttgtggcgtctaatgcagatgtctccatgaagtacaatgactcagcctcagcatattcctttccatcttcagttgaaacagccaccagatggcggagatcggatttgttgcctactagcatgacaacaatactagggtcagtgtggtctctcagctcttttagccagcgtgccacattatcgaaagtagcacgccgagtgacatcatagacaagcagtgcacctactgctcctctgtaataggcacttgtaatagcacggtatctgccaacagaaggaaaatattaggtaatcatataattatgcactaaagaaaatcataaagaaggatcagctactcccactgttccacaaagagtttacttttagcattcaaaatttgtccacgaacaatttacttttagctctgaccctactcactccacaaatcaacatactctctcacacacacattctccaactattaataacaaggggaacctaagccattccctcacagtactaatctgcaatcagtgtgagaactgctacaaataaattcttcgtgggatggaggtagtaattctgattccaatagcaaacatgttcaaaattgtccacaaacaacagaactaaaaacaattggcatgaacatttgatattagaaggaacattatgatgccttatttgttatttcctaggttaaaaagtgctgccaatgtgttgctacagtaatatgtgatagacacatggcatgcatgtagtgaggaaaaggccaagctatggtaaagtaaggtgctctctataaaacatgtacatctcagcaatagactaaattaatagtaaaccacctcaatagtatgtctacatgggtatctatagctctctaatccattgcctcgtttttctctatagattatctccaggttagtagatagctttgctctctctcttcattcaatctattccaagtaggaaaatatgctgacatagatctcttgtagagaacctatagataaccattgcgggtgccctaaggccataaggggcaggccatcttttcctgttccccttcgccaagtccagatctaggatttaagctctagtcattcacatcaacatggtgtgactgtacaacacaccaaattgcacgagcgggtaacagattattggaatggagcaaacaaccgccaaactcacagtcaacatctcaggtcaaggtcagtaagcaaggttgctttttgtgaatgtgtgattggcttggttgctgaggcgtctttatggtataacaggaatgtggaatttagaaatattaaggatccaaatagaaactatagcagaaaaataaggcactggtatagcacaagttatacattataaaattttctgtgaaagctttgtgattttgttgttaaaattgccaaccaatcctagttcaccccacgtccccacccaagtcagtctatgtgtattttgcattctatgattgtctcggatatagatttactagtttcttagactttaatttacaatagcatgcaaggtgttttcttaatataaaattgtattcttttttagatgtggaaatggtttaaatctcttgcctctgctaacaagcacactgcacacggccaataagttttattgttgtataaaaattgagtgatgggcctcccccaacctctctaaagaaaccatatggacctagtatttctgacagaactattcttatccataattcagagagacttataatgaaccaaaagtttctatatagtacgaacaaagttttgcactgtccaattaggatgatcttctcgatttatactccccctccaaggctccaaagcaatatcaataaaactgtgtggtattgcaatacagtgcgttaggtagttaggtatacactacataagccgggaaccaaagtatgcttttgatgcgtatttatgcactcctcatgatgcagaaatgtcgtgaccacaatggcactttctactcttgagatccatagcaatagaagccctcaatagcgaccatttcgccgctggggccgcacttatcaataagtcctctaacacctgtgaaacacctgtcccccagttaacactgcagctaaactagcatcactgcatttttgacacatagcatttcctctgcttcctctataaacttcgaatggaagacgacacagcaaccactttcgctagaacacaacaacgatttttggtggtttcactctcgaaccattaatctcgaatgaaacagacatggacgtcccaacagccaaaccacgtgtcacctcccaatctagtaatctaccctccaggagaaccagccagatgtgaattggcactcactacactttcggttccatgccaaattcgtgcaggaactatcaaggtcaaatttacaatattaatgctctaatatcatcagcaccgaactagttcaaacaagaaattaaaatcgacaacgacgacaaccaaagttcacattttttttaaccaaaaccaagcaatagcgaagcgcctacaaacaatctgcaggaaaattatcggctacgtcgcactctaacttccaagagaaatccatgagcatgcggccagcagcaaatctagcagaacacactcgatgcactacccatttgcgcaccaacgcgggaagcggctagagtaggagaggaagggggaggccgtacgtacctctcctggccggcggtgtcccaaatctgggccttgacgaccttgccgtcgacctggatgctgcgggtggcgaactcgaccccgatggtggacttggactcgaggcagaactcgttcttggtgaaacgcgacagcaggttggacttgcccacgccggagtcgcgatgagcaccgtcttgaacaggtagtcgtagtcgtcctccgccctgtagccgccgcctccgcccgccgccattcccgcgcactagccccctcgccggccggcgcttctctctcagctagctagtggcgttcggctttggatctcgcgggctttggaggacggagcgagcagttgtgggcgctgacaggtgacaccgtgacagctgagctgagcttgctcggttttcttgcgccagtggccagtggggttttaatttgtctgaactctgaagaattaatttgctgctcttcttacgcagaaagtccactctacttctttttagtcctctctgttttatttaacctacggctgataagatgtaaaataaattgaacgaaaccagttagtactaggattttattgtaggggccattcatattaatgccatttcaaatcatactatttttttaaagttgctaaatattcgtatatatttaatttcttgataaactttgataaatatataagaaatactgccattgccaaattttagtaacgtttattttggctacaatttaaacaaccctgtagtctgaactaagaattagtctgttgctttttatacgtagaaagtcccctgcacttctttaatttaggcctatgtttgtacaagctaccgccatgaaaataataaaagaaataacaaaaatcatttctaagtaaaatagtattaatgatttagaagttcatattaaaaaatatactacgagtctacgatgaaataactctaaaatcaacttgaaactgagttctaaaatttaaattttgttgtggttcataggctaataaagtatgactctttggtttatacgaattctgtaggaaaagtagattaattaaattcttctagggttgcactattcatttttttgatggatggagcataggaaaaatagggaatatctttcctttgccatagatcaatatgaattgaaacatttacaaacatctattttttttcattccttttctcaagtaataaaacaacaaattgacacaagttaatgatacattaaccaaatgaattataatttaggtttgttttgtaagtttcatgtgttaacaacccatcttacattttccttatgtcttaatcatctgtgttacacgtaagtacacgtatgttcctatcatattcatgcatgtttcctattcctatagtttttcattgttgcgttttataggtgtccctaagcaaaaactttttgtcaagctcctatagacagcggtgatggcaaaggggtcaaatgaaatattttgattgtaaaatttgatgctagattgaatttaatctaaatttgaaaaaaaaatagtatatgcctaaaggtcggtcaaacaaacattcgtaccacgggctaattaggtcccttatgatttgatcgcacctagttagacagtctaatcgggctaattaggtcccttagagcaagtttaatagtacagcccactactagcttcaaatcatctatagccaatgtaatagtcaattcatacaatagttgcttactatactattaatacctggtcccacctgtcatacacacattacgccttgaagtccgtgctgcagctggctacagatctgtagcccgctgctcttctctctcttcttttatctctttaaaatatgtttatagctggcttatagtctgctattgtacctactcttatgatttgagctgtctgatcggcaacctaaagtctagatcgaatttagttttttcttttcgtgtgtattttcttgctctaggatcaaggtttcttgagtgctactgtatatctatcccaataatacatgaaaagtctttatttttactaagattaatatctttataaaggttatgccgattcaattgagacaatgcaattcaatatacaaggctcgtcatttactttagatttactctactttacccctacctcatctgttggtttgcatggtaaccattcaccttcgcggctaaaatgcgattttttaaaaaaaaattatcccaaaaactttccagttcactagataagtgtttatgctcagatcggtctaaatcgtctttggtagattacttgatatcattatgaaaaagatcagaagctacatcaccgtacccgtggttggagatcaaagcgcctctacagctacttcgtttaagccagtggtaggtgttaatcataaaaagacttcaagagaatcacagctccggatccgctaccggttaaccgtaacccaaccgaccgttggacggctctctttatttcttgaaccgcgttaactactcgaactcttgcgagatctcctctcgaactcgttaaagaaaggcgtgacgcctcctcggtggctcgctcgtgaactcgtgaggcgcgaagtgccggccgccggcacggtaaggcccgagacgcgcgcgctcagctcgtgggatgccttgaggccagaaccctcgcagttttacggcaggaagagcgttcggtgagatccagacgcgcgcggtttgaagcttgaaaagccaagcgaaggccatcaaacgatgataccgatcagagtgtgatcagacgccttgttgccgccgtcgtgcatggtatagttcaatactaccggagtacttggtagatgcagcgacagaggatatgccagcgcgcggcgcgactcagatcccgcaggccggctacggctcacacgccgcacatgcactcgtgcagcgcggctgagcccacgttgatgaaacagctagctagtagcctagtagtacgtgcttgtatacaggtgggtgacgggtccattgccagtgtgacgtgcccacaggcacctaccgtccgtcaccactcaccaccctttactactccagtacccagcagaagatgatggcatgtagggtttcatctagttccagtctaccctttgtacaaataccaacatgagatgggagtccacgagcagccaagtatctggcagtatggcaatctctatgcaataactgtttgacatgaggaataatccatagggattgggtaccattcacttctaaatgatgcaaatccatgtttgaataccggcacaaaatgatgcaaattatgcgaactgcttatgcgtatttccttaaaaaaacactattggcacaaaaaaaagtgctgttcatatgggaactaaattcatccaagtgaaaataccgcaaaattcctacattctagacggaacacaagggtatgaatcgatttgattttgtaaatttcacaaaacctctagtattatggtccaagttttaaaaaatgattttgatacaacacataaccccagatattatggtttcatagtttgacaaacccacactgttaattaatttggttcgctactgtaccaaataagaaatactacacttaatttagatggataaaaattttggtaaattagaaccatgccattataattttgcaaagtttgagatatgtcttcggtatctcaatgacatgtgggacccacatgagtcaatgacatgtgggtcaggatggcatatctcaaattttgcaaaattataatggcatggttccaattttccctaaaaaattttatagatagatcaaagaattcataaatttgagatttgatttagaacttctaagtatggagaatcaaataaccattgattaacaacatggttttctaaaactctaggcccataataccagcgatcatgtaagccacatgcattacccgtatgttttttgttttattttttaaacaagctaggacaataatatctgcagttatatgaaattaactcatttaggtattacacatcctgtttttatagttgataagtgtgccttttgccaagtttagggactaaaaagtgttctttatggaaggtgaaaaggcctcatctcaacatataataatctcaaaataagggaaaagaattctattatcatgtaatatttacacatttctatgcagtaaatttagctaaaagtaaagaaaatcataaattacaatattgctacatataaacaatgtattttcctatcgaagaaaaaggtgtctcatgctattcttccgcgcacgtgccaatactggccaaaactgagctctctactcttccaattaaagaaagcattagcaaattcctaagtggaggaaaagtattatcaaatataacaatactatttatgcacagttcttgacagatatctgcaccttttttgttgacatgaaaatctttctttggcgactagattgtctgctgcttgtgtaaatgtgtcttcttaatcaataatattgtttgcgtcatgttcatgttcatgctcatcctcatgaataacaacacaacttccctaagtcgtggaagcacagaaaagataaaaaacgatggcacttgataccaaggcaagatgtatagatggtagtcacctgtgaggaggcataggtaactaaatttccagaatatgaaaatccatcaaatagtccactctctgggaaaaaaaaatgtgccactgtcaagccaattgccaacaatgagaaatataaaaaactgaacaaacattttatccatcatattttcttactcacctgatgacatcagcctgaattaccctggttttccatatcgtcatcatcaaggataacatattttgaagcaccgctagaagtttgggggttcttgtcacaattcttattacgatggcctttcttgaacctatgataccttcgcatatcatgggagaagaatgaggaaatattgttcactcaacacggatgcattagaaaataaaattttgcttctagttacatagcaaacagagatgctaaatgcttgctaattattgctttataccctctcacacaaagagctgacgtgccaaacaaatattgttgaataatgcgataggtagtaataaaggttcaagtgaaaagaaagcaccaacattattagaattgtggtacagttgatgacttgaagttaatctagtgattagaaatatgaataggtttcgagttaacatgaaaacaaaatttcaacatagaaaagggaacattgacttacttgtataagttgaatagactgacaccaaatattattattcccagcccaagcccctttaaccaggtaaatgtatcattgaagaaaagcacagcaacctgtcagttttaattgttacaagttgactcaaactcacatgcatgaacatagatgaattatatacataatgaatatttaaagtgaaatcaagctttagttataccaaaatagtgaccgcttccttcacaatcccagctacggtcactgttacagcacttgttacagaaaccagaacatattctgtcaaaacctgcaggtggaaaggtccttgtcatcatcttttacggatacatttcatgatatgacaactcacaacaaaaataatcagcaggcatgtataataaaaactgttagtgtatcctgactgaagaaaaaaaggactcattgcaggtattattggtgcacggcgacattcatcattagcaagctaattctgacaagtgggtacatgatccataccatgaaaaaggccaaagcaccaccaagaagcatcaataagctgctccttattatgtgagttgaattatcaaaaaagtggcttgccctgacgtcgtgccatggatccatcgcaatagaaagaattgcagttgttattgccataaccggggtaacataactcatcaacgtaaagggatttcttaatcctgtgaatcatagaaaacaaaaaggatggctgttacatggtggttcctagtttaaaaacaaatgtatcttcatgcgtatatattaagaacctaatgctacataatatttctagttcatataaccttttttaataaggattataattcatgttactgttaaagtcgaagcaataagggcagtttcaggcatgagatgcaacacaaacaaataggattaagataaatcctctcaatggacaaaaaggctatgacaaaatgcataccatattcctctttcttcagtagattccatagacacataagagaataacaaaaaagaaagtacagtcagtacatcaatggaaattaaaatataaaatagctgtatataattaagaggacatagtgacatgcccaatcatcaactttgaatcataacagtagtaagacaaactattaaagaacaaagtattaaacctggaggagaatctgtgtcatgcaccagcggaaaccagacataacagcagcaagcataataaatacaaatccccaaagattgaattctgtctctttagcaactgtccagaaagaaatttttttaccatagttaaacaatgatggagcataagataagtactaataggcatgccagtacgtggtagcatcaagcagtaacaatgcaacatctaagtgaaaaaattggaaattacaccataatccctttaataaagcaatatatacaatttggaaggtcattttgtcagcgctctctaaaaagaacaaaagagaattgtttcaaataaaaagagaactgttatttcttgatgaattcagtatttcagtacctgttagtagaactccaaaggaaacaatcagtatgattccaagaaggttaaagctgggcttctctagccttccaaagaaagatgaaaagtttagctctataacatcaaaacgatttataaaaaaaacagaagtatataagaatataattcctagacaaagcgacaagaaaaaaaaaagcgatttgcatgaaagagaaatagaacgataaaagaaacagaaccaacattagcaggttgaagcaagatacccactcaaggttagaaaaataaaaatcaacaaaagatacattacataaaagtatagatagaagcaaacattttaaatctaccaacttactcgtattgttcatgtgagagtgcacgtgtcagtgcgtgcttttgagtgctttgtgcttgtgggtgcattcattataaagattaaagcacttaagagttattaaggatggaaaaatcagatcgaggctcaatttaaggttgcataattggtatttaaatcaacgaataatggaagaaatcactttagaagaaaacacatgtgtatacactgttgaaaagaaatcaacagcatagcttacctaaacaaaaaggcaaacagaagaatgaaaattggagctgcagatttacactgcataataattgaaaataatgaattagaattccaaatttgctaaccagtacttaactatgaaaaaactaggaaacaatgattcatatagggtgaaatgtaccattgtagcaaatgttacagtgatgaaaacaagtgaaatgttgctcaaatttatgtcaagagcagtagccaaagctgttgggacaactgcagaacaaataataaaattacaatatatcatttgtaaacaatgttattcaaataaatatgatatacaaaaatacaaaacaataaaaatggaaaatatatatttacaaatattttcaggtagtatagattctggtttaacctaatctttgttgattgactcggttcaatctattagagcattgattgcatatccactaagaaatgtgatattgctcaacatcataaaagattcagtaagagaagtatactaagctccctatttgagcctgtgtgacgcattaaccacttttatttctacatgccaccagctcaaatttcatttgaataagagaggaataaatttagcatgtcatctgttctatcatggatttagcatgccaattgtcctatcatagatttagcatgtcatctgttctatcatggatttagcatgccaattgtcctatcatagatttagcatgtcaattgttctatcataatagtcactagttgcttaaggctgcaaaagccaatattgttcatgctgactggtcctaaacctgatcttgtaacaggctaactaaagagtacccttcttcttatgtcacttattagttgtgtggcaaacatagacgtaaaactagcattcaatttatttatcccctataagtccagaatacccaaagttgattttactaatttgagcgcccagctacccaatcccatgccacttctctggctaaatatgtggaagcatcaagaggcataaagtaagctacactttggtcacctcgcagaaagtaatctctccatgtcattgcactagccgctccctccaggccccggtgctggaaccatacgatcaccctcgatgccacagcctgcatcgtgaaatgcaccgtgttcatcaggaatggcgctgggaacttccacatgtgcttccccagcatctccttgttatacctgaacacacgccccacgagcacaaacagaacaccagcatcaaacatgtgctcaagcacatactccccctaatcatccacactccaaaaaaaaagcgtgctactcacagcgtcaagcaggtgctcagcgtgtaccaactcgcaattagcgcaataaccttcgcgatcaaccacggcgaaatcgggaggtcatcagatctcgccgctgcccccgcctcaatatccatcggcaagtggctgccgccgccgccgccactatcggagggcagaagcggaagctcgaactcctcggaatcgtcgtcgctggccgccgaggcaggggaggcgcccccagggggggcattggacatggcggagcagtccttgcaccaccgcgagaacgacggctccctgcggatcccgccctgtttcctctgccctctactcccctcctcccgcggcttcccggcgccctccgggaggcgctccacggctaccaccggcgcgtcctcctccttcgggacggggtggccattctcgacgacgacgcagtcccccatggacgcgggtggcgctacggcgatgaggccggctctacagcaatttggatctaagagaggcgtggatggatctcatcggcgacggcgagcgaccgcggcggcggccgacgagaagccgcgggagatgggggttttgctttcagcgaggattccggtagcaagtcaaaatcggaacacctcgtctcggcgacttcccgagcggttagctttgcagcttcgcggctggtagtggtagtttcccctgcgggcgaggaggacgctgtttttcagggctttttttttttacgggattttcagggctttttttccccacatggaaaacccttttctttctctctgagttggtatacgtgcacttgacgtatcacatgatttcgcttggagatttgtgaaggtgcgcggcccagcagatggagtcatggagatagcaccggcccatccagcgttgtcggtcagtcggtccaagtaggttggcaatttggcatgacctttaccgctggtcttctccaaagcgtccatttttgcgactagtttagacttgatactcatcatgcctgatctccggtcctcttatcaagtctgtactcatgttgcaacaggtatatctactcacagcactaagggcctgttcactttgatgccaaaaaaaccttaccattaccaaaattttggcatagttttggcaacttgccaaaaatttagcaagatttattatatagttaacaaaatttggtagcaaactaaatgtagccattgttttggcaactttaccaaaatttggtaaggttgaaaatggcatcaaagtgaacaggcatttaaagtcaacaagaaatgcttagagatacagatactcgacgagtagtagaggaaacacttcctatgggaatgctcgaaaaacctcgttggcgaaaaacacaaagtcaactggataagaacatgctcgccaacaatcaatagtggtatagggatgctgaacctaaatagattcgtaagagctctaggagtaaggtggttattgcaagaaaataaagcacgggaaaaggctcgatcgggtgggcctcttaacaccccatgggacaacttggtcagattatttattgtcgcaaaccacaaccctattaattgggacgggtccataatccacttttgtgactcagcctagatctaaggtagacgatcaaaggacttagcaccactagtctacgcaatctccaagagaaaaaaaagaccctaaagcatgccattgaggagagcacgtggatccaagaccttaacttctcaaacattgatgatgtgacggtggagctcatcgacaagctggtcactatctggagcgtagtgcaagagatacaactcgctgacgaccaagtagatgaaattacgtggaagctcgcaagtcgtggagactcgagagcacacattggaatatacctacaagtacagtttctcgattcagtttgcacaaattacgaaataatcattgggaaaacctggggcctgaagaaatgcactctttacttgccttatcgtgcataatagagtgtggatgccaaacagaccagcaatccaaagctggccaacaactcctattgtcatcgcctatgccaggcataccatgagaatggcctaccacctcctcgtggaatgcagatacaaaaagaaaatatggagcatgctatctcatgagaaacttagaccagggaggtggcatgtgtctacgtcggtatacacctagtggatagcgctagcaattgccaaagatctataccaaagaatggagtttgctcgtttatcctcctcatggcttgataggtgtgaaggaaagtaaccaaagagtcttcgagcataaagatcactctacaatagcggtggtggcaaaaattaaggaggaagccaacaccgctttatagctcatcccctgattttacttttctttttacaatttctcgcttttacttgtacaaactatttactcatgttttattcaatgatatcggcacacttagtactagttcgtcaaaacatatactttttttgagctgataatatatatcgttttagaaaataattttaccatgtttttaaccgctctcatcacttagactaatgaaccaacatagttgtgaattaattagtacagctatctttgccgcacttcatcatgtgatagttatttgtttcgctgccacttgctaataaattttgaaaaccaatgataatttgcatgcaacgtgagcagtgtgatcacaaagcctaacattatgcacctgacagcataaatcgcaggaaagagtttactccgagctaaaaactgcgaacatataaacagtcagatccaaaaatcatttcgtcattaatcttccgttcacttccatagaagcaatccagacgaccccaaaatcaaattcagagcacacgacaaaaaccccctcacaaaaagcgtttctctgagtagaagtcagacaaccatgcagtcctgcaccctggagccatttgaattctggaaactgggaaatttggaatctttcgccagataaaccgccaaattattgtgctggagccttgtggagataaaactagccagcgttgccccatgcatttctctagcttacataacaaaagcaccattacaaacagcaagagtataataagctcgagctttacactccagcatccaatgcgcgcaagttaaacaaacacctcaaagcgtgcgcactctgctgcgtgacacagcttttagcagccacgcgtgcaaagatccacgtaggcacgtccgcttcgaatggagcaaatgattggaatcagcagcatccacgtcaactagctaggcaagcacgctccgatgctccatggtgccgaggaagaagaacgtacatcagctgcgcggcggcgcaacggcggcgacgcgggcggggttgagctcgaaccagacctgccggaacaccttgacgatgcagtcgtggtgctcgtcggcgttgagcgagaggtagcacgccaggagcgtctccagctcttccggccggccgatgcgcttgctcgcgatcatctccaccatcgacgcgcggaactcccgctgcgggtcgctcgtccggcgcaccaccgcgaaccgctccagctccgacaccgccgccgccgccgccgacgccacgcgacgcggggaccgcacgcgcacggtggcagccacccgcgcgcccggggtcctcccggagaacgaccgccgcccgccgccgccgctgcggcgccggcgccggcggctccgcggccgcttcttcctcgtccgtgtcggacggcagcagcggcggcgtcgtcttcagcgccgggacgaacggagcaggcaccgggatcggagaagcggcccgggagaacgggatgaggttgcggagggtttggaggtcccggtcgccgccgaccgagtaatggcggcggcggtggtacagctgccgcgcggccgcagcctcggcggtgtcgccgtcgttgccaaccgagaggcggcgcggcgcctgctggtcagcggtcgaggaatccgccagctgctttgcgacgccgcgctcgagctcaagctcacgctcgtgctcgtgtngagctcgcgcccttgaagaagcaagaagggaatccgccagtggcggcgacggcgctcttgtcggccggcgcggcaggcttcggtttagcggcagcagcattgttcttggccgtgagcttcgagagccacgcgagcggcgagaaggacaggaaggccgccctgctcttgttgcccttgtcctcttgctgctcgtgcttgtgctcttcctcttgtgtgcgctgctgcttctctctctggttgtgtctactacttctaagcccccacttcatggctcgcttgctaccaccaggcaccaggttcttggtgtgtctgcccgtgtgtgtgagtgaccttggagtgtgaggagagacgagggagttgcaacgcttttaaagtggggagggttttggcggctaagcgatggactgtgcaatggtatgtccgtatgtgaggttccgtggtgtgtgcctgtgtggtgtacatgtgcatgcaaattctttttttttttgccccttgtgctgctattgggacttggagtttgaactttgatgctggggccatagaggcgtagtagagctttccggcatgccgtagctaggtgggtgaaaaactgaagacagctgctgcacttttcatggcacttctttctggtttctttgtttttctgcctgtgtgggctctggctgattgatttccgtgattggtgctgatttttaagctcacgcttgtgcggtgctgcctgtttgcgacgtttgattgatgtctcactttttcttaattggccatcacagattaaaaagtatgaattactccctctcaactattatggtagtacgatttaccctctaaactataataccggatatttgatgccccaaactcttaaaactgtataaattaccaccttaactcgattcgaagcggtttagcctacgtggcacatacgtggcgatacagtcagcaaaaaacaaataaaaaccagtggggcccaccagtcagtgttttttctctctccttctctgcccctctctctctttctctcagggtgaacaaaggaggtggctagcgcctggtgagcagcaggcgaggagctagggcggggcaggtgggggcagaggcggtgggcgggggcggaggcggctgcggctgacggatgaggagccgaggccagcggcgggcgggagtgagggcggaggcggggcccatggtcctacctcacccctctctctcttttctctctctgccacggggggcacggtgggcacggcggggagggcgagcggcgacggcagacgcgacgcacgagtgtcggtggccgcatccacggcggcaacgcacgagatggagctgcacatgaggcggacggcagtgaggatctccgcctccaacactggccgcccggtcgtgttccgcctcagccgaccgtcgcctaggggatctccgcctcaatcgcctgctggctgctgccggccgcccggtccagctccttcgccgccggtcgcccgggagagctccatctcagccacctgtggcgtgggcaatctccgcatccgtagtcggatgctcgggtgagctccgcctctgccaccggccgtcgagcgcatgcacctcctcctcggcagtcggccgtccgagcgcgtgcgtgagagagagaggattgggttgaggaatgggcatgacaggtgggccccagggagttgtttattttatttttctgactggaatgccacattggagctacgtgtgcaagctcgagtcaaaacctctgaaaacagtgttgaggggggttatttgtccggtatgaatagttgagggtgtaaaatatatggtatttcagtttaggagtataaatcgatcgaccacgatagttgataggggtaatttgtacttttttttctaaaaagaactaccgtaacggcgtaacgcagccctcccttcatggtagtactacattggtaggagtacatgtacgcatactcctattattctgtagtggtggtatagtacaattccttgttgcaatgttccgagattttttatgtttagtacagtaagtactcctggtaggtactgcctagtctttatagctcatcagatccacaagattggatcgctaccctcactggctcgtcagatccacaagttgtcagcggtgcactgtggatttccaccagaaatacagtatccagaacctcacggagttcacaaactagggaggcaccgcgagaggaggaacctgcaggcgtgagcttgaatgtgatccggcctttctacgcgtatgccataggtgcatttttctcatgtggctccgtggattcacatcctctaccataacaaacattaacatctaaaatattaaaaaaaataagatctacatacttataattataataatattgatatcatggtaaagaatcctgctccggctcagtaaaccagcacgcaggcaaagttcgcaaactcacacgacgttccgtctttgcccgcccgcatgctggcgctgcgacgctgcggcctttccttcactcgttcatcacgaagcggcaggcagcgcagaagcggcaggctcgctcagcgcaggtcggggaattgggacggcgacgaatatcgcagtggcacgatgaatttcgcagtagcacagacagaggctttcgccaattcgagtgggtaaaaaagtcgccggttggcggaaagctaagctacgagcgaacgagggagagggaaagaagaagaaaaaggccgtgatggcactgaggttggttggttggtttgggggcccttctacgatcgtgccaacttttcgcctttttttcatctctgcacgttcactgttaacttgtccctttgctgcctctctgatgagtaattcagcagcagcggcagcgagcgctgtgcctctttgtttgaacgagctcccgccatcttatggcttcctttttgtatcggcgtttgatcttttggtgcactctccagtaactctgtgtgggaagtgcagtaaagattttgcaatttcctgtgttgctttcttgcatgaagacatgaataattctgtacaaaccgttgcccggagccccggacaataaagatatacagtgcatggacagtgaggttcgaaccgatcgacgtgctgcaagctgcatgaggaatgtgtgcagatatgcatcttcgccagcttggttcggacttcggagggcatcatcgcatgtagctacccctgtttcagtcataagttcaaaaaaacatctagctccatcgtctcgtttggcctagacaaccaaaaaataagacaaaatttaaatttttgaacttaattttaaagttgattttgaaatgcttttaacgtaatttttgttaatgttggcttttaagtcgctacgaacaaatctacaaaaagttttaattataaattaattttaattttctaataagccaaataaaccattttgggctaaatgggcaaccgatgggagctatcgttgctttctcctctcttttttctggcgtagcacgctgtaggctcacttttagccatgtagtgtgtctgacgaagaaaatgactaaatgatggggagcctatctagagtgtagattgccgtcatagccaactgtccttccgtgtgttttttacatgttgagagcacagtagcatgcgcagttcaaaattcacatatggcacgtactagtaggttggtcctctgacagaattagggtgtacccgcattgcctctagagttgctagctgctgttcttatcaagaagttgagggtacgtgcagactccagaaagcaacgaaggacacgtgaatttcacgtctaataaaaaagaaaacaaacaagttgggtccatgaaacaatcgagctgcaaggcctagtttgtcaaatgggctagattttaattcactagttcagcccatctccacccaagattagtagggtactcctataattaagtactactagtagtctagtacacacatgttgcccacaaggaccgagagataataatgtcaagccgacccgacaaggtaacagattaaaaaaacaagaaggctttgcccctcaataatacagcctcaccgacaaaataatccggtcttaccgaagcccttgaccggagattttgcttttaaaagcacgcgtatctttgacgtttccgggatatgcatggagatggaaccataagcccatgaacatgcatgcagtcagcagtcgtcaagatctgcaggcgttctagactggggaaggcatggcgtgcggccacgccgtcacgtttttggcacctatgtgggtgtttatacaggggtgtaaagttttgacgtgttacatcgaatattatataggatgtcgtatggggtgttcgggcgaaaaaaactaattacagaatccgttagtaaaccgcgagatgaatttactagtctaattaatccatcattagcgaatgtttactgtagcaacacattgtcaaatcatggagcaattaggctcataagattcgtctcgcaaaatagttgcaatatgtggaattagttatttttcagtctatatttaatacttcatgcaggtgttcaaacgttcgatgtgacaatgtgtaaaattttcacttaggatctaaacagtgcctctatatctctagcgcgacatgccgtggcccgtggctattgtatcctgtttattacagcttttctcttatagcgggtttaacggtgtagccaactactagctttaattcatttgtagtcaatttaataattaatttatgcaatagttaactacaaatatatactacatcattaataattggtctcatatgtcatacacacatagcgtcttaaagtctgtgcatttgtagcttatttctcttctctctcctctcttatcttctctatgtgtgtttatagctacttcctccgtttcacaatgtaagtcattctagcattttccatatttatattgatgttaataaatctagatatatattaatatgaatgtgggaaatactaaaatgacttacattgtgaatcggggggagtaacttatattttgttattgtacctaggataacctgcttacataagagccctttcaagattatagatttttcttattgatttttgagaaaccctcataaattaatagctccgtaaggactggtgcacatcttaatttgactttaccgccggataaagagaccttttgttgtgacttgtttggttttttaaaataatggaataacattttggtttttctcaacgatctacaactaattattacaaaatccacacataaacaaattcagtacacactgacatgatataaagaaaacgcaacctaaaagacactaacacaatataaaagaaccctgaattactgaattctattcgagaatctctatccaaagttggcaaacaggtgcataatcgtcgactcaagtttacgacatgcatcatttattaggatatcatcatcgtgcctttgtagcttgatatcatcatcatttattacttgtttggtagacgcgttatattccgtattaggtttttattttggaacgaaaaagtattaaggtagtatacttttttaaatataacttataacgttttagatttataatatttttttatttagataggaatgatcaaacattctagtcaaaagcgaacagtgtcacgcatgtaaaacaacagtgggagtagtatttcttactagataaatacactgtcgcgttgctacgggaaattaagttacataatatgtacaaatatgatgtaatatgattattaaaactaaaaccaattgaaacttattaatttttagcctataaataattgagattgcatgatactatgagagaagaaagaagagacaatttgaacctagacctatcatttaatggttaaaataattgggggtgatgtgacttaatgagagaggggagaaataacaataactacacttagcgaggatgaactatataattacataggattcctcttggataaccggatatatgaatgcaatactctgaacttgcatcaaaagctaacagcgtcacgcatgtaaaacaacgagtagtatttcttattcctcttggataaccggatatatgaatgcaataccttgaacttgcatcatataactccgtgaagatggtgggcttttttttcgagaaaccttcaaaaaaacagctccatacgaggccatgtataatgcgtggccttggacctatggtctcagcctccacgtagactcggatgccaccgtggaggggaagagtggtttcacagtgtgtcggaagagctggtagaggaaacaatggccgaaccgcgcctcaactcagagccacggtctaggtcatggattgggtgaatcagtggcctcagcaagtagctcaaaggaggaggagagagggacctaccagatttgagcatccggcgagctcctctgtgccaccggagagacatcacctcctcgaagatcgtcgtcgtgcgccgccaatgcctccgaggagtccgatgagtcgccagcgttcggatccagcgagccagcgtacggatccaacgagagctcctcctccctgccgccgccgagaactcgtcagtgctgtcaccgagaactccacgctgccaccgagaactcctccccgccaccaccccgtcgtgttgctgccaagctcaccatgccgtcg

SEQ ID NO: 80503 - DNA, 33113 bp, Oryza sativa
taggcatatatgtatgtctagattcagtaacatccatatgaatatgggaaacgctagaatgacctacattattaaacagagggagtatcttttttttagaactacatggaatgtatctgaattcaatgtgtggacataccattgccattttttttgaagtcaatgtataaatatgcccttgcaagcactgtttcttcccatacttttacttttttaaatatacattggaaaaacgtgccttgcacgggcattattactagtaataggtaaagatataccaagtgcgaactgccaatactttttgctacgagaaaggagagggcataggtgtgttgtgttttcggtatattggtgggattgaattagcaccgccgctgggaaagaaccagggtatgatggagtaatgaatgcctgactctagctagtgacaagggtttacatgaaaacatctataaacttgaaaactattgcaaaaaatactcaaaagcttttaaaacgcacacatataagtgagaatttagataaccatataaaattgtaagaccaaactaaacttcgttttggagtcatgaaattaagtaattaacaaatggctaaaaacattgatcttcagtttttattttttcttacctattttgttaatattgtatctaataaatgaagtcaattttaattaatcttgtaattttgtaggtttactaataacactttgcagtgttcaaaatacataatctatatattagcgatatagaaatgttcagttttgagcttagaacatatccccctgatgagaaatctgcacaaagaagtgtaagaaacgtcaggaacacatgttgtatctgacatgaaagagcaacaaacaaaataataagaaaattatgtgattaactgctatatatcctcctggttatgcatgcttttagttctgttgcaaagagtgacgttgaacccccaccaaagaacaatctttccaatttccacaaatgacagcagcatttgcacttagacaatccaaccaaaccactcaaactcattctcaagcaatgcaactaaataaatgaaaatttaaaataccatattattttgccatggtttattaaatataaattagaaaaattctaaatcgttacgagtcattcatgttaaaatacattttcaatcatgtgctataaattaaataacatgatatggttagaggtaatggctagcacagcatgtgtatatatcagaagcccatgtatcagatgctaaaatgccatggcacatttaacaatgtcctcgataagcaaaatatgacttatagagaaaaccgtaattttggctcaaactgaagatcaagacagagagaacaataattttgctcaatctgaagaccaataactgcactgaaaggaaattctaccattataagtacgagaatcagtccaccatttgggtaattttgtttggcaaaatttgctacaggacacgtaaaaaacatgtaattagctgggattagctgggagacaccgcgaaaacgtgatatggctgatggacactacaaaaattgtgtaattggttttaggacactggtcgtattattttattatttctgggtcaaaagagatgagatattttcctaaatacccggattgccacttctctttcttcgttttctccttcgccgggaacgcgcgcggtgagggtgaggtcggcgaggtcggcgcgagcggggcggtggggtgagctaattacatattttttgtgtgtcttgtagcaaattttgccattttgttttactaattacattatgaggcaagtactaattgcaagcatattctcattttacccactattatcttgtaaaaagtcgaaaactgaaggcattcctaggcccctgacaagtcttgtaaatcaaatatgttaaagataaaatagcatgtttatcttctttctgcttttgccgatctcctatccaatcttcccgattctgttatacatcggttgagagattctggtatggatgtagctatatatgtacacatgttccgtgattaatcgatatcgcgttgagctatccctgctttcatggtatcagatactcccgatccaatcgcttccgctaaaccctaaaacctcatcgccgacggctctctctcctgccggcgcccatgtagtccgtcgacgacacggctcttaccgcggcggtcgcctccatcaccgacgccgccacctctgccatccggcaggtccttcggcccgacgactcggcctcacctgacgaccgtgccgccgccacggctctcatcgacgcgacttcggccgcgactgccaaggccgtccaagcggtgatttctgctctcgtcatcacgcctatcaacgacacggtggccacagcgtcaagttctaccttcccgacaacggtcaccgttgacgccgcggctcttcgcgccaccctcggacttcctccagccagcgcgaccacgcaaccgcccatcggcctcggctcttcttcaccggccgaccacgctagcctgttcgctgcactcagccttcaaccaccacagcacgaacgagaacgctaattagcgttcagtcgcgcgccccctcccccgcgcgactggacgcgtgtcgcgcgcggggaggagggtggaggacggcgcgtggaaattttttttttctggtggacggtttctttttttcttttttctgtttttttctttcctttttttggttttttctgtttttttcttttcgtatctttttcagttattttcgttttatacgtatacagactttgtatacgtctatacaaactttgtatacgtctatacaaactttgtatacttctatacaaagtttgtatacgggtatatacaaactttgtatacgcgtatacaaagtttatatatgtgtattttttatttttatacatacatgtaaataaaaacccaaaacttttgtatatgcatatacaacgtttgtatacgcgtatacaaagtttatatatatgtgtgtatttttttatttttatacatacatgtatataaaaaccaaaaatacacgtatacaaagtttgtatacgtgtatataaattttgtatacatcatatataaactttgtatacgtgtatatatatatatatatatatatatatatatatatatatataaacaattataatagtactagtattacaagtagtagtaataatgtactagtggtagtagtattagtagtagtagtagtattgtagcagtagttgttgtactaatggactaaggcaggcaggactgaccgcacgggtgcaggcccgcgcggttggtcgccgatcagccacaccctagcacgaacagcccgccggctccatgtccgggggcgctctgccaacctctgacactgtcgatgcccttcatgcccaggcggtgtctgttctcaatgtcaaggtgcttgtccccgtcgtcctcgaccttggcgccgcaaattaccaaatatgccctcaccgaccacgtcctctctgacgacgcttttcctcatcatgcgtcctgggctcggacggattgtgtcgtgctctcgtggctctatgggaccatcgccaccgacctcctggagaccatcattcagcctgatggtaacgcacgcctcgtctgtctctccctcgagcagatgttcctcggccactaggaacagcgcgccatcaacctcacggctgaatttcacacgttcgtccaaggtgacctcggcgtgaacgactactgttgacgtctcaaggctatggctgacactcgcggtgagctcggcgaccccgtcaccgaccagcaacttgtccttgcaatgatcggtggtttaaaccctaaatatgaaattctccaaactattattcctctgcagtgtcccttcccgatgttcgtcgaagcccggatcgagtaagctaattctcaccgagatcaacaagggcccctccaaccgctccaccaactcctccaccgccctcatgaattgcacgccacggggttcgggaacctaaatcaaggcggcggcaacacacaaggtggcggcggcaacaacaaaaatcgctgtcgacgcaacgggaacgggggcggcaccgccggcggcaatggcggcgccgctcagggcacatgtggccaaagcgtagggcaggctgcccctcagcctcgcgctggacaggcctggcccactcctcagcacccctgggtcggcacgattcaaatgtggctgggcggcccgatgctgcgtgctccagggattttgggccctcggcccacttctccttttgcgggcgtggcaatgtccggtgggcaagctgccctcccgcagccggtctcccaggccggcccttaccttccagccggcctcactcagcagcaacaacaactgcagccatcggcccaaccaacgtcctggtacggagcctccagcccaacacttgcttgggaccaacagactttggcaagtctgtttcaaaccgacaccctcacgacgcctgcctccaacggctggtacatggacaccggtgccacctcacacatgacatcggacaccggtatcctatcctctcacccaacctacctacgccactctgtcccacattatcgtcggcaacagttctcttttgcccatcattgctactagcagtctggcaatgcttcatttcttcacgctaatagaatgtttgttctcaataacagtcttgtttcacctaacattatcaaaaacctaatctctgtttgtcggtttgtcactgacaacaatctctccattgagtttgacaagtttggtttcactatgaaggatctacttaccaggaccgtgatcgccaggtgcaatagcttcggtgacttgtactcctttctggcgaacttcttcacctccattgccagttccttcgctgccactaccaccacactctggcatcgccggcttggacacattggtcacgacgccctcacccgttttgctcactccttggtcatctctcctcccaaatgcggctcctccaccgtatgccatgcgtgtcagctcggtcgccacatacgcctatcttttgctacttctttgtctagggctaaggccaattttgagttaattcattgtgatttgtggacctctccagttctcagtgtgtctggttttaaatactaccttgtcattcttgatgattgctctcattatgtttggacatttcctcttcgtttgaaatccgacacattcaccactctttcgcattttttttgcctatgtcaggacacagtttgctacacccattcgcaacatccaatgcgacaatggtcacgagtttgataactccgccgctcgatctttcttcctcaccaacggcgtcgccatgcgcatttcctgcccacacacctcgccccaaaagggtaaagctgagcgtactcatcgttctcttaataacattgtacgctcgcttctatttcaggctcacctccccggctcattatgggttgagtctcacccaaccaaaactttagcccaacacactccctacttcgcccttcacggtgtccacccctcatacacacatctttgcgtctttggttgtcgttaccccaacctatccgccaccgcaccccacaaactctcgccacattccaccaagtgtgtgttcttggataccctagcgaacgtaagagataccggtgtttcgatccgatcaccaacatggttattatctctcggcatgtggtgtttgatgaggatacatatccctttgccgaaatgactggtgacactgcttgtgctactgatcttgctttcctggaggattttacttctcctatacaggctccaattggctccaatcgctcggggaaggctgcctccacttctcttgggcccaccggcgcatgcatcgatcggccgacccctccctgcttgccgggctgggctgggcgcctctctcctgggccggcacctgcggcctcatctccgacggcccatggggtctctactttagggccagcttctccggctcggtctgcccacgatgatgccatcttggcccatgacggcgctcctcatgtccacgacggcgcttcctccctggctcatgacggcgcaccttccccagctcatgacggcgcgtccagtacgcgcttgctgcgtgccccgcttctctagccgtcgccactcgcggtaccgacgtgcgccagaagcgcccgcgccctagttacatggccaccggttacaggcttcggcatctctcccatcgacaacaaccacgccatggtgacaaggggcaaggctggcgtccgggttgccacttcacgcctgaacctccatgccgccactctctccctgatacctcgcacctaccatgctgcgctcgccgacaccaactggcgtgatgccatgcaagaggagtactcggcaccgatgtcaaattgcacttgggaccttgtgcctcttccaccgggcacaaacatcgccaccggcaagtggatctttcgtcacaagttcctcgccgatgggagtttggaccgctacaaggcgcggtgggtcctctgctgcttctctcagtgccccggcatcgtcttcgacgagacctttagccccatcatcaagccagctacagtctgcacagtgcttagcttggcagtctctcgtaactggcctatccatcagctcgatgtgaagaatgcttttctccatggcaccctcgcagagacagtgttatgcatgcagccatctgggtttgttgatcctgctcagcccaactctgtttgtcgcctgaacaagtctttgtatgggcttaagcaagctccttgcgcctggtacagtcggttcgccacttttctccgctccgttgggtttgttgaagccaaggcatatacttctctatttatttgtcgacgtggaggtgatgtggcctacctcttattatatgttgatgacattgttctcactgcttcgtcgacatcgctgcttcactggacaatctcttctcttcagtctgagttcagtatgaaggaccttggtgagctccatcactttctcggtgtttcagtctctcgccattccttcggcttgtttctcactcaacggcagtatggcttggagatattggagcgtgtaggtatgttcgactgcaaaccgtgtagcaactcggcctggtattcagtatgctgttcagcagatttgcctccacatgcatgatcctcgagagtctcatctcatagctctcaagcggattcttcgctatgttcgaggcaccctggatcttggtctccacattcgtcactcagcctcacatgatttggttgtctactctgacaccgactgggccagttgtcctgacactcgcaagttcacctcgggatatgctgtgtttttgggagataatcttgtttcttggtcctccaagcaccagactatggtttcctgttcgagtgcagaggctgagtatagagttgttgccaacgctgttgccgagacatgttggttgcgccagcttctccatgagcttcatgctcctccagtcaaggctactctggtctactgtgacaatgtcagcatagtttatctcttgactaacccggtgcaacgccagcgcacgaaacatgttgagattgatctacactttgttcgtgagaaggtcgccattggttccgttcgcgctcttaatgtgctcacacattatgctgacatcttcaccaagggtcttccaactccagtcttcacagagtttcggtccagcctaaacgtttgttcgaacgacgttcagtctgcgggggcgtgttagagataaaatagcatgtttatcttctttcggtaaccgcgcggttaccggccttaccgcggggtacggtaatagaaaaactgcagtaatctttttaaattcaaataaatttaaaaaataatttaaattttgataaattttacacggtttttcacggcgcggtaaccctggccctgacggtttgggaaaccctttttggcatgcatactggatgctcgaaatcggtggaaggctgcacaaaatttgtactgcccaaattagcagcgagcagagccaatgaaaatctgtaaatcccccacagtaataaaggaaatggaaatccccaaatcagctgcagcgagaggctctggcgccgtcctcgtcatctccacactactcgagtagtccatctgcacatgaacagcttggtggataggcagatcggacggtcgaacacaggtgatgaatgaacagtgtaacagttttactaatttgttgacaattagtaaaaatgtattcgattttcaacttttttgggttcaaatttcctgaaaacttggaatttcagtctaccgattctttttggactctgacatcttcatccttcctcagaagttagcaacaggcatgggattgcaacagtaattagtatagcttccttcactgttcttcgataaaaaaaaagaaaaaaggaaaaaggagtcgaggacgagcagagagcacagcatcagttttatttcatgactacacaacgaccggtctctggtttgcctaaagcagcgatcactccatcctagatttaaatcttattttagcttaaaaagtactatagtgcatgtttttttacctctttaatcacttgtatcttttaaatcatatattatttttaagatctatttgtatcattgtactccacttaaaatatgtgataaaacgagatccagattgaatatattaaaatattttattaatttaaaagtaatttatttaaattgtaaaagtaacttagctatgtaatagaagtaactctatatagaagtaattacattatgagtgagttccaataagaaactatgtggagtaaattcaaaagtgtagagaagattttcatgtaaatacatttatgaaagtaaatttaataaagcctgaaagtaatttacaaaaatcataaaagtaacttagtataaaatgaaagtaagttgttatgatattagaagtaaattcgtcgtaggaataaaaatataagtctatttagaaattaaatttaatcaacacaaattatgaaactgagtaaaaacaataataataaaagtaatcaactcaaagcattatgaaattatgagaagtaatttaatcaaatctaaaagtaatttgtatataagataaaagtaacttacatatattataaaagtaatttataacataaatgttttttttatcataatattatcatgtaagatcttgttataaagatttaattgcaacgaacacaatggtgtaatcggattatagatcggataagtaatttaagtgaaaattttataagaagaaaaaatatgcacaacctaatagaaaaactgcttacatgcatgtctgtaatgctactaatacttctcacgtaattgtccacgtcgctcgttaagtctaaatcgagatgcctctcgaaatagattttgcgtttattaagatactccctctgtttcacaatgtatgtcattctacatcaatatgaatgtgggaaatactagaatgatttacattgtgaaacggatgaagtagtagcgagagatgcatcaagcatcaatcatggaaggttgagtagctacgatcaggtgtttgtaggaaatactaatatcgtctcaattggctagccacagaacatagccctgcggcatgtagtggcagatggcgtcgccacggcttgccttgaggagctcgaagtaggcactgtcccaggtggtggtgttgacgtggcacacgtcgacggcagtggcgccgcccaggcccacgccggcgacggcgtggaggtcgaccctcagcgccaccgcgtcggctggccggtggcagtagtacacctcgtatggatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgtggctcctcgccgccggcggccgtcagttcgccgcaggtgcggagggtgtcggcgacctgcgccgccttgtcggatccagggaggatgccgaacatggcgaggatggcgtccatggcgcggaggttggacggcacggcgtcggccttgtccttgtagatgatgaaccttggcgccgctgcagccacgccgtggtcgtcgtgcgccagcgtcagcttcgtgccttccggcaagacacagcatcccggccgcctttgtgtttttggcattctctaacttgaggatgccagccaaggctaatttcagctggctgcatatatatgcaaggggcggtcaagttacagaatgccaaaaaacacaaaaacgacaatgcaactcagccattgatttgtgtgatccttcaatttgcagtgatgatccaaaactaattctaatctgcttagtaactaattaatactagtctgtatgactgtatatgctgcccttttatagcataggagccatgaaaagcatgtgtcatctcggcaaagagaggtgcaaagtttgtgagtttcctactctctctgcatatgcatatgcactaatccctttgtttttgccctgataacctatacatctcattattgttcctttttttttcaggggaaagggataattactcattagcctcctcacagataaactgcgagataaaagtacacttattgtccggccaaaactgtgtgatcttgtcacaacggcccttatttgctaaatagtgactaatattattttgacttctaagacacttactgaagctaatatccctatttcccaccaagagagaatctatctccctgattaaaaacgccagctccgatttagcacctgttgcatcgcggaaaagatggatcatcgccaagcagtctgtctcaatcactattggcagcagggtccattgtagggcgagggcaagactatccctgcaggcaaggagttccgtttccaaagcactgctacagcgatcaacatgtccacaagcagcaaaaataacctctcctgtgcagttgcgcaacacagcgcctataccacccttgccgtcactctcctggaatgagccatcaacattcagcttcatgcttcctaggagcggcttcgaccatttgtcaggaacaggttcttgactccgtttgatgttgtgcgacttctttagaaccacatccacaacatgtttccccttctcaggacttgcttgggggtgttgcttgatctcagcaagggagaggacatagctttcaatgaaacgtttggacactagtattcctggggctggtttgccatgcactatttcattccgtgtgtgccagattcgccacagtaccattaaaagcataacctgttcctccggctgcgactgctccaataggtccaagatcactttcggatctccattgcgaatgttgctgagagggttaagcttcatatcaacagtcatcgcttcccagaattgccgggcatgtgggcagcgaaacaaagcgtgaacaacatattctgactccaccccacaaatggtgcagatgtctgaaacttcaagcttcctcttcttcttattttccaatgttggaaggctgttagtaatagctcgccaggcaaaaatcttcaccttttggggcgcattgcatttccaaagggcattccaggctctgctatttccattcccggacgaactcgagccttcatcaacctgtgccagagctattgccagatgataagcacttctgacagaaaatctccccagtctatccggatgccaagcaatgaagtcatcctccagccttgaagataaacgaatgtttaggatggcctctgcgtccatgggcaggaaatgctgcgagattttgtcagtatcccaggactcggactgatcaatcaggtctgaaacccatctcagtctgcaatttcttttagctgagatgggtcttcttgaaaagctccgcggaatccagggatccctccacaatctgactgatttaccgttgccaatgcgccatatgatgcccttcttcagtaattctaaaccatattcgatcgctctccagcctggagaggcattacctccaaaacttgtatcaatgagagaaccgttcgggtagtatttggccttcaaaattctagcacagagactgtctggtctgtccaacaatctccaggcttgtctagctagaagtgcctgattaaacagcctgaaatccctaaaccccatacctcccttcaacttccgagcaatcaaacagtcccaggatttccagtgcgttctcctcttccctttctctgctccccaccagaaattacgaaccagttttgtcaattcctcgtagaccgactccgggagcttgaagagtcccataacataaacaggcatggcctgtaggaccgctttaatcaaaatctccttccccccagttgacagaagtttctccccccacagcataattctcttccataatctctcctggaggctttggaattttcctttggtcattctaccctcaggcatcggaaagcccaaatatttatcttcaaaggagttacttatctgcagggtctgctttatctgattttggacagcagtaggagagctttgcccgaacatgatggagcatttgcaaggatttatcaattgcccagtgcaggaagcataagtttcgagaacttctttcatcactaccgcctgatcatttgccgctttaaagaacaacagcgtgtcatccgcaaacagtaaatgcgacacagcaggagcacgccggcatatctgaattgggttcatagctccctgatccactttctcttctagtaacaaggacagtccatcagccacaaaaaggaataggaagggcgaaagaggatcaccctgacgcagacctcgtgatggagcaaaggtgttcaacagggttccattaagtttaactgcatatctcaccgaggttatacatgccataatccatttaacccaacagtgagcgaaacccagtttaaccattgcttactccaaaaatttccagtctacacggtcatacgctttggacaagtccaacttgtatgcgcagtaagcattctcaggatttttattcctctgtatatggtggaagcattcgaatgctatcagggcattatctgttatcaatctaccagggacaaaggcactctggttctgtgacaccagatcatccaggattggtcttagtctgttcaccaaacacttagacactattttatagaccacattgcacaaactgataggtctgaaatcctttagttcctatggttgctcagttttcagtatcagaacaatggcagtctcattgacccccgaaggcatggtacccgaagagaaaaattcttgtacagctcgcacaatgtcgtcctttagtatagcccaattcctctgatagaaccgaccggggaatccatctggcccgggagcttttaacggaccaatttggaacagggcatttgcaatttcctcttcactaaaggttttgcatagtttctcattcatcgcatctgtgactttcggcttcatcaggctagtgactcacgaatgatcaatactggggtcggcagtgaacagcctttggaaatactcagttgccatacgttccaactcttttgtcgtactgtgaacagtaccgtcactatcccgtagctttgtaatcttattcttcttagctctccacactgctttgctgtgaaagaaacgtgtatttctatcaccttctttcagccaagcaattcgagatcgttgcagccatatcatctcctcacggtacagaagttcattcatttgatcggacacccgtcttatttccctattgtcggcattacttagaagaagttcagatagtttctttctatttttctcaatctcccggctgacattcctgaactttttcttactccatgtgcgaagatcagacatcatcctaaacagagcttgattaatgtcgcgcagatcctgcttaactccggaaacgccccaagattctgctataacttcagagattgcagggtctctttcccagtaaatttcataatggacacacttcacaggattcctgtgaaggtcttcagaagaaaatttgacaaggatggggcaatggtctgatctaggagaggacagatgaaacacctgtgctgtagagaacagtcccctccacccatcatctgcaagggcgtagtctaggcgcactttaacattgctgcggccttctctcctattatcataagtgtatggcacccccgagaaccccagatcatggagatcacatctctggaccacatccctaaaggcttgcatttgcagctcacttcgttgtttcagagagaagtgctcaaactgccaaagagtctcattaaaatcacccaccactaaccacgggggatccgaaacttgcttaactgaatttaacaacgcccacatacgatgtctattttccactctaggttccccgtacacaaaagtagcatgccagacaggagcattcacagataaacgaacatacgcgtcaatatatctctcattcatacttataatttccacatgaacagactcatgccagaataaagccagacccccactcatcccatcactgttaaccccagcaaaacccttcaaacccaatctattccgcagcctacgaaccttctcaatcttttgcctagtctcacttaaaaacacaatatgggaacctgcctccttcactaaggcacaaaggtcacgaactgtcgccgcgttccctataccgcgacagttccaagccaagcaactcattgctcctgacgggacccaatcacaggtcccgtcagtttaccagcggccccatggctggttgcctccatatcgtctgtgtcctcaccctctgcagccttcttgagtctcttcactgctctagctgccttgccgatatccccatgcatggaattgctgccacctgtgtattgttggtattccaacaatgcttgctgaaccctcccttttatctggagtcctgactggtctggcatcctcttcctattggcatcgctgatctcctcggatgacacttccccaaacgaggcttgctgttgaaggttcctcatggctggtatcatctcagaagcagaaatttcatcaccatcagtcttcttgggtgcttccttctcctattgttgctgggctagcttcccagcagggacaaccatcgatgtttcctgagttttgtcccccgtaacatccatcttcccagcctgttgagctaacatctcatcaattgcagtgtccccttccctttccttaaactcaaacccatcatgggcatcaactctgggcggtattgcttcctgcatctgaccatcttgtttgtgtctggaggacgatgaactagcacttcctgcccctctgaagaacaagttacgtgcaacacttgatgtttgggcagctttcactttactgatcttcttctcaaaaggtttaagggggggagcatcgtagctcagctgagaattggaaaggttgatcctcattggcagatcttctattgcaatctctgtcggaatgaccaataaaaccacagataaagcaaaagtgcggtacccgctcataacgtaaatcgaacctgcgaaggacctccttgccttggacagtcatccttatagctatctgtgatttcagaggacgcttgacagggagatcaacacgaataatgcggaagaagtcatgtttgttgcgtccatcatccctcacgtctacctcacgaactttgccgagtttgctcccaaacatcccacctcttacctttgtcatcaacaccagagggaggtcatatatgcgcacccagatcggaacaacatccaaaggaacattcgatgggcacgtaatgccatcaaaactcgctaccaggagtgcatctcctctgtgaatccaaggaccccctttaatgacaaaatcagtctccctctaccgagaaggttatgatgaacatgttgtcacgtagtgatttgtagctcatatctgctctcaacctccaagctctgcgcatgtcgtcaaacagggccacttggttcggagttctcagagaatagaacctcgccaagatcgtccacaggccagcagtctgcagttcatcatcctcaatattcaccgcaaccacatcctcctcatcctccaccagatctccttcagtgaacactgcaggacactgtgttgcatcaacttggttgttctctgcagatcccctcctcgcagccgttgtgtgttcctggccctgatcagatgtgcccgctgctccctcgatcatcttcagaggaatcctgtcgagaatcaccgcgtccgtctcattaccgctcatcagcttcgggtgggaaatcgtcccaatgacgatccctttatcacccccaccgacattggccgccatgagacttccgctagatccaacaaacaaagagacggggttgacaacgcctagccctatcgccggaaaaactttgaaccgcaccttcggccaccactgtgacttgtatttatactgcaatgccacagaattaggtctccaatacaactcgaacttcggataccaaaacagattcaatctcctcccccttctagaatttcgcaagggccacagatcccctggaacaatacggaaagcagagaacgaacctttcccatagatcaatccgcctaaagggaaagccttcaacttatctcctatacgagtatgatcaggccaccctaccagatcacgtttcaacacagggaggaaatcccccccagaacaacccacggcgggtaaaacccccggagacatcaggagcagatcagaggagatctccatccagacccatctcgccacgcgcgagagctctgccgccgcccggtcgcccgggtggcgcataaaccctaaccctaacatctcattattgttccttaacattactaacgctgatatatactgtaaaaaaacttcagcatgtacaaattgatgaaaaatgttcattcattttgaaaataatttacatgagctcttcctactattcttctgctatatattggctatttagttcaaccgcttctggatagataaacctgtgactcgggggtggagctagtgttatagcaatggtgtcacatgacaccaatggtctttgctataattttgacaatctaacgcttttagaaaacatatttgaaaagagaactatatcaaaaacttatttcaaaaataagccgtcacctcagtccaatggctctgtgccagcaatcatggcgctaaccctatatatctgttaagtgagagtatatgttcctatcgtacataaaccatcttgtaccgaagtggtgttggtcatccgtttttttaaaaccacaagtagacacgtggtttgatcacccggttcccatgttttttttgtaaatttttgcgctatttcccgtgagcgatgatcataaaggcaaaaaatacgtcgagggggagattcgaacctgggacttcgtgacatctcactaagcaagtgaaccactacaacacatgcaatgaaatgctcaaatttagcacacgctgtgtgcgcggatggcggagtttcggaaggttgccgatggcggtgcagatctggccgtggctgctgtgcacgaggaaggagggaggagtcggcggcgttaggatggaggtcgccatggtcatggcacttcgacggttggccatggcgggggcaactcacggtgtcactgccggtgtggcggtgtcccctgttcggatcgtggccgatgcatatggtgcaagagatgctgtcgcgacatgacgaggcgacatccctcacagttggcagcatgtagggaattttctgggcgttggtgttggctcatgctccactggtggataggcctccccctgctatctacagtaaaaaaaactttcactaattgaataatcaaaatttcaatatttggtccaagatatagcgaaatacccatgtatcaacttatggcatatccactcgtggatctatgaggctatggaatggtgtatataagggatcctttgtgcgataacgcatgaagcgaacgcaacctagttcaatctatatgtgattattgaattatttccattgttttgtctgtcttatttcggttttatcgtttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatatatatatatatatatatatatatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacataatccatgtaaacaacacgactatccccgcccacacaatttatgtgcaaattagcgcacatcgaccgcaaacaaatggtatcaaccagagtccatccagtgctgccatgcttaagtagccaaatacgaagctgaggctccttcagatcggcgatataaaccccagaatcatcgctcgctcgtccgaacaaaacgtcgtggcttcgatcattataccacatcatcacaggtgggaactccaccccatctggaagctggatggtgtacaagctcgaggacttcaagtccaacacaagaacgctgctcgaagtggctgccaagtaggccttgtctcggaccacgacgaacccagctgattccggtggcaagccaggtagctgtgccgtcgccttggtatggacatgccatccgccgtcccggaatgcgtagaaccacgcggaagtagctccccttggggtgaacatcaccgataaccggtatagctggctgccgccatcctctccgaagtggaacccccacacattctcgtcgtcgaagccgagatcaggctcgacgtcatcgtcatcgtcatgtgttgaagagaacgggatggcgagtaggcctctctcaggatgctgcagcggtctgtgcaccgcgtatttgagctcgcgccgatcatgcctctccttgaagaggaggatgctaccgttcctgcactggtagatactggtcgtgtaaccctcgtaagcgaggctgaagttgccaccgcgaaggacgacggggtcgagctccggtggccgtgcaggcggcggcatcgggacgaagagcgggtgagcccgcggtatcttgaggctcgtgacgtagaagcccaggaggcggggcgggtggagctcgcggaatcgccggaggaaggaggggtcggaggcgacgcggagccagcgtctgcaggcgagcgcggcgcggacgagggtggtggggaaggcgaggcggagcaggatctcgccgacgaggtcatcgttctcgagtacggcggacacggcgggtgacgccgccggtggcggtggcgacagccgatcgccgtccacctcgatggcttgattcgtctgcgtcatggccacgtcgaattgaattgaattggcgatggtggggatgatggagagataaaacagcacgatgtgatcgatcgatggagggataagttaattaatccgagattgtacaactatatatatatccatatgggactccatagtgcccgggctccaagatataaaacacataaattctctcaaatttttaaaaatttacaaattgtaagtagatatctaggtatatgaatttgattcatacaaatacctaacaacaaaacaactcaaactcaactttatttcacaattcattattacatacctaacgaattatatgtttggatgttatataactagaatcaaaatctaacaaaaaaaattcagtttgaaagaagttaattgatcatatctaaacatttaaaaaaaattcatactcattcaaattgggtagatactcaatttgaattttgaaacccatactccatgtagcaccagttaatttacctatatatatatatatatatatatatatatatatatatatatatatatatatatatatatatatatacataaaacccaatgtgaatttgagtccttttctttcttgaaacgaaagtttgagaatcgtacgtgttaatcatacagatcaccgcagattaaagtaaaagcgcgagcgaggtggcaatgcaacagatcgatcgtagagatcaccgctataattctaaaccccaagtcccaatcgatttcttcttttatttttgcgaggaaaagtccaatccttttaaatcgtgtttcccttgttgtgtgtatttttccatttcttttcttttcttgaaagttgaaacaactctatttctttttccactgttttagttggttttcacccgggtttacattaccgctagtaaccacggtaaccggtcttgccgcggggtacgatatagaaaaactgcggtaacctccttaaattcaaataaatttaaaaaataatttaaattttcgataaattttgcacggtttttcgcggttaccgcggttaccgtgcttaccgccggggcgcggtaaccccgagcccgacggtttgggaaaccctggttttcacagttcactctaccatggacgtccgactgtgttactttatcttaactaattaaaagattcgtaattttcctttcttcacctaattttcgtccgtatgcacgaccgcgtcgctcccatcccatacgcgcaaatgcgcaaatctgcaattttccgttggtcaccccaacttttcatccgccatgtccgatgtagcgacagcctctgtccgttacagcttacaaagcacaaaaggatcaatcaaaatcccaatcggacaatcattagttattccaaacataagatcgacgctacaaaaattataaaggtggaagcacaaacacacaaacaaatcccaaccccccgcccccacccccacacacacacagaaaaaacaatttttgccttaacttgcagcagctcgtaatgtggcaaaatccagttgcggccgaatcaaatctagctgccgaggcaaagacatcactgatgtatcctctttctagccatctcgccattgatggaggaacaaaagcaatggtgctcaagtgaaagtgggaggaaaggaagaaaaaaaaaatcaatggatctaacccccgcgcctcctcctctgtggagacatcatgccatcctcgccgtcctccttgccaccgtggtcctcgatgatcgagtaaatcttgaggcggtggtgagatggtggtagtatctagcggcggcggcgacaagatggtggtggtgtctagcagcgggggaaacggtgtggggctcccctactctcaactcatcttctttccagtcgtcgccgccatcgtcatcgtccaccgcccgctcccgcgcccatgttagccatgacgtcgtccgttcaccgtcagccgccttgtccgctgtgttgtcgtcgtcgttcaccattagccagttcgtctgcccacgctcgcctgtgccatcgtcggtccgccgcctgcgctcgcgtgcgtccaccacctgcgctccgggcccaaccacggtgctcctccccgagcacactcgccaagctgtggcggaggaggacgacgatgccggcgggtggatgtacgacaaagcggctgacatgggcgcgtgcgggcggttgttgatgacgatggcagcgacagaccgacgacggcgcggctaacgcgggcgccggcgcaggcagtggcggactgacaacggcggtgccgggcggacggccgacgacgacgttactgactccaagagacggagtggcacgaaatgaaaaaaattcgtgctctaatggtatattctgaaagtagaccgaattgagtggcatatcctgaaagcagtgtgtattcgatagcatattctgaaaattcttgcagtagagggagggggagaggtggagacggaggtgcaagaggataaggagaactggagaagtgcgatatatttttttcctcatctcgtgctccactcagctccacatggccacgccacctgacgtcggttcggtgccgtttttctataaaaaccgtaaaaaccagatcttatatcccatatatctatataacggttaaaaaaaatctaaaaattcgtaatttccattcgtcacctctctttttcgtccgtaagtccaagagtccctacctagtcctcccccattcaagcaaaactgaacaaaaattgggagggcggataaaagttcaatacgaaagacagatgcatattcgatctggactaaaaaacagatgaaattaaccccataattacaaaaagatttcatggatctaacctggtggcggccctcactggtgaggctcttgggtgtcggggtgttgagggagctaggtaatcgataaagacaccgggaggtgattcccagcaacggcggctctcactggcggcgatgtcgaggaagcaggcggcggtggcaactttgtgaggcggccgccaaaactcagtcgcctccgcgacctcaagcctccccggctggcagatccgccacccacaaatttggtcgctgcccacgcgccttggccattgcagctgccatggggccatcgccgagagacaacgggatccaggcgccggtggcggatccacgcgagtatgaatgacgccttggagccggtggtcgatatggtctgcgacaactcgggtggaggagggagagacgcagagaaagactggatcgccgccgtccactttctcgtgtcgccggagattggatcggggagagtaggggagaaaggcgattagggttagggttttcggaccctcccctccaaccggcgatttcattggcacgggaccaatccgagccgtccatcagatcggacgggtcagatcggccccgcgtcggccgccaccgctatcgggccatgcggtccttgggccatggaagagaactgggtcgtgcgcccttcgccgcgctcagttcgccctgcgtcaggccatcgccagtaggatggcccgcttgctgtgcaattggctcgtgtgcttgcgctgaacgggccggtccaattttttgggctggttatgaaagtaatagaccaaaataagattttatttaattctgtcgatttaatttatttagtcttttatagaaattttctttggtattatttggagccattttaaaattgctgaaaaattatgaacgattacttgatcactcttattgtcatactagaccgcttaaaagatggctcagttaaactttatccaacacgacattacccggtgcaacgcatgggcattttggtagtatatactgaactagcaatgcaaatggcccatagtaacaacagggttaagaaattagatgcagctgtacctaagcagaaattgatgttgcaaactacttcctccgtttcacgttataaaactttctagtattgcccatattcatatagatgttaatgaatctagacatatatattcattcttgcatccaaagggactaactaaacttttattgagaaactaggaagatactccctccgaccggatgggatttcatagtacagcgaatctggacaggaagcatgttcggattcgttatactataaagtgtcccattcgatactaggttgttatatcatatgacggagggaatagtaatttccatcactttgcacccatttaccaaacatgctacactaggacttaaaagtcaaattctagtcttactattaattaatttcccatcaaaactttctatcctcttcatcacaaaacatgctagacttaaaaatcaaattctaatcttaccattaattaatttcccatcaaaactatcagcagccgcactactatttcccttatataaactcgcagtattctctaaacttgccaaacaggcccacggctgtaaatttggatttcaatatatggcaggtgcgattatatttcattaattaaggaatcatactcttgtgttgctgtaggtggcaaataaaaggggcattaattctccacataagaagggcacgaattagatggtttccttctatatatatgattattacctctattggattagcctaaacaaatctgtactagtactgtaataaaaaaaatccccacataaatacaggagtgcagtacatatgaaccccttctgctatgaaaccctgtggaagacggctggccttggcacagcgcatagcagccggcgttgagaaggggagcgaccgatcgtactgatcgatttgttaggcttttaggcataacgaagaagctagcaggtaagtatatgcctgcagacttgtcatctctattttgattcttcacattggtcctcttgttcttttccttgtattcatccatgtacacccgattcgagaatctgttttcatttttcaaaacaaatagtccatattactttactcaacttttaattaaattttactagcgctatacccttactttgccaagggattagaaggaaaaattacgagggttgagttttaaccatctggttttactggtgggatgagttttgggtggaaaacatgtgttttttttttgtcgaggtgcgtttctttacaacgaattacgatgtagtaggaggagggcgacttacactttttagagcaggtataataaggttgagtcagcaggctatacgttgttacacatcagcgaaatcctatgtggttgagggagaaaagaagaaagagaaaaaacggacgctagatctgttgccgggcgatagtgtgagaaacgaggctcttaccgctcgcttgtagctgatacgggtgatacctgacatatttggtgggcctgacatatctccactatccaatgtgcatgtatttatgtttttctccctatctaacacgctagagcacaggcaacacaaatagctacagggatggtggttagttttgatcatgccaattaatttggttgtgcatgcatgaattaaatgttttgtttatctccatttagctagcgaagcagctagctcatcgcgtgagctttctctcttgacggctatatcagacatggcgactgcctgcgcgactcacgcagccgctgccccccacccctagcacgagagcaagtgaacattagttgaagagatttagctgttgccactgagatggaggaaaatagatgataaggggaagaaagaaaccgttactaacatgcggggattatgataatgctataagcgttacatacgtgaaatccacactaatttgaacttaactaatatttttattgttttctttaaaataagaggattgctacagtccagcaggttgtaccgggcggtaaaacaaatctaaccgttgaatcgggatgggtaggatcgggagagaagatgagcgtcgggagagaaatttaaccggcgttcgagtcgtcgttcccggcggcggcggcggcgtcgaagtcgtcgttcccgacgggatagtccaggagacggcggtggttgatcctggcgatggcggagttgatgtccaggtggcggcggcgttgatggcatcgatccaggcggtggcgacccagatcgaagtcgcggtgtcagaggatgaagacggcggtggcagggcagaagcacggcagcggcgggggtgaggaagcacggcggcagcggggtggaagcacaacggtggcggggggtgtgaggcacggaagagggagacggcggcggggcggggcggcacggcccgatccatttgatctaggcttcccattgcgaagttacatttttgcccttccatctgagttttcaggtcggtattgtacaaggatagaattggtaccgagccgttggatctggccaggaatttggtaccacccggtaccggtaccgagcgctggacggtaaaaagactcttaaaataaactccaaatttactcaattttaaaataacctttaggcatgacattgataatgctacggttgtagagcatgtgaagaaaaccgatcttcagactgcaaataagtttctataagagctttttattgttcataattattataggatatttttttaaaaaaaatgttgataaactcgccacccaacatacggagtacaaacaagatgtgtttcataagattttgagaaaaccacataccgcacgtgtagcataggtaatttccgtctccctttatcacgtgagtgagtcgcgtcttctttccaactatcgatacgtcttctcaaaaaaaaaagaaaaaaaaagagggacatcactgagaaaaactacgccgacaccagaaaggctgtggcggcggcggctcatggctcctcttcggtcggtttggcaccgtcgcgctagcccctactggtaggctcgatacccttaccgcggcatttatgtgataggttctccgtgatcgccgccgacgccgacgccgacgctcgccggtgggctcgagatcgccaacttctcttctccctctctgccacggaatagccaagaatgaacagaatctgtccaactatagccagtctctgattaatttacagaaatttcgcatcgtttttgatttgtggctgacaccatcctattccccatgcgtgcagtattttgtttcatatatatatttttttctttttgaggataggcaaggagtaatgcctaacatatattctcattttcagtctgtttgcactaattttgctatttttatatttagtccatgcttcaatgctgagaatggtgagatcggatacttttttaaaaaaatctccattgctaaattaaaaagttcggtacatcttttttttttacttcgaggaagtttagcacatattaaattacatacgtattacatatgcaatttatgtaatctaggtctcgattttgttttcttggagatctgtgatgtcatctttaccatgggtgacaatggaactccgtggtatcgtgcggattcatccggatgtttttcatgcatgttacatatggctttagcactcacagttatgtttgtttcctttaaattagttattctttctgtaatcctattaacgtccatggacagactgaaattatctttttgactttaacacttttatatttttcttcgtcataaataatcagttgtaactttctaaagtttgttgttctatgatcaggagttcatggatcagccacttttggaccgtgcagcttcttcctcgtctaaggccacaagcagtagatcagctttcacagatgctggattctttagtattatcactttttcttggatggggccgttacttgatcttggaaggaggaaagcactagatcttgatgatgtgccaactttggatgataatgacagtgttcaaggcatcctccctaactttgaggcgaagctcgtctcagtttctggttcagggaagtacaccgatgttacaacaattaacttggtcaaagctcttgttcttacaacctggaaattaatcctcttcactgcagtttgtgccttactccgtactgtctcttcatatgttggtccatacctgattgagtactttgttgactacctgaatcgaagtccacagtccgctaaagaaggctacattttggtgttgagttttgttgttgcgcagttcatcgaaggcctctcatcaaggcatttgctcttcagatcgcaacaacttggtgtgcgggtacgctcagctcttgtcgccgtcatttaccaaaagggcctctccctctcaaatcagtccagagaaagcagttcaagtggagagatcatcaatgccgtgagccttgacgccgagcgtgtcgcggatttcaattggtccatacatgagctttggctgtttcctgtgcagattattctagcaatgctgatcctatactccactcttggtttggcagcatttgcagcccttgctgccactgttttgacaatgttagcaaatctacctatagggaggatccagcaaaattaccaagagaaaatgatggatgccaaggatgctagaatgagggctatgtctgagatgctgcggaacatgcgcattctcaagcttcaaggatgggaaatggtcttgtcgaagatcatggagttgaggaaggaggagatgcattggctaaagaaagatgtatacacctcagttatgcttatatctgtcttctttggagctcctgcttttgttgctatggtcacctttggaagttgtttgcttctaggcattccattagaaacagggaaagtattgtctgctctggcaacgtttaggcagctacaaggaccaatcaatagtatcccagacacagtctctgtgatcatccagacaaaagtatcacttgacaggatatgctcttttatgcacctcgaggaactatcgagcgatgttgtaactaaacttctaagaggtacaactgatgtatcgattgaggtgaggaacggtcagttctcttggaacacaccttctgaggttcctactctccgaaacttgaacttccgtattcgacaaggaatgagggttgctatctgtggaactgttggatctggaaaatcaagtttgttgtcatgcatactcggtgagataccaaggttatcaggagatgttcaaacatgtggtaggattgcctatgttagccaatcgccatggatacagagtgggacaattgaacataacatactttttgacacaaaactgcatagggaaaggtatgaaaaggtccttgaagcatgctgtcttaaaaaggacatggaaatattaccattaggtgatcagacaattataggagagagaggcattaacctaagtggcggacaaaagcaaaggatgcaaattgcacgtgctttgtatcaagatgcagatatctttctgtttgatgatcccttcagtgcggttgatgctcatactgggttgcacttgttcaaggtatttttcagaacaaatctttaaatcctttttctatatgtgtgtaatcatcattgaatgcttaaactaataacttattgttggtacttgagacttctaatactacaaaatatatttttacatcatatgatttcaacgacattttctcccagtcaatttagggttttttttaaccttcagttgtcagtgctagtgctgtttgaatagaacatgttggttttgttggatttttcatttcccaacttccaaaatcagtaatagcagtttatctcactgcatagtttattgtgtggacataaacctaatgtcttaatcagatcttttgtatgtttcagctaaacagtttttaggtagcttgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccggtcaatagcttgaaaatggtacttgtatatgttgtgttagcttttgtgagctcgttattcatcttcataagatcccatcttcttgtcatggctggatgcaagactgcaatgatgctatttgataagatgcatcgatgcatattccgagcttcaatgtatttctttgactccactcctagcggtcgaatcttgaacagagtaagtaatttaccttcaccatctttattttaatgagaaaattgaagttatctccttggaatgccattagaatttttattcatattcaattaatcatgaaagttgaaacaaaattgcaggcttctagtgatcaaagcacagtggacaccagaatttttgacctgatgggatatgttctatttcctgctatcgaacttcttggaacaattattttaatgtcacgggtagcatggccagtcttcgtaatttttgtcccaattattgcagcatctctgtggtatcagatattctttttattatatatcttatgttcgataccaattgtggttccagtttataatttttaagtatgtagaaggaaaaatacattgattcatgactatattgacaatttttcacagattcaactgaaaattgaacatcagtgtttttcttttcacagatttaatttaaaatttaaagggatggcaaagcaattacagataatacaaaataaaatcattaagtaaatatatgatgtgatacattacttggcaaaaatattcccaatcaaattttcaggttgatcctagtgtatataggagtgtccttgtacatttccgatgttcttctgaacaatcaaattttgtcttaaaatatgctattgaacaataataattgttaccatatttcaaaactataattatgcattttctatgacattattggtttcaagacgactcatattttgtgtttgtttttaattaccacaattccttcccttcagcaatattacatagatggtgctagagagttgcagaggttgactggagtttgcagagctcctgtgatgcagcattttgctgaatcagtagctggatcaaatatcattagatgctttggcaaggaaatacagtttatcaatgccgtcagtcatttcatggataatttatctagaccaagtttatataatgctgcttcaatggaatggttgtgctttcgcttggacattctttcatcctttatcttcgcatttgccttgatacttctggtcaccttgccagctgctctaattgacccaagtaagtacggtgggctttaatttgattagtcagatcaaattagttcattattgtattaacatccgtgctaactctcatatttactacttcacagagacagctggtcttgcagtcacttatggattgagtctgaatatgttacaagggtgggctattgcagtgctctgtagtttggaaaatagaatgatatccgttgaaagaatttttcaatacatggctattccttctgaaccaccccttacaatatcaaaaagtagaccaaactgccggtggccgacaaatggtgaaattgagcttcgcaacctccatgtttgtctcttgaactctatgttgttatataagttcacttctaacaatgtcggagttatatcaattattgattagaactcccaaattttctattcgaaatattctctgagaaaaacaatatgttattaaattactcccttagggttgataatacttgtcattttagacaagagcacggtttccaaaaaaacaactttgaccattatttttcattataatatgtataaaagtgttaataaatatatgattttattaaagtactttgtaagactaatctatacatgtaatcaccatatttgaaagacaaatattttaaaaatgattcataatcaaagattctatacctcacccttgtctaaaacgacaagtattatcagcccggagggagtaatttatttcttcatgaagttattccataaaaattggcatgcaggtcttttttctagtagtgtagagttgcaatcctctttcataatatactattttgtatgacttcaacataccgctgtagaaataccctcccaaaactatattttctttcttaacatggaaaacatacaacacctaatgcataattttctggtgaactgtttttttcctctaaagtgctttgtatgtgatgtaggtaaggtatgcgacacagttgccttttgttttgaaaggcctaacttgcactttacccagaggattgaggaccggtatcgtcggaagaactggcaatggcaagtcaaccttgattcaagcactattccgcatcgtcgacccatgtattgggcaagtgttgatagatggccttgacatttgcaccattggactacatgatctacggacaagattgagcatcattcctcaagatcctgtgatgtttgaggggaccctacgaaataacattgaccctttggaggagtacagcgatgagcaaatctgggaggtaattcttattttaaatttactagtacctccatccctaaataacatatggaagacaaattactatagaaaatacatgacattcataccccaaattaaatgagggatggattgaagagagagggtagttagctttagaagcatacttattttggggacaaaacttgagtgttagaaatatacttatttagtaatggaggtagtataatttgtaatgcttcgtatgtgcacctatgttttttttaaaaaaaaatatgcataactcatatctgctattcgatgggcaaaagagttcacttgtgtatatatgttatccag

SEQ ID NO: 80504 - DNA, 58118 bp, Oryza sativa
agccaagtctgtgagtccggaaaagcaatttctgcaaatcgaagcagaactgtgtaatttccattttcaagtccaaggccgtaatacctcagagatgatggcgacacccttccagtttcaaacaactttgaatcaactacattgttaaaattttgggaactatatataatgttctttgcatctgtggcccggaagtagtgtcctacactgctgacaccccatcttgtttgaccagtaacataatatgttgcagctccaagatttgcaggatctgcttcataaatggtattatctgatcctctcgttgatgtattactaccacagtcaaccgcaaaagaataatctacgatcacaaaattgtaacaatcattaaaattccttagctcatattattgtctttggttcaatgaagattgagaaatgtacattttggagatccacggaaacaaggagtgtcttgttggaggcagtttagcccccaaggtagtctactgtgcaaatttggattgaaaatttaagttgtcagcaagcattcttatagtgcaatagcaaaattataagaattagaactaaattcgtatagtgcactagcaaaattagaactaaatgtcacaattagtatgtacctgttactggtgctaccgagtaaaaagttgtttgccaccaaattcctttcacaaaacagaatattagaatatctatttttttctcagcaacacagatatcataatattacacttacaactgtaaattgttttggctagcccaagaaggaatgctcccagtgagttgattgtacgaaaaatctctgtaaacattacagaattagattatacaggagttaatatattccattatgaaagtaaattgtgctataatgccatgtcgattgtatttgacatacatcgcttttaaggaagagcttataccatcaggcaaccttcctgcaaggttattgttcccaagaaacctgaattgggcacaattcaagatgatcgaacatgttcatctgcttaataggagcttctatcaacaaattaatgtaaaaagaatttcttacaagaactgtagatttcccaaattcaggatggattgagaaactttccctgtgatattgttaaaacttaggtccctgtaccacatgacaaccatattacttgaacatatggtacagaacttgagttaatgattaataatatcatcaattggcaccatggcctgtaattgaaaacttacagcaagcttaacttttcaaacatagaaaaatctactgctccgagatcaccatatatcttgcagttcctcaatattctgtaacaatgaaatccaaccgtggtaacttgcaactagacaatatactgtaagctttatagctgaaatcatcacatacagggtgttcagagaagtcagattactgataagagccaatggagagatcccatttacaatatctccaatccgcctgctcatttatatttttcataaattagttatcagccttgacattatcaaccttcaagagtatacaatgtcacctaaagagtatacttacaaggttgttaatttggtcagattagacaaactttctgggattggtccttcaaatgaatttccttggaaagcactacaatctcataattttagaaaaagggcattgcacattttaaaataagaaaaagatataaaagttctatatgtgaccagtcttaataaaatcactacgtatgtatatgccacctggacaagttactgtgatgcagctttattcatttctatctagcgaggactgaaatgtgaaaatgcaattgtttatagaaatttagttcggtctaacaaaaagtacatcgaggtaccggtacctcatggtaataagtcgtttatgatcgttagatttagctaggtaggatgagcattgttagatcaaaaaatcaaaaacgatttggtactgtgaggtaccggtatctcgagatactttttgttggagcggagcaaatctattgtttataagtctgaatggaaagaacatgatatacagaataatttatcttgcacaaattcatctctctcaaaaataggatagaacatatgagatatgttaataagttaatattaataatcttacatttcttccaaattagtcatgctacctaaataatcaggtattttccctgtgaatccattgtctgatgctagactgcaagcacaccaaaatgtcatttatcatgaaagcatgacgaatataacagctgaggctatgcttttgactatacaggatctgcaggttctgaagttttgagaacgttgaagggaacggaccactgaatccagaactatcaatgtacctgttattgaaagtttgttattgtcatgttcaacaatagatctggccattccaaattttaattcttatagaaatagaaatatgaagttagaaatcaatggagtatcttacaattgcttaagtttggtcaagttgcctagttcttcaggaaggccacctgtgaaattgtttaagctaatgcccctaaatgaaaataaaatatttcaagataagaaattattatcatcaactaatagcaggaaggggcatagtttttcccgatgtgccatttgacccgcaatattcatcatgacaatatgttcatgtttttgctgttcgatcaactttagttgatcatttgaaagttgaaacaacacatgaacagggaagttacattgacgtgcctattacataatatttagtactgagtagtagttatgatttttttattactttattgctcgaacttatgcgattgccatttgttgtactattatattagttcatggagtccaaatatcacttactacaaaaaaatgcacatcaggtcaacactataggtgccataccagctaaaaccggtagctatagtgtttttcccacctccttaggactaaaaacataaaaaactaacacctttaagggactataggtacttgttcttgagaaaaaccgacacgtataatataggtgtcagttaattaaaaaacgacacgtaaaatatattataggtgacgatcaacactataggtgccagactagctaaaaccggtaactatagtgtttttcccacctccccaggctgaaaacataaaaaactaacacctttaagggactatagttgcttgtttttgagaaaaaccgacacgtataatatagatgtcagttaattaaaaaccgacacctaaaatatattataggtgatggtttttcagtaaaacgagccgagaagaaccggtgtgcttgaacccaccacaccaccacccaccagtccactctcttcttcctcttctcttcttcctcctctcttcttcttccttctatcttcctctccacttcttccttctcctctcctccatccatcacggcggcagcacgggagcgggggggggggggggcatggcagtgggacggaggcggcctgtgctggatctggtggtgtggtggtgctggcccctcggctgtggggatctagcaggctggaggtgcggcgcggcaacgacagccggtgtggaggaggtgcgatggcgtcggcagccagtagatccgtctcttcccctccctccctctttgtgatttgttgatatagatgtgatctattgctaatgtagatgtgatctagatgtgtattatttgatctagttgtgttgtttttctagggattattgactatagttcatggatttgaggcaatttttagatatgggttttagttgggatcggcttgacggctcaatgtatcgagctgatattttttgctcgtgtgcgcctaaaaggagctggttttcgaaccggcacctttgaccccgggtaatcagtgctgtcttcctggtaccggttggaaaactgacacctatgatgttttatgtagtagtttatatactccattttctttcgtattacctactattcaagttttgttgcaagtcaaatatatgtactcttggctatcaagttttacaaatgagtatagtttaacatagttagatttatatatatatttttagattcatcatgagaaatattgtgacaatatataattcatactcaattggttaaaaaaacaacttcttgatattttacataggacaacggaaaaatgatgagtaatttggaacagaaggagcagctgaagattaatccgcatatgagaaaatatttcttacaatgaaataagattggtgaggtttccaagttcctttggaagtggtccagatagtggattgaaacccaatgccctttaaataattaagaatagttaagaaacaataacgatcaatggatgaaacatgatatagaacatgtaactcctacaagtatttcatcgaagtgaattttccgatgaatgatggaatgaaaccagtcaagtaattatagttcaagtccctgaaaacaacataaaaaagtagaacaattagccaacataaaaaggatgttgcatggctgactgaaatgtaccctgctgttcacaaagagaatttgtgtgattgaatttttagtctgtgaaaaacttgatctataacgtaactttagtagcaggactagttaagaagaaaaagacttagataccatacaagttctctagacgggtgagattctgtagctctgaaggtatttgaccaaccacgtccaacttatttaccctccttcataacaacagacaagtaatacctataaaaaaatgtgcttgagctattaggtgttgcccaaagagagtgtgcgtacagttttgtaatgcggcatagtgtgttgttgctgaaagtgcaatcgcatttgatgaatgggttgatgttgggatagtaatcccagtcgtttttgtcagcggcgaaaccgctgcagagatcaccgctaacattccactccgatgatgcctccttgccccatctcctcatgatcgtgttcagggccaccgctgcattcatggatgatgtttactaattaactcaccactaataatcatatggatgatagctaggtcattaatgaaatcaaattcctctaactctttctcaatagaaaccggcacctatacatgtatcattccctaatagcatccccagcttatccaaatttcatcctccatattcccatttggatggccattcaaaaatgtttcctactccattttccttttgattccaatagatcattcatattacattctccatgtaccaaaaacctatattttactaatatctttcaactacctttcaacactcccaaaaatcaaaaatagacaatgtatgagaagaactgttgagaaatttgataattcaacctctaaaaaaacttcctcacctttctctctcttctatatccaatgctgagagcctgagaggatgggaaggacatacgaggagggctgaccaccgacgggtagttcaatgggtgggagtaacagggcgcgcgatggggagagaagtggcttggcggcatgggcggaggagcggcgcgagcaggcgtgcggagggtcggcacgggtggcggggggagaagtcacaagcgcaggagcagtgaggacggcaggggagatgccacgggcgtctgcctacttagaggagtctatagaaggaggggggagggcagagtcggatatgtgggcgcgtggcgctttggccgacggtgggtgcagggcaggcgcatgtgaccgatgtcgggagtggccggctcatatgatcatggggcgacgctcaggaccggccgactaaggtggccactagcgcatcctctctctcttctctacattcattccttcacccctccatagctcgatctgatgagggtgggagcagcagttgtggaattgcgtgaggagagagaaagaccatatccggcgtttctctcttcgggatagcgcatgagctatctttggatgcccaaacggcgtatccgctacagaggtggattttctcccaccatacgctatttcatgtaaggaggacgggagagagtatctactggggatgctctaacaggtgctctaacaggtgttctgtagtagtgcgagggacatcatatatcgagcacaaccacaaattactactcctgcaatctaactatacgcatggaggaaaaccaagagacatttaactattcgtcacttttaggttattgatatatgagtgctcacatgtcatcgactatagatgataatttattaaatttcacatcttaaatatgtaaatgtcaaaaaacgaaagaagatagacatacgtggtgcgtcaatacacaccgtacatgattgctggcttgcttaccttcgactggatcagtttttggtgcttgttgatcctgagctgctgcaacccgccatgaccatacaaacaccagacaccacacggaatggcgaatgacacctctggaagaacgcatctctctctctctctctctctctctgctgaaacaacactgcgtggctttgttttttcttttttaacactgcgtggcttgttaaagacgtacacgacctcctatatattcgtataatatgtagagtatatgcacgtgcaaaataccggtcaactaattgcacgcgctggttaaccagacccgtcactattgataacgatatatagagcatgtgttttaccctccacaatcaatttaagggactatctaaaaactgccgcaagtattttatggaaaaagctttcaaatctacaattatacttccattatacctatactataactatataatatatattaaaataaaatatacaactttatatctaacttatattgatattacaatgcctttagagtgcacttatacattgtagttacactataaagatactatagttatacattatagttttttgcccaaaaaatttgtgacagtttttttagcaattcggtcagaaggccttgcaaatttaaatccatgctttgataaatccgacttatcaaagacaaaaataattggaaaacagctctaaaactatagtgacagctatcaataatctttaatttcaggattagcattgttttgttcagttttacatccttcattttttgtccaacgcgtcgtgtatagttaggtcttagtcatgcatatggtttcaagttttacaccgttcgtcgacccaccattgttttgactgcctgcagccgaaggaaaaccttgccgtggaaaggaaaaagtctacaagcaagcaatcaagcacaaaggtgatgggaacgaagtcattggagctcttatcaccacacatgagaaactgtgaaaccacgtgtggttttgattcattgtgatggaaaattggcaagtgctggaagtacaggaaatgtgtacgtggactaacgtgggtcaggttgcgttatctatacacaaacaacggtcgtttacatgtctataggtaatgcaagtcaaccttggccaatggcataactaggtctatgctcaaggaggagtattagtcttgtgtggttgggatactatgtgacagggttgtacggacgtcacgatcattggcggtcaaccttggtcaattaatggcatatcgagactaaactcagggaggagtcgaagtccaaaacggccaaggatgtcgggtaacaaagttgagtacaagacggtgcatgctggataaataatgtggtggaaggacttcacaacagactacacaatgtcaagtgtgccaagaaaattgatgaagaacaagaaaagggaaaacacagagaaagagggaggcgggccaagcactggagcccaagacaacctcctctcccaccaccggattggcctagcacggcccaacaccgtatgcacgcaggctcaagcggaagagcacgggacgcatggcaccaactagttgggatcttcctctagttggcaggtgagcccacccaggacggcacgtgaagagaacgtggcgcgggcatggggtccactcggagtggacgtggcctccaatcgtgaggcgtggggccgtaccggccacccggcggcttttgtctcgggagagcgcaggcgatgtggctccttccgactggcgcacgcggcatctcccactggctggagggcccacgcgcatgcaggagaaaggcggagccgtggcaatcggtaattggggcgcgcgatgtcgagattgatcccaaggcatgcgtgggtagtagcggcgcggatcatccgtggaaaaggtggacttgttgtggcggacatgttgtggctagctacatgtcagtgatatgaggcttttcctttgaagtggaggaacaacggatggcccagattttatctgagctagtgttttgccctaagagcatttgtgacattgtcttagttaggggatttcagccacattggacaataataaggggtggatgcttggtgagaggtctccctttgagtcgcctatacaccttggtgtgagagagccttcatagctttcgtgtgtgattttaaattcaaatccaatgtgaagatgtattttttagtgtgttagtctcacggcagcgactactcatacgtctactgtagacaatccgacaatagaggagaacctggtgaagcatcgagttcgacctaagcgtatcaagtgggccaatgtcagaatcgctaggccggaatggatcatgggctgatgtattcgcgcggctatataagcgcagtaggtggaagggaaaagaggtcgaatgaattgtattctgaactatctcctaaactgaatacttcttccccttccccaagtctgaatatctctctctctctctctctgtgtgtgtgttcttcgcctgttcgactctgttctatcttcttcctctgaaactttccagaaatcaacagagttcgtaacaataggtatcagagcaatcgatcctggattacttggagaaaccacgctatcattctcgtgcgtagctcaagcttcggtggggttgttggaggaaatcaagcccatggtggtggagctagcggggtggaagccaaccatagacaaggcggtggtggagttgcgagaggatattggggacttgcgtcatcaagtgaatcagctctcaaaacagcaagccagtgctatcaagccagcggagcggccgccgctgcttcccacatcgccaggatctcgtccgctgccgaaggaggaggagacttgtccaagtcatggtgacatgggtcacggcccgttaggccaccgcgcgggaatttcactccggggaaaggcgattgggaagaatacctctccattgtctctcccgggcaagggtacatttactcctcaatttgcttctcgaaatgagggacgtgattttggggattcagtggggcggaattttgggggatttccttatggtggtgtgaatccgtgagtggactgtcctcaatttgatagagagaatcctagagcatggaaattgaaatgtgagacttacttccaagtgagtggtattagatcagatgtgtgggtgggagtagccgccttgcagttcataggtggagatttgacttggttgcaatctactaatgctcacgtagatttgataagttggggtgaattctgtgagccagtttgtgctaagttcgggcgtgaggggtttcaaactctaattcgacagtttaataggctacgccaaactgggtatgtgcttagctatgctgaaaaatttagtgagttagtacacagcttccatgcacatcactgttgacggtcgttatcaattagttttgaccgtcaatattaccaaaatagaggagaactagtgatgcttgcaatgcatatatctgttagaataataatattccactagtattaggtatactaacctattgcagagaatgacaataaagtggaggagaatcgacatcaactcaaacgataaatcaatcaaacgatgtcgatgtcgcgcccagaaattcccgaatagaattccaagcagaatgtgcattaaattccccgtccaggaccggccggggtacacaaacaagaatgttgacattcagatcctcgtcttacaaacaccataaaagacttacataaatgcagcggaaaaacgaaagacaacaggagcaaagccttgactagatctgcagtgggaacaccactccacaggcatcctcgacggcacggacgaagcctactcctcggagaaaccttcatctgacacgtactcgtgctctggggttgggaaaaatagagcaagactgagtactacccactatactcagcaagtcataccggaataggggtatgatgcagggaattatcaaaggagagctagagtggttcatttgcataaaacgagcatttataaacagaagttgaaagatttaaacggttgtaataattaattaatattaactatccactgtccaacgctatcccacgttgcgacaggcccaaccatccacctaaactatccaaattcaaaagattacactagggtgagactaatcacggtgaatctggttgaccgcccataaccgcgggcacggctattcgaatagttttactctgatcagaggtgtagaactgtacccacaagacacagccccacgacacgttcccgtgcgccgacatgccaccacgacataccggaaagaggccgtgacaggacccttcgcataacccccctctaaccaagcacaccacacctcaggtttcatccccactcctcgcaaggcagcgggcagtcccctctcgtgcctaggtgaatccggaagccgcataggccgtcgcagggcccatccgaactccatcacgcccatccttgcctggatgcgtcggctagaggaaagctacactacaagcccagccattgcccacgctggcttgtgattagtatgataagttcttccagggcatcccgcgaaccggtccttaactgccatgggtgcgaccagcaaaaccatgcacccacagcccaccatgtgatttattttaatgaacaaacacaaagcggtggcactaatccaacaataccattagaaccaacagtctaaacattaataaggttttccccattgtgcactagttgaactaagcatgattaagcaatccctagtccaatctctagtcatgttataaccccaagctgacaaagagacatggtacaacaatagcatggctatgacaataggtaaacatcccatagtaacattataaaacgatgcaatatttgaaggaaaacaatagagcatttgcaatataggatcaacatgttcaagtgacaagcatgacttgtcttgctctgctgcaggaggaacctcggcgactatttcgaagtacatcggagcgtcggacgaaccggaatctagcgacatacaaggcaaacattgcaaacaggctataagactactgaaacagagaacaaaaccatttttaatggattctacacatttttcttaatttactgagacttgaatgggcttaaacggagctcggatgaattagttatgaattttagaagattcactgtgtttattactataaaagaaaaaccttaaatcatttattgcgcaataaatcccagggctgacgtcagcacggagggggggaaagacggcgccgacatgcggggcccaccggtcagcggctcgggagagggaggaaggggcgccggcacgcggggcccaccggtcagcgactcaagggggagggcggttcaccgtggaccgggaccacgcgggtggtccactgccggtccacggaaccgacggtccagatcgccctcagggtcgatcggacgggcggcggcgacccggctcggctcaaggccgaccgaccagccgcggcgacggcgacggcacgcgcacacgcgaacgcgttaccggcaacggcagccggcggtggagacggcggcgcaaaggcggcgccgacgggcggtggtgctaaagcgacggctaacgggcggcggcgctaaagcggcggctaggagggagagggaggggaatagaagggagagggcgcctcaccgagggtggccggcgcggaggaagacgacggcgaacggcgatggcgagccacgggaggacgacggccactggcggacgggattcggggtgccctaaagaaggagaagagagagattagagggagggagatgaaccacggcgacctgtattcatggccgaaagcgcggtagcggttgaactcaccggagcgcgaggggatgcgaattccggccactaaactcgaccgggaagcggcggccggggtggagcttagcctcgcgaacccgacggcggcgacggcgcggtgcggcggcgaccctagcggcagctagcggcggccggagtagcgaaaacggcggcggcgggtggttgcacggcgcgggagcgatggggagcacgagggagtttggcgagaaggggaaaaagcgagagggagcgatggggaagcttaaataggggaggggagggccggacgtggccgggagaggcgggttttcgccggccaacgtggggagtgggggaggagagagaggcggtattcgaaaaccgaatcccggccatctcgggcgcgggcgcgggcgggagagagaggggagtgggcgcgggagatgcggtgcacgcgcggacgtggctgacgtggcccggaaaaggcggaggcgtggacgcggcggtggttgcgggcgcggcggcgccggctggagtaaggggacgggtctgataggtggggcccacctatcggcgtcccggggagagagggaggggcggcttggctgggcctcggcctgcggccggcccagcagggaggagggagagaaaaggagagaatgggccagcggcccattcgaaaaagggagagaaaaagaaaaagaaaaaggagaaaaggatttcctggaattaaaatattgcttgctcaattttaactggttaaaattatttctagggctctgaaaattccactaaaaatcctgttagtgaatttcgacatgtagaactcaagaaaaattccacatgccagttccgattattattcgcattgatttaaaagggtttactcttgctttgcactggtattttcgtagggtcgcttataaattaaatttttggcttgggaggagaacttcggggtgtgacagtcgagaaccagacttatgtatgaatgggccaagaactcaggattgacacgacacactgggccaaatttcacaagtctacgaagaggaacaccggaggaggccaccagccaacttgtgggctggttgggccagcccagggttcggctaaaccaggggttcggccgaaccaatgccagcgccgatggatgcagggttttgagggaacagtggagattcactccctatggcggttggagggtattaccgacctttccaaccaccataaccgtcattacctgcctatttaaggagttcactctcttcacttcaacacacacctcaagcaagagctctctcatttctctcaagtttagtttagtagtatctagttggtggaataggaatagagtagaaatcaggagtccagaagccttcggaagagttcgggtatgactctagtagctttcctttcctcttttgaaagctttgtacttttattagaatactcttctatatacatttatggtattgaaatactttccgagtatataagtacgtactttacattatgttcatgttatactgaatatacggctagggtatctgcgagatgctttggtgcgggtataatgtttgcatatgcaattactctctgtcatgacgatgatattagagtagtatctgatattttagacgtggtgcctagattacgggatatcattatttggggttatatactgcggataagaggtgggccgctgacggtgacagcttagtacgggtattcctccgcgccggtatataattcaaagttaattccctggggaggttattcctccgtattgagccccggttgtatggttatgacgggctgttgtaaggaactcggcagtcaggggtggcttctcgaagtacaaggagggcatcggatagagggtattagctgtatatcggttaactagaatgtatgtatactatgtatattagaagtacaggaatagattttctttctcttttctttccacttagcttagataatatattatgagaatgagtagctaatgcttgtgtgtcactctacccttagattatcttaacccctacttagaatatgattatcacaagtaatatataaattattagtcaagttctctctacatgatcttcccacaggataaaataaatacgatacccttggaatactctcgggtgaaatgctacaatggtatattcatgcgcttgcggatgaactctgtaaccataatataccagaagtatttctgcgctattgctgggaattatatttctagtaatgacgttaagaaatacgaacaatcacccatcctggaatacaatgttctttgtcacccagtttgtggaaggattgagagctgaaattagagcggctgttataatgcatcgacccgaagatttgggtactgctgtggatcttgcccgtttacaggaggaggtgttggaggcgatcaggagggaatctcgtcgtcctgagacaagttccagcagtcggactaccaatttttgttcggccacagtgtttccagtgggacaacctcgtaccattttggcagctggaactcgttctgataagcgcatgtctcgggtggaggacaaagtagctgctcttcatgctattctcaaggctaaggggctctgttacacttgcggtgagcgttggagcagagatcataaatatggtccaactgtgcaacttcatgtggtggaagagctattggaattccgggattcttcttctaaagagaggggtgatgaggagaaggattctgctgttattcctaactctgaatatgaaggtgaagtgtgtcagatttccaaagaagctatgcaaggcactgagacaagtggtactctcagacttcaagggttgattcaacacaatgaaattctaatgttagtcaactctggcagttcacacagctttatttcagagggattggccgataaatggactcagcagcgacatgttttgtcacctatcaaggtcaaagttgctgatgggggtattttggagtgtgttactgagttggaggattgtctttggtgtgtacaagggatatcctttcaatctaacttcaaggttttaccactcggcagctatgatgtaattttgggcatggattggttagagcaacatagcccaatgcaaatcaattggcgagcgaaaaccttgcagtttcagtataagcagcgtgcagtttgtcttaaaggtgtttcagctaatattgctcttttccctagtatcactggtaatcaagttaagggactagtccatcgtaatgcggtgttgcatgctgtggaattttgttcgttggtggaagaatcgtcatcttcttctctgcctacagaaattgctcagttacttgaggaattttctgctgtctttgacgaacttcagggtttaccaccagctggatatttgatcactctattcctctactgccaggagctcatccagttaaccttcgaccttaccgatataatcctgctcagaagaatgagattgagcatcaagtgtctgatatgttacagcagggagttatacagccgagttctagccctttttcttctccagtgttgctggttcttaagaaggatctcacttggcgtttttgcattgactatagacacttaaatgccattacagtaaagaatcgttaccctcttccaataatcgatgaactattggatgaattggctgcttcttgtttattcacaagtttggacttgcaagctggatatcaccagattaggatgcggcttgaagatgtgcacaagactgcactgaaaacccacaatggtcactatgagtttcgggtgatgtcatttgggcttactgctgcgccggccacttttcaagagctgatgaacacaattctatctcctctactgcggaaaggagtgttggtcttcattgatgatattctagtttacagtacatctttggatcagcatgtgtctttacttcggtaggtgtttcagctattggctcaacatcaactaaaagttaaacgttccaaatattcatttgcacagactagtcttacgtatttgggacatgtgatcagtttggctggtgtggctactgatacaaagaatattcaagcagtttaatcttggtctattccacagaatgttaaggaagttcgtggttttcttggtttggctgggtactaccgcaaatttgtgcgtcattttggaattatcagtcgacctctcaaagatttactgaagaaaaatgtggtgtttgtttggagttcagaacatcaggcggctttcgatgctctgaagttagcgcttactactgctcctgtattggcgttgccggatttcactaagcaatttgagattgaaacggatgcttctgataaaggggtgggagcagtattaatgcagtcaggatatcctttggctttcctcagtcgttctttggggccccagaacagaggtttgtcgacctatgaaaaagagtgccttgctattttactcgctgttgatcattggagatcatatttgcaatttggtgaatttgtcattcgtactgaccagcgcagtttgacacatctggatgatcaatgttggttactccctggcaacaacgtgctctcactaaatttttgggtcttcagtatcgcttggtctattaaaagggattagaaaaccgagctgctgatgctttatctcgttgctctcatggagaagtgttacagttgagtgctttgtcatcttgcattccgacttggttggaagaagtagagaatgggtatgctgctgacctggctacttctcaactcatttctcagatagtattatctccagagcagtttctagattatactctgacagatgggattcttcgcttcaaaggctgtatttggttgggttcgaattccactttgcagaccagagtgttgatagctttccactgctcagctattggaggtcattcagggattcaggtcacatacagtcgagtgcatcgtttgtttgcttggcccggcctcaaacgtgttgtccggatgtttgttaacacttgtgaggtatgcaaacaagctaagtctgaaagagtgaaatatcctggtttgttgcaaccgctaccggtccctgatcatgcttggtagacgatctccttggattttattgaggggttacctatatcagccggctttgattgtatttttgtggttgtggacaaattcagtcgttatgtgtcacatcctgattttcgttttaggatttataaattatttaataaattattattagaatttatattaaatgttcattaatttacaagtgaagttaaatgtgggaaataaaattcttaaatataaagcatggatggatttaatttttatgaaattctccatggttaattatactctctgaaatttctcggatttttcggagctcaattcctaattttaatcatacaaagaacattttagtaattacccacatattaaattaatcattaaattgcctgattataatcttgttaagtactttgagtgtccaagtattttcaggatttttcttgaaattatttgagcattggaagtatttttaacaattcaaagatcatttcagtgattattttaattagaaaaagttttaaatcttcccctaagccgtgggctgattccagcccatctccgtcctttgtgtgcacggctgtgcagcccatgtcggcccagccgagctcccccttctctttctttctttgctttgttttcagccagcccaagagggaaagtatactttccgtccctgtcactacagtatcgtcttcaacctctggcagcttacctgagaccgaattggctcggtttttcccctccaaatccgaccttttctcttgtgttttcctaaaattagttgaggggaaattatctcctccttatcatatttctttccctaaagtttcggagatcaattttgctcggataaaccgaatcgaattcgttttcgagtttatctctccacctaaccctcggatttttctggctcaaatcctttcgttttgagttcgatctctctcacccatgactatataaagcatcccctagtcgtcctcttccgtttgccccaagtcccgagctctaccgttgcccgtagcgcggccaccgcgtagccctagccgttgccgtcgttgtcatcgttccagccgcgccgcgctgtggttgtggtcgccgtcgccgcttagcgtcatcaccgtcgggttcacgcggaggaggagcacctcggccgcccctttgcagccgccgaagaccgtcggagagccgtcgtcgccgtcaagtcaagccgagccggcgttggagttcgtcgccggccttcgttcgtcgttgttctttacaccggtgagttcgcgtcgtcgtcgtcttcgcatgggtgtactcggaagacccagccgagtcctctagctccggcgacctcatggttcagagccatggccggcgatgatgtcatcgtgacatcataaatcttttttttagtttttctgtattagatgaaatctgattaaacttcagaaattcataactaaatcatcataactcggattcaagtggttcaaattgctaaattcatgtaaaatcgatatccacatgttaaaaatatccacatgtactgtttatgcttgttttttactgttttgttgattttatttatttgctttagtttcggacgttccggaggagagcgtttacgttgaggaaggttcagaagcgtttgaggaagctcaaggcaagtcacacagatcccaaataaccctttaagcaggttgaaccagtttaaagctaatgttttatttcaacttatgcattattttcgaatgtcatcgagttgtgagcctttcccatttaattatggccaacaatgactttattttcctatgagtaataaattaattagcttgaaccttatatattggtttggtttagctaaatgctatatatataattgcttagccatgcttagaaacattagctcattaatgggctgaatcaccttacattattacttatggttatatttaatgttagctcacgatggttaatcgtgttatgataattaattgataattagagtctgattaaaggtgggttgtgagcacatggttttgatggtcgtgctcatgacaattaaggaccggttcacgagctactgttgtgaaacattaaccgtgccaatcacaagccagcgtgggcaacggctttatcttttgtatagcatgattcattgcggggtgccagactgagaagcggcgagaagtccgtgggggtcgctggggagtccatgcctctggttatagttatagagggggtgattatgatccaggaatggtgcactgtggtgagttgtgttgtgcagagagtattgtcacaacctctattcgggtactttctagtatcgcgacgcatggtagacatgatgttgaggctgtgtcttgtgggtacagtggtacacctctggccagagtaaaagtattcgaatagccgtgcccgctgttatgggcgggttgagcaatgtttttcgtgattactctcacacctctcacaaaaattattgatgctataactggtaataatttgcttagctcctggtttggagttagatctgtgcagccgggtttggttgtttagaagtgtgctgttcagtgttgattaaaattgatgattactctactgttttactattcttaaatatttgttaaatgctgcttttgcaaatgagtctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccctagttgagctgcctgtgggagtggagctgaaaccatcgctagatcgtttttccgctgctgtttttttttcttttgtaagaatataacgatattattatgatggatttgtatattaaattgcctcggttgattcctggacgaggattttatgcacaaataagttcggaagttactagtgaattctgggcgtgacattatgctcattttgtggcgttaacacatccatttactgcttttgatgtgggtttggcatatttgaacaacatgtacaagttacatggattgcctcagcatatcatttctggttggaacgtatctttacaagtgccttgtggacagaactttttcgcttggcagatacacaattgaaaatgagttccgcatatcatccgcaggctgacgggcagaccgaaagggtgaatcagtgtctggaaacttttttgtgatgttttattcatgcttgcccgaagaaatgatttcaatggcttgccctggcagaattttcgtataatacggcttatcactcagcacttgacacctctccgtttgaagttctttatggacatccacccagacattttggtggtttggatatttctgagtgtgtagtatctctaaagaacgatcactagtttacttcgtcagcatttgctgcgagctcaacaaggaatgaagtcacaagctgacaagaagcgttctgaccgtacctttcaagtcggtggttggatttttcacaaggctcaaccttatgcacaatcatctttggctgttcgttctaatcacaaattggcgttttgctactttgggccttttcaagtgctagctaaagtaggagtcgtggcctaccgtttgcagcttccattggattgcgctattcatccggtgttatgtctctcagcttcgtcaagcatcttaccccgctcaacctactgatgttcgtcttcctcctgctgttccacctgaagatattgttcctgtggaaattcttgaacgacgcgtggtcaaaagaggagatcatgcgacagaacaggtgaagattcgctgcaaggtcactcgtcggctgagtctacttgggaggatgctgcagctctccacctgcattttcctgaagcaccgccttgggggcaggctagttccgaaggagggaggaatgtcacggcagcgactactcatacgtctactgtggacaatccgacaacagagaacccggtgaagcattgagttcgacctgagcgtatcaagcgggccaatgtcagaatcgctgggccagaatggatcatgggctgatgtattcgcgcggctatataagcgcactaggtggaagggaaaagaggtcgaattaattgtattctgaactatctcctaaactgaatacttcttccccttccccaagtctgaatatctctctctctctctgtgttcttcccctgttcgactctgttctatcttcttcctctcaaactttccagaaatcaacagagttcgtaacagttagctccactcttttgtaatgatatgatttgaatttattttatgtaatttaaattcctgtatttacttcatgcaatttaaattccgcatgagttttgcctctcctattaatttctgtggagtgtgtttctactctctctctccaattcttcgatctcgtattcctagcgaggaacgtagaggcaaccttatatagccctcgagctatttgagagggagttcaatttgagaggttgaactcctcatctgagtagggttctttgtagctttttttaacctcctcctagatctagctttccacataactatgatcttaaggaaatgtttgatagaaattttaaacgagtattatgggggaagaattttgggacaattttgttcttgccccaactttgattgccaatattgattttgcccctgttttttagggttttcgtttttaccctaattttttaaatgaatcaaccgtttgcccctgttccgttaattcttgctaacggtgttaaatgtggagggtaaaaagacaagtaaaccattagatattttcccgtacttttgatataatcaaaatacaaatctattgatgccatactatagcagtaatttaatttgtcaaaaaattgtgaaagtttgccaaaatttgggtcaaatttgaaagtggtgtacaaaagtaccggaaaatatctaagggtatacttatcctttctaccccgcaatgaacaccgttagcaagaattaacagaatagaggtaaacggctgtttcgtttaaaaaaaaagtagggataaaaacgaaaacctaaaatataggggcaaaatcaatattgaaaatcgaagtagagacaagaacgaaattgccccaacaatttttgtacgctttattcatgcccacactagagcgggtagaggtcctaaaaaacagccgactttttctggacttacatagttacatatggatggatgtgcggtagccttctgagcggtggaagatatctcagagaattaacccaagcctttcgagagtaataggtttttttatctacaagccaaggtgcatctaagagatcagctctacctaaatctgaaataacaagtatgtgtacctttggttgaggatttatattgctcctccttattactgtctctatttctaaatcactactataaaaaaacatttttgcaaacgggccaaagcgatttttccaggtggccatccactccgcatgaacttcaaagcatgcgaaaatacacgatttttgtaggcggacatttgtccctcctgcaaaaatgattttagcaggcggcatctccatattcgtaggcactatagccacctgcttgcgaaaatgttttcggagaaaaaaaaagccaccacccacccgctgctgccctctccccctctggccatgccaccgccttcgccccctccgccagatctgtgagggagacaaagagggagtgggggagggagggtaggggaatcgcaccaccgtcgacttccatgacgacgaaaaagacgaccatgacgacgaggaagatgaccacacccgtcacctgatccgccgcacccgcacgtcgccatccaggaactgccaccccgcccgtcaccatctccagctgccgaggtagagtagagctgaggagaggagagggacgggagctacaccgcccctcccctccggccacgctgatcccctcccctcggttcgcgccaccaccgacgcccctccccttcggccgagccgccgctgacgccgctccttgtcaccaataccaccacccacacctccccttcggccatgttgccgccattgcccctcctctccgcccgcgccgctgcaaacgcccctcccctctgcctgcgacaccgttgacgcccctcccgtccacccgagctgccaccgacgccgctcctcgttgccgataccccgactacccacaccgctcctcctcggagccaccgctgacgatgccgcccctgccctctgagccgtgcgtgagagagaagaaaggtcgagaggataaggataaggatggtggagagaaaagagtagtggatggtggaggaaaggataagatgggacgcaatattatttttggtgagctgcaggcacgattttcatagacggaggacaatctcagccccattgtcaatttcgtaggtggccatttacttccaagatgcctatccgcctagaaaaaatatatattatcgtctgaaaattggtttttctagtagtgaatatttgatattggttagttcaaaattgaaaatgtagggctgccacgataccctttgcaggaggactatgttcccgattatttcatttttcgtgatctacttttttgtttggagaaaaggtaatggaaacaaatctgatgtttatatacacagaagtgcttgtacaaaatcgaaagatacatcattaatacttaaactacagatctcataacaaagagaagaaaaacaaaaccaaaactacttgactaagcatcaaaactacattcgttctgtcctgctttcacaaaacaacactgaagtgatcttgatagattttccgaatggatccacatgtcctgacacatattaccttcgcccaccgacgctctctagcagaggcagagaagaagaggccctgccaataccatttgcgttccacgaatggatcctgcacaaacacctcatatcccgtggcacttaagcctccgatctaacatagttccttaaccattgtcaacacctccaaaaagcctttcgtccactcctcgccgtcctcacatgaacgctagctgtatctagccattagaccgaatccagtctccacggttgccgctagcaccgtcactgagcttattgttatcctaccaaagcccctccttgttgtcctaccagatctagcaatgatctggcagccagcacacctagggccctcgccgctgaccatcgtcaccgtcgtccacaccacaacgttgaaatgtacaggctgccacgttgaggaagccgcccctccaaccggagttgatgccgtcttccgccttcaattatctcgtgccacccctccagtcagaaccggtgccatagcccctgccaatgccgtctaaccaccgcctccatcgcagcctcaccaccctgccaaccaaagccgaacgcccgcctccaacgtcgttgtgcccccaccacttggagccaaggtaaagaatcaccactagcggctagcaaaggtgaatggcgagacaaaggggagagatgaccatccgtccaaccgcctgccaccataataaacaggtgctgccggccagcctatgtcggcgtgccaccaccaaactcaagcgtgtgtcatagtgaatgtggatctagaagagagagtgataaggacacggctatggtgcccggatttgtcccaatctttcacagtaaccaaaagatagcaaataatacagaccattgactagataaattgagcagcaattaattttcaaataaactagcagaaccaaatagccactccataaaatatagtgacaaaatagttgtgcaaatctcgcaaatatactccacccatgcggcaagggagtcacacgatcagagaacgaatacttctgtagaaatcaaagatgtgcccaagaaattgattcccgagcacactcctgttggttgattttgtggacttgtggcgataaaaattaggagatgggctaaaccaccggtttccttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcacccgatcgatcaaggcactggaaggggttcatgaggtatctcacaacagaagaaacaatgaagaagaaagaagaagagcaatggcttcatctcaggtcagttagatcaattaattttcgcataagcagaaggtgaccatgtttaggctaagactcaattatttaattggaataaattccaacattgtggtatcagagcctaatcttagccttcttgttaacagtgaaatttggtaagcccggagtagtcatcgacttagagtcagcatcggcttcgaagtcttgagattagccgatgagagttgtcaagtcatcagttgtcggattcttgctatattcggttaaggaaattgatctactagatgaagcttatctagaagagaccgagttcaaagagaatgtggcatggcaagttatctattaattaggaatagtttgttagtttccttttatctttaggaaagtgtgtttagtgtcctataaggattttatcttttccttttatctttaggaaagtttctttcttgtccgatgaggacttgtatcaacccatgggtataaatatgtacacctaggatctgtgtaatttatcgctacgatcaatacaatttgacgcatcgccaccctttttacttctacttttgtttttacgttccggcggaacttggcacccgatgcagggctgcatcgtcttcgatctctggcgaagggataagtccaatgttccgccggcccaggcaattgtatcgtctacatcggcgtagttcaaggctgcatcagtacattcgacctcttggattgctttggtttggatgatatacttgcctacctatttatcatatgtctatgttaatctagtcttagcatatcaatttagctctatcggctgcttctcgttttagggtttctgccggtatcggctaaatctcatatgtctctgttaatcttgtcaggtgcaggatcaaactgactggcacgcccgcatctcatcaatctttgaacctgcacaggagctaagcagatctcccaggccggtgtgttcgattttttcatcaacacttctttatcccatcatccctaagtgaagccattatgccaattaaaccctaatttctattcggcatgcatgatgcgattttgagttaattagattagattaatccctttgccttggttgcataagcgaagccctgttatactgctgatctcggccaactgctgatctcggccaacagtagaagaagcaaaattattgaagagtttaattttgttgatttttatgagaagaagaggattgggataaacaagattgaaattcccaattcaaacactaagaattcctagaccgatgctaaggtttcggctagcactcagcaaacaagaaaggggataaactagattgaaattccccattatcaagcaaaagggaataaacaagattgaaatttcccgaaatccccaataagccggatccaattggcctaaaatccccaaatgaggaagcctaatttttgggggaagaaccctaagtcacaaatatccgaattaaatgcaaattcaagtcaaaattaggtttgagtttgggttacttatcggatttagaccccctaagattgccggcgcacaccggcctcctcggggcagtgccggttgaccgccgtgcgcgcaccaccttggagctcgtctctccaccgtccctcgccggggacgggaaacgtcggcttggcagctgccttcgtgctcttgccccaccccgatgaggtccggccgcatcgccgccgcctcgccggactgccgacgccttggcacaacggcttggcgccgccctcgggggcgccccccagccggctgagatggagccgctgcggcacttgtcgccacacgcgtgcgccgcctcgtcggaccgccgtcgcaacatcgccgccgattcgctcgctcgctcgccggacgccgaatcgggaatagaaggggataagaatgagctagggttaggtctcacacccattcccccctggcgagcgatttcttcagtgcgggcgaaatcttggccgtccgtttgatcagatggccgccctcgctcccgcatcgggccgtcgccgtcatgggccaagctgatctgggccacgtccgccaaagcgccgagcgcgcacataaatgggccggtccattttgggccagcttttcgataagagtgggcctttattttttatttattaagcccatgattttaattcctcagaatgtgttatatctttattagctaaattttagcccgattttagccttttttttatgggccggcttaggaagtgatgagccgtattattattttaagcccgccatttatgttttatgtatttccagaaatttatttatgacctttcttagccattaaaaattgctggaaaattatggtcaattatttgatcactcagaaaattatttctagttaaatggaaccaacaggaagtttagctagaaagaaattaatgatatgatattatatttgaccaatgttaatatgatttcatgtcaatatttattaagattattatttccttaagccacttaatttattcctagttgaatagaaatttaactagaaagtatttatgatttcatgtcaacatcattatgatggtcagtgccttagtaacttaattatttatagtcgaatggaaccaacgagaaattcgagtagaaagcattaagatctgaagttatatttaacccacgtttttataattgcatgtcaattataatttttttattccttagttattttctaccaaatggtgatataattaaggaataaattttaagattattcataattatttatgaccaatggtgttttgactatgaaattctaagtttattttgcatatgattgactaagccaaggtgaattaattatatgcaattggcaatgtttattatttaagatcagttgcaatacttggtaaatatttctagattaatggaaccaacagaatgtttatctagaaagaaaaaatatttcattaagatagtaatttccttaattattttttgcccaacggtgatgtaattaagggaagaaatctaagtattgtcaatcgttattttaattttctctgtcattttggccttaacggtgattagacttagaattttatttatgccattagtgcattaattcctttgtcacttctaccttatggtgatgtgatcaaggatctaatctatcagtaagcttaattcctttaccatttctgcccaacggtgatatggctaaggattttaattttaattctatggcatcactaatggcgtcatttcctatatcatttctaccgtatggtgatttgatttgggattttaaattatttacattatcacttctaacctttggtgatgtgacttaagacattaatgtttattccctaatcagttctgcccaacggtgatttgatttttggattataagtaatttcatttaatgattctttcgccttgtctcttcccaacggtgagacaaagcgaaataaagattaagctatcgttattgtgtaagtgattgtaataatgtacatcatttgcacaagcaaccacaataatagtgccacttaatattttagcaataaataatgttgtttatcagttaaagtctatggaattattattatttttcctcattgacttaactgagcctaaggcctacttgagtatgacttggcattgacaaaggattccttatggctcccgtagctaatgtcactaatttttttttctaaactcaagaggcatctttagcctgggagtaggccaatataatgttatgtttcgcatatcactcataaacattaagattatcatccctgttggtgttaggggagaattttgagcatgactttgcaaaactgtatctagcaaacgttgagatgaacttttagaagtttgtgaaaactaatgcttagtacaattttagtgcctatgcacatttgccgccataatttaaaaggtagcacaagaaataaatcataaggcgtgcaaacttagtgggatggacatcgaacatttcatatgcgccacttgtccatttcatattatttttctcccattagactacggtcattttcagttatgtaatactaagacaaagtggaccataattgacttggttcatcattccacaaatcaataaaaaatatagaagattaagaggcaaaataagtaagatcctattaatcttgtcatttgatggcaaagatgaagctttactaaggggttgtagcaactctaaatttaataataataaagctcactttcctcgcaaggggaaataaaattgcctctatgtcctatgtatgctactcttgaaattttcttgtgtaagttctttgcaagtaatagggacatgcttaatgtcctgattcaacaaactagttaaataagaagattaaaggcattattttgggttgaatcattatgagacgttgtcgaaattatggccttatttttcggccacatttctaggggagaatatacgtctcattaaggtcgagacacttcacccttagaaatttttgacatctatcattacttagatgataattcgctaagtaaagctaaagtaaaatcaagtgattcaagttcataaggtattatgcttccattacataaataataagagaagattattctacctcatttatgactcatagctccattatgtggatgctagaattttgtatctcttaatttgtgacttgcacaattaaatatacataacatagcttgagggttttgttatggaaagaaaagtcacatatagggtgcagacttaagaaatccatttgtggacttaatcaagcattgatgatgatttaaattccgctgcatcattagtgaactaagcttaaataagaatcaggagaataactattctataatgatggaagtaagacgccattgggagtgtgtcattgtcgcttatgtcacataactaggggagtttggaacgtctcatgagatagagatattcttttccttagattttaatggcgttgtttagctttaagttaaaatttcactaagtcaagaaattagccaacaaatgatcatttaaggctaggtttacccataagcgacctccgatttcctttaagaaatttaagacactaatgctaaaatcaaatgaagttatgagatcggattatggtggtaaatactaaataaagtttgttcaccttataagacattaaaaataagcgttcatccaaatggttttcgaaccatgtaagaataaattgagatggatgaacaaaataagacattaaagtgttcatctaaatggttttcgaaccatataagaataattgagattgatgaacaaaataaagaatttagtagaagtttctgaatgagtcaaaatattcggccatttaagtgggttaataagattaagcctgactctaatggaaatttcgaacaattcaagtgaggtggacaggtgcatgaaaattaaaggtggaaaatttcattcaccggtactccatactaatgatattttattgttaagcaatgcatattgctgttagaaactaaggaaatttttccatgaattattttggtctgaaggagcactgggcttatatcagtaagtcatacattgacataaagaaataatttgagagaattcagttaaagttagtcaagttgaaattaaattataaagataatcatttatgattcagctgacagaagcttgagattagctcaaatctggatgcctacagatttggcaaacatttttactgggaatcttggcagtatttaattaaatccagagtagaccactggtattaagaatgttcacaaggcaatcttatgtaacatgctcatgtttctaaagtccaatgatctcagaagtttagagacatttggacacttattttgtgagatgtgtggatatttataaagattattcagattaagctatgtccacacataggggagcaatgaccatgtaaaagctccaaaaatagtctcttactgcatagtcgatgatgcagttagattttaaagcatgttatgattaatcatatatataagaatatttcccagaactaagagtggtaaatagcgctcataaaccactcaaaaggtgtaaaccactcaattatactgtgttatatgttgtgcactaattgaacacagttttctattttagtagcaacatgttgtgtgttttctgctaatacattgatatagttgtgaaacatatgtcctaggatcgaattattattaatctaagcttttgcttatggatgcatactctaaaggctcataaagttaagattaattaagatatgttctagccagtacatgtgtaaataagagcctcactaagatcctggatgagggggacttaatttttcaatcaacacccactaagttaagcttgagtttatttgagttctatagtgagatataggtcttgttgtctcggtgacgcataatgttgttgaagacacattgccttggggagctattttatttaatagactcataagtaagtctcgaaatcaaggggagaatgttggttgattttgtcgacttgtatcgataaagattaggagaggggctaaaccaccggtttccttatcctaacaagaaacaaactacgagataaatctgttttgtgtgatcaaaatagactcgaattttagattgagatagacccccgagccccaccagtgtcacctataaaaggaaagagaaggagggaggcaggtgacgacttatctctctctaacctcaaaccctaaattaatcgcccgatcgatcaaggcactggaaggggctcgtgaggtatctcacaatagaagaaacaatgaagaagaaagaagaagagcaatggcttcatctcagatcagttagattaattaattttcgcataagcagaaggtgatcatgtttaggctaagactcaattatttaattggaataaattccaacaactcctccaaaccagcacttggccggtggcttcaatagatcatggtcgatggattcaccattaaccagctcagcagggatgataaccctagatgcgaaaacttcgacaaaagatcaacctctccaaaaagttgtcttcggcttggtgaagtgtcacgcccggaatttctatccaaaattccaaactcttacatgtgtgtgaaccctcgtccaggaatcagccgaggcacacaataacaaattgataatagagtacaattattactctaattaataagcgaataaaatgtcattacagaggtagatagttcctatcaatcaataaaaatctaagcagcggaagaataagataaacggcgcagacgactccactccacaggcagcttgaccaaggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaatgaacatttcagaatttaataaaacagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacgggaaacgacgacgatgacgtcagcgggaccaccggcggcggctcgggcgcgcaaggttgccggcgaacgacggcgcgacgacgcgaacggaggacaccaacacgtagagggcgacgcggcgaactcaccggtgaccaaagcaacggcggaagatcaacggatggtgacagcgtcgaggaagaagcggcggcgaccttcggcttgacgacggcgacggtgttccagcggcccacagtgacgacggaggggcagacgaggtcggcgacggcttggcgatcacgacggtggctttcccgagcggcaacgacaaccggagcgacggcgacgcacggttggagctgcggcggcgacggcggcgcgaagctacacggggctagggcgctacgggcggcgacggacgaagacgagggtggcgacgggtagcggcgggcttgggggtccttttataggggttggaaggcggcggcgaaggcccacggcgaccggcgacgagaaggaaagtttagggttcagaggagagagacgaatccgattcgagatcgaatccacggatttccaaacgaaattagccgacgattccaaaagagaaaagatagaggggatcccggggatcatttcccctctattaatttcaccggaaacggaaaggggcggctggatttggaaggagacgacggcggcgcggcgctagggttcggccgggcgatggcgcgaggaagacaacggccctgacaggtgggccccacctgtcagcgggcagacgcgcgcgcgcgagctcggctgcgggccggattgggccaggagagagagaaggttccaaaagagaactttaaaaccttttccaatttaaattattcatgaaatgcaattccatttattaaaaatacttccttagctcaaataaatcccagaaaaatctaggaattatagaattaagcaaagtatttaatgaaattttatctggccccattttatattgaaatttattaattaaaactagatcttctcttctaggcttttaaaataaattctaataattccaatttagacaacaatttaaatatttgggatttttagtgtgtgacatgaagtgactggaatagatatactggattgggacaccaccatttttaatttctggcctttctggtatatcctccttcttcctctcgtgccctgtagaaccaattataagtcccttgcattcaaccctatggttccgattcacttgaataggatttgttccaactaactaggctctaaaaaaaatatcttatatattagaaggcatcttggtcccatcactctatccacctcgaagcaaagccgtcctcggctttcatgtaattttggaaacctcttgttgagattataaacacataatgatttaatttattccataaataaatcataatattgcagatgcaaactagcatgaacgtatcattggatctacacatgtacactaggcagtaaaacataaacagatcaaatatacgtaccatattgaacacgtaccgaggttgccgaaaaatcggttgctcagcaggaattactcgtggttgtgggcgttgacgaaggcgtgcaacacgcgagcgaagaggaagacgagccgtcgtggacgaacagggagcagtcgtgcgaagcgctttcaaaaacattattgccgcctctcccggtgcagaaagtcgaaggcagaggttctggagaactgctctcccgatcgccggtgcacgccggcgagcaggatggagtagtatacgagcgacggcgcagcacagagtaggaggcaaaccctggatgatttcgcgtgtgttgcgtggaagcggcggctcggtttatatagagaaaggttgctttatcagggcgcccgcatgatctctactccgcgtcgcttaatcagggtgcccgcacgatctccactccgcgtaactgaaccagatacactccgcgtaaccgaaccagataagtcgcgcataacttatccagatgccacgccgtttttcacgcaatggatttttcggtatgtttccaaaacaaacaaatctgaatttcccacagcaaaacaaaactgcaaaaggaggctgcatctgcgacaattcgacacgtacgtcgtgcacgcgcatcgccggcctagcccggcgagcaagcgcgcgtctgtccccctcttctctccacctcacatgcttcaagtggctaggagggcatcctcccttttaaggaggtctccctctcttagaataactccccatgcatgtcatcctatgaggtggtcttttgtgattttccaaagaattaatctttaagtgggctaagacccatctattaattccaacacctctttctttttcttcatagcaacaaacacatcagcctcaatagcactcctcgtcatcagtttcagcacatgttgcaccgccttgtgcacaaaagaataattattggactgaccaccatgtgtagcatcaagatcaaactgccatagtctacccaacaataaatgacatgcactcaatggcgcgacgtcagagtccactttatccacatactttccgatagaaaattttactctcaccttgtgagtaattttcagtataccactctgattcatccattgaatataacatggtgttggaagcctccggattggcaaagcaccaaatctaaactaacaacatttgtaaaacttccaccatcaattttaatttgcataccttctcacgaataatacattgcgactgaaaaatattggagcgttgtcccttcacaccattaacagtatagcttctacttcttgagccatcatggataaaccgtttttactcacctgtaactattggcttatagttaggatatgcgtaggttacgatagcataaatcaaaattttctaccgtgtaaaccaggaaccacatgcaagtataagatcatagatcgttaccactcgacgcgctgcatagcggaagaaagcgctaagaaggcaaagccaccctcgcgatgtagcgcgtgccgatatagaggaagtgctcgattgcaccggctcgaccttctcctcctcgtgcgttctcctcgtcgtgctcccacgccgatcagcaccgcaaagcagcagcgcctctaccggtattcacacgtacaaggacggaacaccatgcatagatgtgctagcacccgcgcgcggctagggttttgctcgggagggaagtgacggctagggtttctcgcatgatgcaataactccgccggtcacacccctcataaatatataggatccacgactcaggcctccaaggcctataggactcctattcagatccctatctgaactaaggtcatattggatctccatccaatccccttattctggcccattaagcgtgccaccttgtaggttcatgtacactcggctgtaacccgaaaactcattttcggtccacgtgtcaacagcggcccctagcagaacttattgaccaaccggacatacataaagatcatatcggctgaacctctagtatatacttgtataaacccctttgcctcacgatatcgattaagctcgaggctagatatgtgccatcctataatagctcaatcattcactcgaacttgtgatagattataaaacctgtgattgactcctcaatcacctttagcatggccatgcactttcataatctataatatcgaggggcccaaatatctctccataggaggggcaaatcccatattcttgattaattattcatatcccactacatgtttcattgcatacccgaaaactgttttataactacccaattacgaagtagtgtttagcagtccctaagcaagctactacacatcatagcaatccaaaattaagctaaggctaatctacaccgcacactttactctggagtcctggactcttttgtagttccccgactccctctccctaatggcagttgcagcttgcagtgccatatccatgtccccctcctatattccgtgctcacctcaacattctcctgggagttatctcctagctcagcaggtggccgccctgctctctctctcccttcctctccagtgggtatgtcctctctatttccttagatttgtggattgggcgtcagccgctggactggtgccgcaggacctcttattgcaaagataactcgtccaaattgcatgttgtagaggaccggaggatggagccactaaaatcgtgtgttgcagaggattaaaaggtgttgctgacgaggtgtacatatatatgtatgcaagccggtgcatatatatatatatatatatatatatatatatatatatatatatatatatatatatatatatatatatatatatatgtaatcttgccttaaattttgctttgagattaatttgaaatattgccttgtgtacacaatgatggaactaatcttcgtttattcatgacaaatacatgctctacacgtgcctaatcttgcatgccatatgtgattagattttgctttgacattaattttgaatcttgcctcccatacacaattatatggaactaatcttcgttagttcacgtttcagaattagttcacggttggaactaacccatacactgcacatgcgggccctagggaattctcaactctctcgttgcaccacgtggcgagcgttttgagggagacatgtggcagactgagagcgtttttagaaagtttaatggaattttagtatataatagatagatagataatagataatagataatagatagatagatagatagataatgtgttatctatttcaaggaacaatgttagataattatgtaaacatagtatgtgatacaatcatctatacgattgcctctaggacatatcacctatagtaacattagtggatgagtcaccaagaggatcatcagagaaagctgtagttaccaatcctggtgcagaagaaacttcagcactgctagcattcatgcattccctttgcactagaggttgatttgacatgccgattaggagaagaaaagtttttactatggaccactttaaacttcccataattattcatagcagcaattcttttgttgttcaagtctgaatactgatctctagctgcaaaaacacatacctctttatttttctttctactaacatctttgcaggacttaacgataatttgcttcgtggcaatagaaagattttcagcaaacataaacctcttcccatcaagttgggtcgcacaaccatgtgcattcagtaactcatctctgataatagatgcactccacgaagaacgtatagcctgcttcttggaagccttaaaatcttcacctacaatagccaacttctcaattggtgaatcatgttgttgacgcagcagcactttcatccccttccacgtcgctgtagatttgttcttcctgtagatttgaccaccactgcaaaacacgaaaagaaaatcgccgctctgcaaaatccaacatctgggagtctttgtagcatcttaattagcggcataaacatagatttcctgctagatcgaggaatagtagctagatcgaggagtctttgtgcatagcaccttcccaatcatagtagctagatcgaggaatagtagctagattgaaaagaaatcctccaacgcacatcttcacaatcatagtagctagatcgagcagtctttgtgcataatagcggcataaacatagatttcttcccgagccaatattcatccatcattgaaaaacagtagaaaaatttctaaatgaagaatgatcaacccaaagctttgatatcaatgtttttttgagcacgatcaggatgctattcacttcttgttcactcaggtctccgccgagtgatatgattttggcggggtcagagtcatctatctgcaaccagacaaccttgccgtggggacgggtttcagcgtcggcctggttctttcttgccgttcgacttctaaggtatgaactcccctgtcgaaggaggccacctatagatggccataaggcccgaggcccgaaggcccggcccatggcacggctttttggcccggcccaagcaccgcacggcttgacttgggtcgggcccgtgccagcctggcccgaccgccgggccgtgtctgggcctcccctccggcacgctgggctggcccggcacggtcaggccggcctggcatgatgggccggcaggccaggcatgccacacaaagtatagggactaaaaataaacatataaatgtcactgtccaaagaatagggaccttaaatagacttattttagctattgatatcacaacccaaagaaaagggaggtaaaatagactttttttagctatatatatgtcacagcccaataggagggaggaaaattagacttattctgaggaaaagcactatgggccatcgtgccttcgggccggcccggcacggccccaggcgtgttgggccgtgcctaggccgtgagtgcggcacgtgggctggcacggcatggcccggtgcgtcggtcgggccgtgtcggctcgacaagccttggcccaggcacgaccgggcctgggccgtgccgtgccgggtggcccacatggcgatctataaggccaccatggtagccgaaggatgggaacccttgacaactaccacaccggctgggctaggcatcttgagcttgaggtagttgtgataagagactgcttcaaacttggtcaaagtgcctcagccgaagatggcgttgtaattgtatgggatgtcaacaatgtcgaagagtatctcttcttctctcttgttttcttgtgtgccgaaggtgactttgaggtgggcttgacccaaaacttgcactacttcgcctccaaaccccctgagcgaggttggtgcttgggacaatgccagtgtcggcaaacccatcttggcatatgttccggcgaagatgacatcagccgaactgcctccataaatcaagatatgccgaacttcaataccaaccatctctgcaccaaccgatcctggtgtgggaaaaggactccttcagcatccttcggtctgaaggatatctgttgcgtcaagtatcttgggaccccttcgcctgccgaaacaatactatgcactgctcgaagttgcatctttttttgtcgtttcgacacttgcgagggggggataagatcttgtgatgacctagatcactcttcactgtgcatcttggcgctgttcagcctgaggtgcttggttgaggaccgcttcgcgcgttgcctcttcagccctggcttgctgctgcctgagctcttgagtgttgccttgctgccgaatgttccggcattgctcggttgtgtgcgaagagtgtccatgaacggcgtagtataggtctttcctgatctttttgcgaaaaggttgttgctggccgcccgcttgctgagcgtcgaactccttgcgaagggcttgcacttcttctcctgccatcactgctttgccagctcgatcagttctaaatttttccatgtcatcggggcatggttcggccttaaaggctgcccttgattcaccggaggggttgagtgaatcagaacgggtgccgaactagtaacttgggcttgaatttgagcttgtgcgtgagcttgcgcggtggccgtctcggctgcggctgttttgtcatattcggcttgtatctcttgccgccgcttggtatctttttcgcctcatgcataaccatcgattatgcgaaagaggtgttcgagcatccttggttccttgcgggcgatcttcctagtgagttcgcccttaagtaggccggtcgaagtagcgttgatgacagaggcttctgttatgtcttgcacttggcaccgtgcttgcgagaagcggcgcacgtattcccttgtcgattctcctggcctctggctaatgccgagaagaccttattgtgttttcggctcctcataagtgcctcgaaagttaagaacaaagacattgcgcaattgctcccatgagtaaatgctactagtaggcaaattaatataccaagatcgagcaatgccatcaagagcgaggtgaattaccttcgcctttgtattctcgtcaccatgggcagcttcgattgtggactcatagatggagaggaactccttcggatccgtttctcccgaataccttgggacatgagggaacttgaactggggtgggatgggatgattcttgatcccccaactcaacggcaaacccttttcgccatccgacttgatcatgacgccttgctgagaaggccagcttagctgcgggtacgggggcgcaaatgaggttgagcagcagctgttgattgatgccccgtgccaaacaccattggctggttttgttggtcagtcggagcagcttgcatcaccatagctgggtcgaacacgacttggttccaaacttgatttggtagtgggaccgctccgtagccagagggcacggcttgtgcgaaggtcatgggtgcttggaccgcggtgcttgggtcgaattgcggcagttggctttgaggcgatgccccttgggcttgacttgtgttaacgaccaaatttcataatctgagtatcaaagatagagatcagatcgaagcagaatctaaatccaagatcttttaggaaacagagcaagaatcggcaagagtccgaatcggctttgatcaggattagtagagtccgagttggacagggttagccgattgagccgaatcctacaatatgacaaagaatacattgtcgggttgagttaataagcttcatgatgattgccacgcatggatagaatcctgagaagacaattgtatctattaattaggatattttacgtaatttccttacagatatgtttgggcaaaagtctgccgcaaagacttatggtatcatagagtttgttagagataagagtcgtgtccgatgtgtacatattttgtaaatctcgggtataaatagaccccgagccccatgtaatcaaactaatacacattcaatacaatctcggcgcatcgccacccttttactttcgttttgtttcgacgagttcttgctttcaggttgagttgcatcgatttcgatcttcaacaagaggtaaaacttgttatggcgccttgcgttctcgggattagtgcttccatcttcatgatactctaatcttgtttatgtaattcgtcgagttatcatatatcttatataatctccggcaatatcgccatctaacctacaatcggctaacgtctgttaatagaaggcagccgactaggttaaataccaatgttgacttagattatataggatatctaccactctatgaaacatccaacggcttgattgtctagatattgtccttctttttatacttatagctgcatcagttgagtctgatcttatgagtcgtgattagaatctcaatctctagcctgcttttggttgccgattagggtagcatcggggtttcagccgatcttacctgatttaactacttttatcttatgtgcttgattgacatgttaaatctgccctttatgttaagatcttgtagcatttaagtatattaggctttcgtttggtatattttacttgctttaatatgttaatatagagtggtatctgttaacaaccaaatttggtaatatcggcattgggaaagaagattagatcgatgcaaagtcggaggcggagatcgagttcggaaacagagcaggaatcggctggagtccagatcggctacaaattggatcggctgggtctgagtcgggctaggtaagccgatgcagccgattccgacaatgcaacctgatgtatgatatcgggttgaattaaggcgcttcaaggtgattgccgcacatggatagagtcctgagaaggcaattgtatctattaattaggatgttttatgtaatctccttggagatatgcttgggcaaaagtctgccgcaaagacttatggtatcttagagtttcttagagatagtagttgtgtccgttaggacatatcttgtgattttcgggtataaatatacccgagccctatgtaacttttaacacacacgttcaatacaatctcggcgcatcgctacctttttgctttagttttattttgacgagttcttgctttcgggttgagctgcatcggtttcgatcttcaccaagaggtaaaacttgttatggtggcttgcgttcttgggattagtgcttccatctttatgacactctaatcttgtttatgtatttcgtcgagttatcatatatcctacataatccttggcaatatcgatatctaacctacaatcggccaacatccgtcaatagaaggcagccgattaggttaaataccaatgttgacttagattatataggatatctaccactctatgacacatccaatggcttgattgtctagatattgtccttcttttcatacttatagctgcatcagttaagtttgatcttatgagtcgtgattataatctcaatctctagcccgcttcttggttgctgattagggtagtatcggagtttcagccgatcttacctgatttaactactttttatcctatatgcttgattgacatgttaaatctgccctttacgttaagatcttgctgcatttaagtatattaggcttttgtttagtatattctactcgctttaatatcttaatatagagtgatatcggagtattagccgatacatgctagatctatctgatcggctatgctataaacgtatatagtctcattattaatatatatttcgatctatgtgatttatactgtctcggcatagcgaccgatctatcccaatcacttgatttaagtatatatcgatataatgattatatattgttaatatctacagccaatcgagtagatttagtcccttcttatttcttaatgactgccgatcaatgtatatatgacatcggcacctagccgatcggctattatttatagatttaactgcggtttctttgcttctatttcttgttgattacaggatcaaatcaactggcatgctcatacattcgaaggtgagatttggacctgtactagagttaagtaaatctcccaggcctcgtgttttctgtcaacacgcttttggcacgcccggtgggacatttaagaagtcagccaacaattcgtcctcatggccgagaaacaaccaccaccaccatccccagctagcccaggctctgttaaggaaaaggtgctgaaattagggttgactgacgtcaatgaaggaaacgtcgtgccgatcgatccagaaaaattcacacctgagcagaagatagagtttgaagcaatgttgcagcaagcacgggatcagttcttgaactcattcatgcagacccgcaaggggacacttgtttagaagtacaaaatagaagtggttgctgatgatccagggaccagttcttctaaggatggagatggaaaacaagctccagacggctcggctcagctgagtaacaaaagtgctatcgacagctctctaggaaatcaaggtgacaattctcaaggagtccatggagtgcaaggtgacggggtgcatggagtgcaaggtgatggtgctcaggggttgcaaggaggaaatcataatcagaatagtgatgcggcacaagattttttcagtaatttccaagatcgggttgactacgctgtgcatcatgctttgatcaatcaatctggggtgttagtcaataccttatcaaacatgatgaagtccatagccgatggttcaatagctgagcatcaggctgcaggcccggtttatttgcaaggaggtgtctttccaaattatcggtctttgattaccgatgttcagccatcaactcaggcggtttcctccgctgcaccaacatctcagccgacggtgttggcaactttttgtgacaagttgacaagcacgatcgcagcaccttaagccttgcggtgatcctagagtcgccaaccacctcgatctagcaaagagctaaacctagatgggttttgataactaaaccggctagcggagccgatttctagataactacccgtctcgtgggcaaaacggaaggttttcaggacaaacctacaaagagctgtcgcactctcacagcgacggcggacggtttatggcgcaacccgacaaagatggacaaactaagagaaaactaaaagcaatataaaaaaacaattcgatcgattgatagtagattggcttttttacaatgaaccggccatgtcccttatataggggttggtcttgccctctacaggccctcctccacgtccaactcgggatagaagccaaaggaaacccgaaacatgccttcccgagcaaagaaacctcgagacccgatgaaacagaatcggactcggccctgccggtcagactggccacacaccgccggtctgaccagccctcaaccggcggtctgaccgcccaacacacggcggtcagaccggcccactcggaggaaaccggcagacttccaaattttggcaatctttcctattttaatcctaggtgccaaatttgggtataaacacatgcccccctgcctttttgatgaacaacgtgaatctaaaagcatagaacatgtttttggtcttaggacgataatctaattaccggccatagtacctcctaagcgtcttgccaaacgctcgggaagtattgcttcaagtatttcccgttgattgctcgctgaaaacgctccccttgaagtgtctccaaaaaatacgcgttccctcgaacaatgccgcatactcgataaggaccctcccaactaggagaccacttaccgaactccttggatcgagtacccaaaggaaaaattgtcttccaaaccaagtctccaacttgaaacaactttcctttcacccttttgttgtatgccttggccaccctcttcttctctttctctatctcctccaatgccctcaagcgcttgtcgatgacttcatcaagattatctcccatcaacgtcttgtaatcttcacttgacaaatcatcttgcttgatataacgaagagaaccaagatttacctcaaccgataaaacggcttctttaccataaactaactcaaaaggagtgactttagtggcaccatgtttagatatcctatgcgcccacaatgcttcggaaagcacctcatgccacctctttgggtgttcctcaatcttcttttttactagcttcaacaatgtcttattactcgactcggcttgtccattagcctaagcgtagtaaggagaagaactcaacaatttaatactataagattcggtaaaactcttcacttcctaagacataaaagaagcaccttggtccgtagttaatgtttgcggaataccgaatctatgaataatatgcttcaaaataaagtcaattacctccgtatgagtcatattcttcaaaggcacggcttcggcccacttagtgaagtaatccgtagcaactagcacgaacttatgcccctttgataatgaaggataaatttgaccaacgaaatctaaagcccaccctcggaatggccatggtttgattatgggattcaacacggcggcgggcgccaattgaacattgccgaaccgttgacaagcctcacatcctctataatatttgaagcaatcatcaatcatcctcggccaatagaatcccgctcttctaagcaaccaattcatcttgtgggccgattgatgagttccacaaattccttcatgtacctcccccatagccactttagattgatcttcatctaagcacttcaacaagacaccatcaagcaatgtgtatttgaacgattgccgccgaattttccgatcaaccttaagtgtgggatccttcaaatattgaatcaaaggaattctccaatcttcttctgtcacctgggcacaaatgtccgaattcacaattaattcggcttccaaattgattgaaacgtgccccccggcgctctgtccaaacccggtcagaccgaccacacagggccagtcagaccgctcggggtcgccggtcagaccggcggcatgcggccggtcagaccgcccctggtctccagttttgccaatttcgcataaagatttaaaatcaagcaccgactcttctaatataaaaaataatcccttcttcacattatagccagatgcttgttgtgccaagccatttgctctagaattatcacgccaagcaatatgtgtaatagcaaaattatcaaaattgacaataatatccaaacatgaatcgaggtacctatttagtgatccgtccaagcatttgtagactccggcgagttgttgcaccaccaattccgaatcaccaaaagcctccacgtatttagctccaaccatctccataacttgtaagccgaacaataaagcattgtattcggcctgattgtttgtacaataatacttcaaacgaaccgatgcttcataacacatgccattaggtgaaaacaaaactacccctatgccttgaccttctttgcaagaagaaccatcaaaataaatcttccaaggtataacttcaattaagcaaacctctccctcataagcaatatctatatgatggtctactataaaatcacatacaatttggcctttcatagatttcaatggttcataagccaaatcatattctatcaaagcatatgcccacttaccaattctcccacttagaattggcctttgcaatatgtgtttaataacatcggcttgacaagtaactatgcatgtgctagataacaaataatgcctcaatttggtacaagcatagtataagcatagacaaagtctctctataaagacataccttgtttcggcatctaaaaggcggcggctcaaatatgtaatgatatactccttgccatcctcctcttgcgtcaaaatggcaccaatgactttgtcttcggaagcaatatataaccgaaaaggctttccggctttaggcgctcgcacaacgggtggagtagacaaatatctcttaaactcttcaaacgcctcttggtgttttgccccccaagtaaaatcgcttcttttttcaagcgaagtataggaacaaaagcatcgattttacccgctaggttagaaataaaccttctcaaataattcactttacctagcaacttttggacctccttcttgcatgtcggcgctttgaaatcatgaatcttttctatcttcttaggatcaatctcaactcctctctcatgcaccatgaatcctaagaacttccccgccgacacaccaaaagcacatttaagtgggttcatcttcaaaccataccggcgcatcctctcaatagctaacctcaaattggctacatgtccttccataccatccgatttaacaacaatatcatcaatgtagatctccaggacaatacctaacaaatcatgaaagatcaaattcattgccctttgatatgttgcaccggcattctttaacccgaaagtcatgacaacccactcaaacaaaccaacaaatcccgggcacctaaaagccgtcttgtacatatcctcttccgccataaagatttgattgtagccggtattgccatctaaaaaactaatcaccttatgacccgaggcatcattaatcatcatgtcggctataggcataggatattcatctttgggagtagctttatttaaatctctaaaatctatgcaaactctaatcttatcactccccttcttttccaccgggactatgctagatacccactctgcataacgacatggcctaataaacctcgccttcaacaaccgatcaatctcctctttgactcagtcatatagcaaaggattaaaatgacgaggtggttgcttataaggcctaaaacctggtttaattggaagccgatgctcaacaagctcacggctaagacccggcatctcatggtactcccatgcaaagcaatcaacatattctttaagtagctcgattatcttaaccttataatcagctctcatatttttgtttacaaaagtcggccttggcttagttccatcacctatgtctacttcttccaaaggatcggccgatgtaaacccttttctaagcttctctacttcatcaaaatcctcaacggtttcgccaatatcgttctttgtagaccgatattcttacaccctcctttgtaaccactctaaattagcctctttactcattatacaaatttatatggcttagccgtgctacactagccggctttatagagataggtacaaatttgccatcggagatactaataaaatcctaactagaaagatccctccccgataagcattggatattcctatgatgccactcaaaagtagcatcagccattgcaacctcggccgatgtatccgcttgaacaatctcaacatcatcgccgtcccattgaattaaacattgatgcaaggtagaaggtacacaacaattggcatggatccaacaacgacccaaaataacattgtagttaccttgcacatcgacgatgaagaaagcggttggtagcgtcttatttcccacggtgagctccgccgaaaagataccccttgcctccgttggttcaccattcaagccattgagaatcatgttggtcttcttcaactcatcatcctcacgcctcaacttcttgaataatgagtatggcatcaaattcacggcagcacctccatctactagcatcctagagaccggcttcccatcaacatggcctttgagataaagaggcttcatgtgacggtttgactcatcgggcttctcaaaaaccgcatctttaggaccgaatgagaattaaaaaagccacctcagcttcatccatagcacaaaacttcataggcaacatacacaccatgttgatatccatgtcttcttttggagatgattcacctttgtcaaccgattgttcttccttctcatttatatcaaccggtttttccttctctatggacttaggcctccataccggtggtggtcgcaactcgttaaaccttttatctctttgctcttcggcctttttctctcttatttcttgggcccgaagacgttgcaaccttctcttttgtgtagccgtcaaatccttaggcatccacctaggattcggctctattccaggaggtaaataatgccctttattaactttgcttgaagacgatgaagccctcacatcgccctttgcagccctctcatcaaaccgaagctggagcccggctagaccggccgtagaccaccggtcagaccggccagacgcgctggtcagaccaacatgtggcgagcggtcaaaccggcctgaggcatcggccgaaccgctgtcgggtcggcggtcagaccggcctgatggcccggtcagaccagccgtatggctgcggtcagaccggccgactgcgaagaactggtaccggcttcggatttcttgtttggggacactccaactccatctccagaaggtattggcacatcatgagaccccactttgatagtaatcacctccgaagtcctctcctccaccttgacgcgctttccttcccacttttcttcattagcccgattcttaccataaaatcggctattgtttggtgaagacaaacgctcatgaattggcctccgtggtcctcccctcccttggttgaattgcataggaggcatatgattgaacattggcggcgtcggcccccatggcatgaagcaaggataaggataacccgacggcggcattggataggaaccccatgacatatcttgtggataatgatacgaaggtgaacgcgaccgtcttggtgaatgaccaaatcgctccttaggaggtgatcttggtcttttccctttgttgcgaattttctcaccaccttgcttttcatatttctccaaaagcatattaaaagtcaccttggtcttcctaggggctttagaagttgaagctccactcctattctctttccaaacgccaacctccggcttctttagcactatcatcttggaccttggttcaccaatgaccacttccttccccttagtagattcggcttgctccggccgaatcaacaccttcttatcattgaaattaattgtattcaccggaaaatgatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataataaaaaatcttatcacacttggccacatcaaaactatatttaacctcactttgccgatctttgcgaggagtcgggattaggttagaacaaacaaaagttttatttttgttagtccatgaccattcggcaacataaatatcatgatcaccctcttcctcactatcattagcttaagggtaatcaaccacattaacattaggctttttatcaaatggtctagcaagttttctattatccttaacccggctttcttgagccagagccctttgcatgagttgactaacatcaagaaattgttggccatctagtctttctctaagaggagcaactaaaccattaaaagcaagaccagccaaatctctatcagttatattcaaagtataacatcggtttctaacatctctaaatctcttaatataatcaatgacagattcattatacttttgcataaccgatgtcaaatcacataacctaagctcagtttctctagtatagaaataatcatgaaattgttcttctaattgagcccaagtatgaatagaatttgctggtaaagaagtaaaccatgtgaaagcattaccggataaagataaagaaaacaagcgcaatttaaaagtatcactattagcctcaccacattgcgccaaaaattgacctacatgctcccatgtggtcttaccatcctcaccactatacttggcaaatttgggaactctataatttcgaggaaacagcacattatcataataatcaggatatgactttttgtaagttctagcacgatttctagtttcaatcccgaatctattcctcataatatcactaatcatatcctccatgttattaggcccttgttgatttggcggtgggtttggtggcctaataggttgtgtttgtggcgcaatatgattatattggccttgtcttgtatcgggaggatatcccctagaaacatcattataagcattaggaatatgtgtcacgtcccaaaacgaccctaaaatatatcctctaaattatgcctagaataattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttaaaatgattttataaaaagaaaaaccctaatgggccgaattcggcccatctccctccccctctctctcctctccccgcggcccactcggcctctcccctgcgcgcgcgccgctgacgggcaggcccgcccgccaccctcgctgacgggtggggcccacccgtcatcccctttctcccaccgctcccgccgcctcccccgcaccctagcgccgccgccgccgcgaatcccgccgcctcccgccgtccccgcgtgcaataaagtggggggaatcactccccgtgatcccctctcccattccacccaattttgcatccctctctcccttggattcgtttggaaaccctcccctaatcccgccggcgccattgatggagcccgagagcgccacgccggtttccttcccctacggccactctctccctcttccaaccctatttaaaccctccccgcacctccttcgtccgtttctgcctctcggcgcccttcctcctcgccggatttgagctcgcgacgttgctctctctctccgccgtcgccgccgagctccggtccgtctcccacctcggcgccgccctccttcggggttcaccgcatcctcgccaacctcgtccacctctccgtttcggtcgccaaccaccggagcgccgccgtagccgtcgacccgagccgcgccaccgcctccctccgctccggctgcctcctccgtcgccgccgtcgacctggggtgagccgtggaccgtcgcctcctttcccccttccctcccctctctcggccgccgctccaccgcgccggtggtcagcggcggcgaccatcggggcgcgggcgcgccgcctcccgctgaccgcgccagcgtggtcgccctcgggcgcgccgagtggttgccgcgtggggcccggccgtcagccgctcgtgccctcgggtgtggctgacgtgtggggcccacggcgccggccggtgtgagcccgggtgcaaccggtccaccgtggaccgtgaggctgccgcgtgggccccacccccgtggacccggtccgcgcgccccctccccctcggctgacgcaataaaccccttttttaaattaaaatttaaatgaagaaattcgcaaatattcatttaaagagcatataaacttcaaatggccataacttggccatttgaactcggaattggaccgttcaagtctcttttttttcgttaagaagtcaagaacccattttggtgctttgttcctgcttgttatatggagtttattagagtaaaagcccttttattttctgttggtcgtgtagacgttgcagcttcggaagatccgctcttcgtggaggttgaagccgacatttgggaaagtgagcaaggcaagtcacatcatccttgaacatattgaatcccagtttataaaattattttgatttaaattattgcattatcgctttatttaaattcccgcgttatcactgttttaaattattgcactttgcggataaatgcccaaagccgaggcgccagcaaggccaagcgcctccccgccccaacaacagtggtaaggatgtcattcggggtcatgtgaaccacgtgactgccgaggatgtgctgacaactccagacgtcatcgtgggtacgttcctcattcattccatccctggtaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaattccttttccttcggatctgattcttctagacaccaagaacttgcatgtgatccttgggatgaattggttggctcaattccaaggagtagtggattgcgcaagacgcactgtcactctgtaccgagggccggaacaaccggttgttttctttgcacccccaacctctgtcggtagtttagaacttcatcagataggactgtcagaaatccccatagtcagtgagttcggagatgtgtttccggaagaactacccggtatgctgcccaagcgagagattgagttccggatagatcttgctgtaggaaccactcctctgtacaaccgaccctaccgtatggtagcaaatgaactggccgaagtcaagaaactgttggaagagttaaaagaaaaggggtacatacggccgagcacttccccctggggtgctcctgtgatttttgtggagaagaaagacaagacaaagaggatgtgcgttgattacagagctctcaatgaagttactatcaaaaacaagtaccctcttccccggattgatgatctgttcgatcagcttaaaggtgccacggtattctccaagattgatcttctctccggatatcaccaattgcgtatccgtgaagaagatatcccgaagaccgcattcaccacgtgttatggactgtatgaattcacggtgatgtcgttcgggctgaccaatgctcctgccttcttcatgaacttaatgaacaaagtgttcgtggaatacttggataagtttgttgttgtcttcatcgacgacatcctggtatactcacaatcagaggaagaccatcaacagcatctctgtctggtgttgggaaagttgcgggaacatcaattgtatgccaagctcagcaagtgtgagttctggttatccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttcaagaaagaagaaaaatttgtgtggagcccgcaatgcgagaaggcgttccaaactctcaaggaaaatctggtttcctcgccagttttaatcttaccggatactcgcaaggacttcatggtgtactgtgacgcttcgcgccaaggattggggtgcgtgctcatgcaggaaggtcatgtggtagcctatgcctcacgccagctacggcctcatgaaggcaactaccctacccatgatttggagttggccgctgtggttcatgctctaaaaatctggcggcattatctcattgggaatcgctacgaaatatataccgatcataagagtttgaaatacatcttcacccagtcggatctgaatctttggcagagaagatggttagagctcatcaaggattatgatgtggggatccactatcaccctggtaaggccaacgtggtcgcagacgcgctgagtcgaaaaagccgttgcaacactcttagcgtccgtggcattccaccggaacttcatcaacagatggaagccctgaacctaagcatagttggtcgtggattcttggctacgctggaagccaagcccaccttgctcgatcaaatctgcgaggctcaaaagaatgatccagatatgcatgggatcctcaagaatatgaaacaaggtaaagccgctggtttcacagaagatgaacatggaaccctatggaacggaaatggtgtatgcgttccggacgacaaggaacttaaacagctgatacttcaggaagctcacgaaagtccttattccatccaccctggcagtacgaagatgtacttagacttaaaagggaaatactggtgggttagtatgaagcgggaaattgcagagttcgtggccctttgtgatgtgtgccagcgtgtcaaggcagagcatcaacggccggccggacttctccaacctctacaagtaccagaatggaaatgggatgaaattgggatggatttcatcatcggacttccaaaaacccaaggcggttatgactctatatgggtagtcgtggaccgactaaccaaggtagctcggttcattcccgtgaagaccacctatggagggaacaaactagctgaactctacttcgctaggatcgtaagtctccatggcgttcctaagaaaagtatatctgatcggggacgccagttcacctctcatttctggaagaagctccaagaagagttgggtacccgcttaaatttcagcaccgcgtatcacccgcagacaaatggacagaccgagcgtctaaattagatcctagaagatatgcttcacacatgtgtcctagattttgggaagacatgggataagagtctcccttacgccgagttctcctgcaataacagcgaccaagccgacatacagatggcaccgtacgaagcattgtatggccgcaaatgccg

SEQ ID NO: 80505 - DNA, 55006 bp, Oryza sativa
  unsure (1)..(55006): unsure at all n locations
ggctcgccggcgccgttgggcccttccgaccagcgggcgagccaggaggcggcatgtggggtggcgacgcgtgggggcggcggcctagaatgacgaggggaggtagaggagttagggttagaactgcagcacgaatcttaaagcgatccgacggtccagaattcatatgatttgtgaggtgtttttctgtcaaatgccatctagacatcctttttaaaaggcgataatgaaagatttactactgtatgtgaatcaatatgtatctataacatatgagtaaatttttacttaccatttataaaagtggtaaatagttaaatactagtatgtcttacgatcagattattactgctcgatcgggtcagtcactttacatctaaagagaaaaaaaaggaaaaagataaaaacagagtcggtcactttctcggtcgggttctcgggtcaccgtctctccgcctctcccatcccgagcctctcgcaaaatccattctcccacgcccagatccaccgccccccgccttgcctcctccgcgtcgccgcgccagtgcgccccgcctcgccgccgccctcctcctcctcgtcgtcagggtaagccccccgcccgcctcctccgctccgagcttccccggtttccgctcgaggtggtttcgccggacctcttggttgccggtttctctggatggggatcccgatttagttagccatattctgcgttttgggggaaccgggacgtcgcaaatattgctcctggattggcacctgttcttcccttgtttgcgttgcgatttctttctactagtattattattctgtattactattggtctgcagaagaggcccttgctggggattttttttttatggaatatgacgatcgtaggcattgtgttcgtggctcaatttcaaattccgagtaggaattgggcgttttttgtatagtcggcaagtaaggtaatggcggtggcgaccattctgtctgaaattgaatacacagatgtgctagttagtttcatgagatgcaaacggcatggatttgtggtgctccttggcgcgctacccggatgttctagtttcatgccagtcatgccgatgctgctaaactactatgtgcaagtcaacatcgtatgtgcatctgtttttaagattatttttgttagccctaaaaggttcaatcctagggtggttgatgtaagcatattttggaagcacctgtctgttagcttatgggaatcattagtcattacactttttagaaatggaggcttgtgaagtatgtgagaaatataaagttggtacaggatagagatggtgccaaattccttatctagaaagatttggtgccaaatgcctaaagcaaggagctgtcaccatgtgtattaattttagcaacatctctcacaggattcacaaaagtgaatatttaaaaaaaccaaatttgcattttagttggagaatggcttcatcccttcacggcttcacctgatgaccagctttgaacctggtcttttacactcggtgaacaaaaaaaacttatcttttacacttcctttgatcattctcatgcccactaagcactgaaatgttggaacaccagttaccttatgccagaactgtcaattgctggactttttatttagtttcattccttttttctttgttgatgtaagtctcactgagtcactgactcaatgtcagtgctttttgcttgtacgaatacactggttaatgattataagacagattatcagatgtagtgttttcttgtgatttgtttgtcacgaatggaactcgttgcatgggagagtcctgcgttgagaaattactttcagttgccaaccaatcatatgaatgctagtgtttacctgtttcaccttgtgctgaacagaccaacatagatacttcgaactaccctaaggacttatttgcctgctctttagtttatttattgtttaactaccacactctcggtccaaagtagatggcatttgaatgtgaccacctttgtagctttttcttgaggatttcaatactttcatttgttgacaccagtatcagtttttatgtgctaattttttcttaatgtttcagtgttatgtttttcatcactataaagtccaataaagtgaagagtgactctgcatagccagatggctgtggacagagatatctttggtatctcaggtccgacatatctgaatcctgttaattggtacgtgctcctgttgtgattacagtgttacatgacatttcctggaaaattttgtgattcttgaattattatgtatgtactatgtagagatgctgcacttaatctacgtttttaatttttatgcacatgcatgcacagaactaaattctgttaaatgtcttaaggttttggttggttcttatcttttatttctatgatagataatattaggtctatttaggcatttattattacaaaagcttctcatgttaacaaacttgtcacagccatcatttgtattttttttgaagagggcattagtcataattggtatgtcaatagttaaagaaaaaaatggcatgtcttacaatatgatgcatgaaagtgtgcagacaatctttttggagtttcattcattgtggattgagcttcatatttatgtatgtagtgttgacaatgaagcatgaatttagggactagtaatcaccttgatcttcatcgatgatcagcaaaaccagctgcctgttggagctattgccacagagtgcacatatatgattattttgctaggagtacagatgtgatgaacagtttccgtagtgcattaaattggtggaagtaactttttccctcgtttatgaactctcaaaaggaactgtgagcataatcggagatctgtggctgcatgcttagttcaggctgtatatgttttggagagggaccggcaactaggtcgtcaatctgttgaagccttgggacctccttggtgggaattcttccattttgagttgatccgcaagcttgtcgatgatgctgacttgtctattttcggtgcaatatttgaattcaatcctccttcaagtaaagaatcttctgctgataatgcaccgagatttgttattgccttcagaggcactataactgagaaggaaaccatctcaagggatatcgcccttgacctccaccttgtccaaaatggtctccatcggacctcaagatttacaattgcaatgcaagctgtccaaaacgtcgcctcggttttccctggctcaaacatctggctagctgggcactcactgggcgcaggtatggccatccttactggaagaaacatggttaaaaagggtgtgcttttggaaagctatctcttcaacccaccttttgttgccgccccaatcgagaggataagtgatgagagagtgaagcatggtttccgcattgcaagaagtgtaattactgctggattagccattgcaatgaaaggaaaaggcgaggggagcagccagaggtctgttgcagaagattctttccacattttgtcatcatggacgccatatctgtttgtcaatccaggagaccatatctgttcagagtacatcggctacttccagcatcggaagaacatggaggatctcggtgctggatttatcgagaagctcgcaacccaaaattccataggagatctgttttacaaggcattaggatgggaatcggaaccactgcaccttcttccatctgcagacttaattgtcaacgtaagcccttcaccggacttcaaatatgctcatggcatcagccagtggtggcagcctgagctgaacttgcagtgcagtaaatatcggtactctgtaggtgcatgacattggaaaaaatgtcttaggagacccttcttacactttcgtttattcattgtggttcgttccactctattgtagctgtcaatatgctgtaatagatgtttcttgaacctctgattctgttgacatgaaaaaaacttgtaatttcgtggagcaacgatctgtcagtctttacacatatgttcgtgttcatgtagctcttcgttatttgatcattttctggtgttgggtgagcatacctctctcttatgctcataaattgtttttttttcctacttggtttgaaccatattaactgttttaaatatataatgtcattaatgtagaactcgcggctaagcttttctttaaaagccaaagctacttttgaattttaaagttgatttttaagaataatcctaagtagattttttacatggtctgataacaatcatgaaaaaagggtaggcaattgaagtggcgaagagaatctactatagttaattctaaattcaaaatcagtgcagcttctaacagtatattggaaatctccttataggaagcttcatgaaatattatccctatatttcctttgctttccaagagaaagaaaattaaagaagtggaaggggtcggagcttcttatatttggtattcggggaggatgggagaagtaggttcgagatggtttttttaagagtaaattttagaaaactgcaactttagtgacaaaactatcagtttgctgtaacattagcgacatgtttaagtttgttgcaataatagcgtgagaaattatcataaaactataacttttacattatatgctactacagtacatataggtgacaactgtagcagcatataacgtaaaagttgcagttttttgataattttccacgctattgttgtagtaaactaaaatataccgctaatgttacagcaaactaatagtttgtcactaaagttatagttttctaaaatttactcttttttttaatggatcttgttaaaaatgcagaagggagaaaagggaaaaaagaagggagaaaaagaataatatggaaaaaaaaagttgttaaaaatgacgaaaaatagggaaaatagaaaaaacacatgagattttttttctggggggatcggaaaagcatatggaaaatttgggaaaaacaggaataacaggggtaaaaaaaaaggaaaactacggtgaaaaaaaaaggtgggctggtctgcctgggctatgccaaacggaccttgcaggcacggtccacacgccgacgtgccgtgtttgggccaactgtggtgaagtcgtgcctgggctggcatgcctttgtgcggtccatttggtcacctatactcgacctacaaagagcaatgcttgagccaagcccccacgcgcgatgcgcgcatgctccgcgttggagaccccctccacaattctcgcatgagtttggtgtggtacccactagcatgcattaattgctataaagcaagcctcacagtgagccacgtcaccatgttatttcagtcattggatcaacattgtgccacaaagatcaaccgttagaggaataagttcacttgaggtccctcgatttttcgccgagttcgaaattcatcccttgagcgcaaaaccagatacaacgcatccctcaacttacaaaaccgtgcaaataaggtcctagacagtattgtatccggttttggctgatgtggccgcatacgtggctcctttgactaggtcattgtcccacatggcattgacgtagcgcttatgtggtaatttgatcccaaaaaataaataaaaccatgggacccacatgtcagctacacaggaaataaaaattggtggggccccacatgtcatcctcacttcttcctcttctctctatcccctctctcctttctcttctttctcatccttcctcctcccttcttccagcaacacgccgccgctgggaacctgcctccgccgcgagcgcgtcccgggcgtggtcctcctcgagctccgcgaggcgtgttgccggcgccggcggagcaaagtagtcatcagggagctctcgcttgcctccgcgaagccctcgcctcgcgccgccgccaccacggcatcgtcgtccgtgtcctccgcctcgtcgctacgggggaggaggaggaggagggtggggggtggtgtgcgcggcggtgtcgttgggggaggaggagggtggcgggggtgcagccgctgatggaggcgctgccaccggtggcgagagcggcagcggcggcggcggcgtggtacgaggtcaggctgcgacggtgctcggggacaaatttcagttagtgggatccaaactgaggataattaggcattgaatcctttatttgatcatttacatcaaaattcaaatcagatcgacaagaacaatcagacaaggattcaggattttgctttacctcccgtaggagaggcgccgggaaatttctctgccaaggaaaaagagatcgaattatatacatagacaaactataaaattgatctataactaggtactactatataaagggaaatgtaaaaggtttactaaccatagtcacccaaaaagaagaacaaagcgaaaaaatttttgaagaaaaacagagacgaagaaacaaatcggagtgagttggttgtactgactgttgcacttgctcagggcggagaagttgccgccgcaggcggcagggagggcggcgacacgggtgtagttgatcttgatgccgaagtccaggccgagcgcgccgcagaggcaggcgacggcggccgggctacccagcgtgctcttcacgccggcacagcagtccttggccggtctcgccttggggctccccggcgtgatgtacgtcaggcaccccgccagcgccgtgatcgtctacccgcagtctgacgacggcccgcagctccggccgccgctccctcctctcccatctcccgtctgccgccgcgcacagctcctctggcatcagcggcccggctgtcgccccctgcgcttctccccgccggctggcctccccgatcgatttttgtcgtgccccgcccttctccccgccgaccggcagccgccgcgcttctccctctcggcgcgcctagagagaggagaggggaagagaggggagatgggtagagaggaggaagaagagaacgggtgagaatgacatgtgggccccaccatttttttattaatttgtgtgtgaaacgggtcccacggggtttattgtttttaccgaatcgaattgccacgtaagcgccacgtcgatgccacgtcaaatggagaccgagtcaaattagccacttaggcgtcacgtcagccaaaaccgtcttccaaactgccgagggacttcatctgcactggttttgataattgagagacccgttgtatctggttttctagttgaaggacgaaaattggatccgttgacaagttaaggcacctcagatgaacttattccaccgttagatcttcatttcactaccaggcctatatatgaaggaaaaagtacaccaaaggtccctcaacttgtcaacaggatacaaaaacatccttaaacagcaaaaccagatatacggggtccttttaactatacaaaaccaatcaccagaggtccttcggcggttttgatcccggttttgatctacgtggcggctgagtcagcgtgggacccacgtgggccccatatgtcagtatctcttttccctcctctcccttttctgctgtttctctctcacacacactcttctctcctacggccgacgatgcagcacgggagaaggggagggcggcggcgggcgaacacggtggcgggctcgccctccccgatctcactctccggcatggggaaggggtggcgcaggcggcggaccggcgggagaccagcggcaggcggtcgtggatgcggcgctcacgcggggctggctggccgcgcggtcgtggttggcggcgggtgaggtgttggcggcgagcgcacccgggaatcgatggggcagaggcggccgcggtcgtggcccgcgagtccaggcagctgcgttcgttgtgggggattggattcggtcgtcagctgcgttcgttgctttgatggaaccaaggccacgcgattccgttctgatcgacttgttccatttcatctactgtctcaatcagttcagttgttgaggcgcatttgatttttgatttgggtcgaaaatttgatggctcaatctgatctgagttttgggatgaatggatggatgcgtgcagagcaacggaggacagggagaggaggagatggtgagccaggggagcgcgggagggggagtggcggcctcctccggggtcgtcgtcaacatcaccaccgggcccatgacggagacggaggacgacatggccgtcggcgaggaggaggaggtggtggcggcgtcggcggagacggaggagcacgtgcagcgaatcctcctcgccatcgacgccttcactcgccaggtccacctctctccattcattaatttcgctatttgtcattctgaatttttcatcgatcgatgagattgcaatgccaatgcaggtgtcggagatgctggaggcggggcatgcgctgttcaagaacctcgccgccgacttcgaggaccgcctctgctcgtaagaccaccatccatagccatggccatggacacacacacccgctaataaaataattggtttggttggttgcttgatgacgagcagcataatcaatcgatgcaatctggtttgtttgtgaatttggcgtgtacaggatccacaaggagaggagagggtggagaggtgggaggacgagatccgggagctgcgcgcccatgacgccgccaatgagcaggcacgctccctccgccgccaccgctctcgtctgccgacgtcgcaccgttccagcccgtcgacgccgcaccgctctcgcccgccgacgccgcctctccgcaaccgtgctcgcccgccaccgtcgccgcttcgcctgctctggccaccattctggtgcggcgacggctccttccccagcggcgacggtgcccggttgaagaggtgccccttgggccgccctgcgccgtcgcctccggccggcttgcctagtcgccagaagataacagtagagtgagagagagaggagatagggagagggtgatgacgtggccagctgatatgtggggcccatgtggtcccacgctgactcagccgccacgtagatcaaaaccgggatcaaaaccgtcgaagagcccctgttaaccggttttatatagttaagggacccagcatatctggttttgtggttcaaggatgatttttatcccgttgccaagttgagggaccttcggtgtactttttccatatatgaaaacaaggcccaattggatgtttcagtccagtcgaaccccatcatcttcccgtcggccttctgccatgaattgggaaagacaccatagttaattcaatttactcttttgataagtcttttgcaattcctcatgcaaaccatgctaatcgtctccatcatggtttgtttcctcttcaacaattgtaaaccagaaactgccattatctggtgtcatgataaatctcattgattctctttataactctcaattcctcctatataagtgtgcaacactgcccgttttcctgcaccgtctacactgagtcactgagccaatttgattccctcacttgcataagcctctcacaagtcgaagccgctttcctatgcgacaacagccggctgatttagccaacatttggtctccacctatgggaagagcacaagatacgaaggcttctgcgtgttcatgaacaacattaggttccctttccgtttgatttactccacattcatttttgtaatataagtgctcttttctttttgttgtttccagcaagcttagagcaagtgcatataccgatccactgattgggcgatgaatgatcaagccataacagggtcagggtagtaatccaatcaaattacacattacttcatttttgtaattgttactctctctctctctctctaggatagtcgtcttttaaattttgctcatgtgcaacatggtgatttaatacagaatgaccatttaagcttctgcaacactttatgaacgtaaggaaattttataacaatgagcgtgctaattgtaatttacatgggtccattgacaacaaatatttgagtgagatctcccaaatttcttgaaattctcatgaagttttgctattttttaaggctcaattccatattaatttcatatttctttgttcctattgagaaaatctcagaaaactcaatatgtacagtagtacaaactttggcttgggttgtagttttacatgtgagttaatcgtttttgcagaagttcatccttaattagtatatagaggtgctgatgtgtaaaaaaaatattaatccttctaggttgcctttgcttttttatttttctttccccaaagtgtcatccaacaatctagctatgattgtttcccaaactaggaaggaagcccgcacagatgcgcgggcaacttatatataaaagattgttaaaaaaagttgtatttcactatattaattataagaaccgcttatttattatttataaaaataatgctaaagaaatcccatctcgccatattgattaattataaggaccgtagatcaccttataattatatgaaaataaatatctagaccacaaattttgatatactaaatgacaatagtatctttcattttcaaacagaaataactatgtcccagatatatgtatactcgcctgtcaccactatttattatcgttgtattataagttgtgtgcctttttaatagatgggattacatccatccaagaaaacaaacttaatatgtcattaatacaacaaaaagatcatctgtacttcatacctaattgttcatgcctcacttgtgtttaaatatatgtataaatattttgaagtattgctcctaccaattcatgggataaaacatttaacattagatataaatgcccctctaatgggtgaagccgacagtagccaccaaggctttcttctcttatgccttgaaacatgtgtcctttatcaacatagccgtgctcctcaaaatcagtgtggagcataattttaacgcttaattcattatcagctaaagaattgcatcgataagtaggctagttgaactttattgcgaatagtagcctctcaccagggtcacctttactcagtcatatgcatgcccccgccatttctacagaagcagagtatactacgttatccatgcttagcgcccttcaagggatgacacatagataagatggaagtgaatttttttttagttttgagtccatttatgaaatagagtgacacttgtttatggcgttaattggtccactaaattttatcatatataattatctcttctgaaaatatgtagagttgatcttgagaagtaattgttcatgaacatatgaatatgagttttgatatttttttttcattattgatctaattcatctatgcatgttcgtggggtaatatataatggaacaatatatgttatcatgtttatttgtgctgattgttaagacaatttataataacatgaagattgatagaatgtggtttcatttaatatttttttattcaaaagatagttaacatatttatcaattttctatagaaaaaagtgggttgtaaatgaatataatatccactatcagtacgttcttaaaaagaatggagtaattgttaagattatttagataagaaagacataaaaagggttagaatattgttccatgtgataactttttaatcagaattgctatatatatgtcatgaatttcactttgggccatattttattacgaaagtcttattttagactacccttaaaccaatatttttattttggacagggtacgtattaatgatctcggttatgttggcttctaatgatcaattaactgtcacagttatatgtaataccatatttttgatgtatgatgtagatggatagaagcgttgaggttggtccaaagaatcacagtggtaaaaatatgttatgcaaagtaaaagtattggttaaaggttggtacaaagcaaaatatcagtaatagaaaggtgccttaaagtgaaatttaattttaatgttgagattcgtgctatagcatttagcgatgtggtagaatgtggagagatgtaaaaagtgacactaactgcgttcttaagagcaagtttaatagtatagccaactactagctttaattcatctatcgccaatctaatagctcattcatacaatagttacatactacactattaatacctagtcacacctgtcatagacacactgtgtcttggagtccgtactacagctggctataaatctgtagcctgctgctcttctctctcctgatttatctccttaaaatatatttgcagctggcttatagcatgctattgtacctgctctaactgagctattgctactactccaacctctactactaccagtacatgaccagtagaaacgttagatgctaggcatccacgcgactgtcaaagtgcagaaagagaggggtaataattagcaaaatctcaatgtgcatttacatttataatttataattatagagtactacacagtaattagggtgtattttatattatactggagtgtaattttaatcattcgtttttttcaaaatttaaatattgttttgtatttttaaccaagttaattttgtttaagtttacatcatcatattaataaattatgttgcattttgtttggtcgtaaccatagtgatctccttttaattgtactatgaaatctgactgttttagcgttcgttttatgtcagaagaaatatacggtctcttttttattaaaatatagttaacatagaataccctagcaaataaactggagagaaaggagccacaacagagggtagactgacctctaatttaaggattaggaaaacatggtcaatagtttttcttatgtacgtatatatgcatgttttttttccctctcctgtacgtgcatatatacatacatatattttctccagatgaatagcatatatttatttttctctcttacaaatacacattagattaggagagagggattaattattttaatatgatttgatctaatctaatctaatggttcaaaataataattcacttgtacatgcgaaaatcaattgttatatatttatttttccctcttgcaaataaggatgagattaggagatggattaattactttaatctgatatgatctaatctaatataatggttaaaaataataattcacccgtacatgcgtaaatcaatggttcgatgtttagcttttatttttttagaatattttggattttattgatcttaagttataagtttaattctaaattaaattatgaccatttaacttaccatgtttgtgttaaatttctagctataaaatagggtgtagagagaaggaggagatatatatgggctgcacgtacatttataacctttttttgcacggtacgtcactacgtacaaagggaaagagttacgtgtgggaggagagggaggtggatgtggaaagatattttagataaatctgccggtttgaaataatgggtccaccgatttaaatgaaaacagatggccaatggccagatgttttgttttttttcttagaatttctaagaatttctattattatttattagaatgccatgtgacagcttaggagcgtttgtaggatgccacgtggcggtttgagagcgtttgtaggaagtttggctttggagcgtttgtatgatgccacgtggcggtttgagagcgtttgtaggaagtttaatggacttttagtatataatagatagatagtcaattatcactcctgatgaaccatccagagactaaaaataattaagatgatgtgtgatgaaccatctggagactaaaaataattaatgtgatgtgataccataagagaatagagaacaaacattattaactatacttaacgaggatgtgctttataaatacatttaggatttatgggattacacgcgaaagtgattaattactaacggtaattaatgagcgataattaattaatcaccgcgagcgtgatttcaagccaaatcgtaagcaaccggcttgatgaccgctggcgcgaggcccgggttaacgccaactttgagcacgagcttgaggtcgtcgtgttggtcctccagcgcgtccctgaggaaggccaccatgaggccaccgatggtcctcctggccacctccttggtgtccccgaggttcctcatgcacatgcagttgttgatggcgtacggcacgccgtcgtccagcatgtccaggtggccgttgtcccgcagcacaaagtggtatcgcggcggcgcgcactcgtcgtagaactcgcaatggttcacgcccgccggcgcgcatggcgggccgccgacgtgcctcgggcctaggccggtgccgatttttttgtgtttttagaccgtagagatggaaaaggggtatagatgtcggtggtaatactttcaacacatatgtgccgatacctatttaatattttatagtaatgcgatgaccatcaccgtcaggggcggagctagagaaatatgagggggttcctaagagcaagttcaataagctagtttagccgacgataaaactgccacatcggatttgtcaatgagctggacacgagagagcatgagtcggggattaaattatcaccggctacacacacatcccaacgcaagtgcagcaacactaggctagctttgactggggcatgcaattgtggggtccacgcgagctggtgtgatgtaggaatggcgagacgaaacgacagcaacaagattaaaaaattggatgaggaagctagctaaagattaaaaaattggataatagtccatgtaaacctgcttattgtatacattagctcttagcaatgtctatgctgatgtggtcatttttgcagccattagcgggcgacactattgaccttgctctaactttctttatgtaaaatactgacatgcatagttctagaacgatattatactaaatagttacgtacccagtacatataagcatcatctgtctaattgaaggcaatatacaacaagaaagtgcatggaaaaaatttaaaaaatgcgtaccataaaaccatgccggattgaattttccatctttgttggaaataactgatatgggaagtacaagatcacgaggttggcaagacccattctctaagtactttctttttaccttgtctctttggttgggatgataatcatcaatttcttttcttaagcctggatgatattcgatcgtctcttggcatcatctagtcgaagggatgaactcttcacattgttggtacaatccattacttttcttttaagaaatttctccatagaaaccttttagagatcaaataaaaattttcaagctttatattgatacaacaaattaaatatgaaagttgagagaaagcgctcacgtactctaaggctgcgttcgttaggggtagttcccaacacctcctcctcatctttcgcgcgcatgcttttcaaactgctaaacggtgtgtttttttcaaaaaagtttatatatgaaagttcatttaaaaaatcatattaatccatttttaaaaaaaattagctaaaacttaattaatcacgtgctaaacgctgcttcgttttgtgttccagagagtgagggttcaaccctcactcccgaacagagcttaagtgttggttaacggctgtgatttttcatagaagcacaatcacttgcaaccgttctactccggtaatcccctccgttgactgcaaacaacaaacaataacctaatcattggtagacttgcaaaattaaaagaagggagcggcagggtgcaaccacgcaagacttaccggccggccggcgttggagacttggagttgggctgcttctgcttcactcactgcttgggctggtcggcaacagcaaggcgccaaggctgtaagggcaggctggcagggcagggcagccaccaaccgggcagggctcaggctaggcagctggccgccggtgtctggctcgggcacgccggcacggccggattggcgcagtgctgtgccgcagtgggctgggcagaacgggaagacggcgtcacatccatagaacgagaggtgagaaacaatagcgatttttgatttttggaagaggaaacgtcgaactcgaaacggtgccgccctggcgccttgattcccgtcgccgcccagccctacctctgccgcgcgctatcgatctatgggaaacacgagcgaattctcgtatcctcctctcagttgggcctggtagagttatagttttgggccagagttttggatctttggggggaggggggttccctggtttggactggggactgtctatatggtggagaatataggggtaataagctatttagaattttgggccgggttcttgagcacccccctggcccattgggctccgccccaccgtcaccggcatccccgggtggagggaccatggcttgaaggtcaagcgacgagggccagcctggagaggtcgggcttgacgccggggaggttgaggacgctgccgaggacgtaggcgaggccctgccgctcgtcggcggcccagcatgcaaccttcctggtggcatcgttcaagtcgagcgcgatgccgtagagctacggcatgacggcgatgaagccgtgggaggcgacatgcgacaggaggccctcgtacctaggggcggatccacccattgggcagggttggacggccgacccagctacggcccgcaccgccccaccccccaccctccttggctctatcaacattgggcccaaaatgagcagccgaagcgctagtgaccagtctaaccgccgatcgcataagccgcacgcgagcgacgcctcatttctttcgacctggatcggcgccacaccatcaattcgccttcgcggcttcccccttcagccttcaccgagacaccgagtcgaccaagcgccgacgcagcgacgccagcatgccggtaggtgctagccctatagggagtaggcgcgctcccgcgcactagccgaaacggtcccgtcgcggcgccgcaacgccgctcactccattcctcctggctcggtggctcatgcaggatgtagtcctactgttctggctgcctggttgacagccctaatcactaatcaattgattacttccatcaagtctgaacggtgaaccacttggctttatgagttgtctaatatttgcaaattaaggccctgtttggaagattagcccagagctaatgttgggagctcatgtttagtcatgaattggtaggctcaacattagcctagggtggtatgtttggatcgataggctaattcaaggctaaaaggtggagagagagtagaaagagaggagagagaaggagagagagagctgctttttgatggtccccacacaaaattagccccattagcaccccttggaggggctaatgttttgaggggggctaattcacattagctcaaaattagcccacctgtttggatccttgagggctaaacattagcccatggaaccaaacagggcttaacacgtcaactattatcttttgttgtataatgaatcatatatgacacagattattaatttattttaaaatgtttttgtttcccttaatttattggttacactatatttctatgtgattatagtataaatatgatatttagtgtgtttagctattcttatgaaacgaccatctccgctagagatacaagtgggtagtcccgttacccgtataaaaacctgtttactagttcatttcttacatggtagtgcaaaatttagaataaaaaatgaactagaagtgagataaacgggctaaaaaaatctgcttgtccgtccgcttgtatccatagattctccgtcctatctttattttaatcctgcttccgccactgctcgtaccagctgttcaccatgttgcagccgtggaggaagatggcgaccgggtaggtcccggcgttggcgggggccaccaccatgagcggcttggggcaccaagccttgggcacgctcgggagcacgctgtggtcgacgtgtttggcctccacgcggtgcggcgccgcatggaacaccgccaccatgccgagcgcacagccgatgtgccatgtatgatatattgatatgaggtatgtatcttcttcttctttttctgttagtgtggtgattggtgaacagggtttgcaatctcgaaattaggtttttggcgccggggggaggggtggttgtggggggtgttggtcttgaaagaaccaaaattttagaaatttcttggccgaaattatttgaaaatttgaaatttttttaatgaatttaaataaactttgactaaattcaaaaaagaaaaagaaccaaaaatttcggatgagatttgtgcttgccggtggggggcaagaaacaaaattttaataactggtggtgaatgttgagacgaggaacaggaggcgtagctgcatgctaacctctatttaaatatactgcagcgacgcgcgacagtaccatttgcggtgtgaccgcactatttctttatgagaaattttattacgttaacgaggtatgttatagaattgagatgtggaacaatacgaaccattgattagagaggaataaaattatcataaacaatataatggcttccgtatcaatcgtccagcaggttaaatgcacaagagatttgtaggagtgattgccatgcactgatgcatgcacttcctgaaacaccgcggcactgcatattggctactcagtgaggcggttgacgacagcggtctccggcgatcgaggagaggacaattgtatattgcgatcttggccgatttagatggatagcaacagcatttggcgatctgcataattagatcgatgctagtactatactctaccatctattcgcgctcgtcatctgaaacttggccatctgaaatatcaattaattaacgtcagaataagaaagggcaaaagatcgacaagaatcaattaggagcaagcttagcaagcatcacatgtacctccgtcaatgctaatgcttggatgattcgggtggatcttggtggcacgcctcagcgcagccttcaattcgttcacctcctcctcgctggcgccttcacaatccaacgagacattgacctcctggagcgatggcaagctccccagtcccaagtcgagaccatcgtcgccggcaccggcgacggcgatcgcctcccgcacggagaaccgggagcgaagcgttctgagcctcggcattgctcctcgccggaacaccgccggcccaacgaatccccacaacccacagcacaccaggcacgcgaacgagccagctgatccaatcaccaacaccaccccgcggattccgagctcctcgtggtccacctgcagctgcagatcgcggagagcaggcagcctcccgagggtctcaacgtcggcctgccggatctccctcacggcgatggatagcgagcggaggtttgggacatgcgacggattcgtcatccacgccggcagcgacgagaaccagcagatcttctctgtatccagtgcgacgagatgccgaggggcgacccaggcgtccaaaccacccatgttctttcgaacattgttcatgcagacgtcgatggagagacgctggatcttctgcaacttgtgtaggagacccaccagtttgtcgttccatccgtcccagaagatgatgcacagcaccctcagctccgttaggttgcccagctcttctagaatgcccacagtagcacaatcgatcaacacatatgctagatgttcaagccttgttaggcttccaatcccatctggcaccctcgcaaacccgtcgaagcatagggacgtcaaatgtctgagcttcacaatattcagtggcaagtcacaaatagggtttgccctcaggtccaaagtttgtagaaactgtatgtttcctatttcttctggggcctcccgaatatctgtgtcacgtagtcctagatacctcaagtgaaataaattcccaacatacttaaggctgtaaccttgtgaaagatcacaaccttgtaaatccagtacacgtaaaactcagaagctcctaaggacaggtactagatcagtggcagatggaaagacaagagctgtccttgcttgctgcaagctccgagttgctgaagtcatagcatgatcttcattgccattttggagggacaacctccgaatcgtgtatgacagagatccttgatccctaccatttaatatagtaacaaagttttcctcacttgacaatgagcagataagatcgaggaccatatcgtgtacgcgacactcagataccatgtcagtatacatatcatatatgggttggatcatatttctatttacaaggtcattgaagtaactctctccgagttcaaataggctcctcccttgtttcccacactggataaagccttcagctacccacatccatatcaaacgatctttttcgattttgtaatcttccggaaacacacttaaatataataagtaagttctcaaatggggtggcagatcataatagctaaatgacaagatctttctcatattcttaacatccagactattctcgagaccagtaccaaccgagttgtacaccttgtaccactccatcttatttcttgctttacaagccagcagactagccattgtaatgatagctaatggaacacctgcacatttctttagtattctctcggatacttcagccaactcctcatcaggatatttttccgtgtcttcacagttaccaaatattcttccatatagtaatcgtcgagagttatttaaagaaagatgtttcaacttgtaaacaccaccagctttttcagcaacctcagaaatacgtgttgttgtaatgattttgtatccaacatcattatcaggcaaagcacatttaatcattttccatattgagatatcccatatgtcatccataacaatgaaatacctgcatatagattaagtccttaattaggaaaaaaactaatgaaattagaacgggaagttcaaatactggggccaggtagattagcaagttcgtaggcaaaactagtctagctattgtgaatctttgccaaaacagagataaattattcactcaagaaaagaagatttggacatagctatttaattccgactcaataacgatgtaaaaaggcttataagcagttgtagtttttttttatttaacccggacatgatgaacattctcaacaattaacagtatgtagactgctaattagtacttcctccgtttcacaatgtaagtcattctaacattttccacattcatattggtgttaatgaatctagataaatatatatgtctagattcattaatatcaatatgaatatgagaaatgctagaatgacttacattgtgaaacggaggaagtattacgaaatggatggcatactagcaaattattagttgctgagaaaaaacatcatatatatgtacagattggtggaaggaatgtgcttccatatataccttttctgttgaaggaattctctgagttcattgatgagctgcacctcatccaaatccaatggtttttcattgagatctttatatttctccttgtcaagttgataaatgatgtccatgaacaatttcttcaagtcaggagtttgagacactgatacgaaagcacaacaatcgaacagtgatctaatcttttcatatactacattagcgagagttgtttttcccaatccccccgaatccaacaatggaaaccaccttgcctgctcgctgcatggacactccattctcttccgtcagaatattgatcagctcatctctcgtctcaccgatgccaacaagctctttctcatccgtgtaccgcgtgaataaacgagggtcaattgtagcagtcttatcaccaccaccagcaccaatgttgatctcatacctgcggcgacgctcgtgaacctcgacgacgcggctcttgatgtccatgatctcagaggcgatcccatggcgagccttggccttcctgaataggccgacacttctatcgattagcttgctgatgccccgtggtttggcctcaccgtccccgttgtcgttgccgatgtcgcgcacgacgaacgcgtcgatggtgtcctcgatgtcgaaggagagctctctgagatccctggcccagatcttgtcctggggatcaagctggtcggccggcgtggcggagaccttggcgagggcgccctgcatgctctcgagctcggattggaggaacctgatctccccctttaccgccttctgcagattgtactcgccgacgagcagatcacctagcttggcgatgacgcttggcagtgcacccgtcgccaactccatggatcaagatcttgtcctcctccctgggtggatactggatggtactgacaaagaagataagctcggagaggatgagactcactcgtcacccggtggatcgatcgtgggtgaatcgcctagtccagtcccctgtcgtcgctgactggatcgatagggcgacgctctcgattgattcgaagtttcccaactcgatcgatcgccctgcgctcgaacaggaggaagagctcgatgaggttagacggcagtttgaacttttgttcttagacttttcgatttagatgagataatgattagaaatgaaagatatcgttgctgttgggtcgctatagtcctacttggaagattccgagtaggtaaagttgacctgctccatacatgtgcttctgttctgacttgtgaccatgtctgcgttgaaattcgagttgcttcgccttcatcaaaagaacaattcagctgcaagtgagtttcaagtatgttttccaaatcttcttttccatatttcttgcccggctgcattgaccatccaacttggtcgttgggtcacagatcatgctttggcctcccatgcttgtcttttcctttggctcctagcgtaacaaagcgtaacaagtctggattttctacattttacccctttttaaaatcttattttgcaaatagatctctagaaaatacttattttagcaatggaccatttttctccaactagagttgttagcgccaaggttcaatgtcttagcatcaagcactggcaccaacaccgtcgccttctgtggcagctaaatcactgacgttaagggagtcggtgtcaaaaaaactgaaacataagtacctatttgtagaatattttttaaaaaaggattaaaatataaatatattttactacaacatgcccttagcgcaagtctcttttgcggtaatggtctattgtaagaaaaagtatttacatttcaacctttttcataaaatttgttctataaataggttattggttctagtttctttggcgcggatctcacctagatcacttgcgctaagaaaaagatatatttgtttgtctaagtgtatatttataaaaggaataaggctgcatccgttcctccttgttcccaacctctactccctccttttccatatgcacgcttcctaaactgctaaacggtgtaatttttgaaaagttttctataggaaagttactttaaaaaatcatactaacctatttttaaagttttttttagctaatacttaatttatcatgcactaatccatcgctccgttttccatggggagggttcccaaccctcaccaaagaacacagcctaagtcaacataaccccccaacctattaccaggtgattacttaaccccctcacctaataaaccagctatttaaccccctaatcttgttgatacagtttaattaataccatacagtggttttgcactctggttttgccccgctggcgggacacgctcgaccagcctggcacagtggatcgacaggcgtgtgggggatggggtgaataaaaatatgagcggttctctcctcgttctccttggaacctcctctctctctctctctcctaggcgaacaacctgctgatgacagggagtagatccatttgattggattgcagggtgaggtaaaggtgagtctccacaacctgtttctatgttttttttcccaatcaggttatctcttcaaggattagggctaattctacaaggtcttttagtggtgggttatgtattttttctgtgaaattttgatagtgctatgttgtaggcagtaaaattctcatcactctctgtgaatttctcggtaattttatcgtcttgatgattttaggatttagggcttatgaacacaaaaattagctcatacgttggtaccaaaggacacataaatttgctctatgggtgtaagatcttgctttggtttttttaagactaaccgaggctagaagcctcagataatatatagcgtatgatcttgctagttgttgtcatttaatatcatcaagagttaggattatttttgtttcttatttttgcaagaatggatccatcggattttcttccggtcaggtttcactatggtggggaatttatgttttctagggggcaattgcattatgtgacagagcgtaccgcattgtcatacatagagctcgacaagatatctttacctgagattataggtttcctcggtgaccacatgctagttagtgatttattacacttgcattggctatatcctgaaaagcagttgtcagatgggctaaggtttttgcttgatgacagtgcttgcatagaaatggaaaatcatacgtctaataatggtcaggttgcagacatttatattgagcatgtagcaactgatgaggggcaagatgataattagattgctgactggggctatggcattgcagaagctgatgatgaagcaaaatcagaatcaaaggcagagctacttcctactattgttctatgtaaagataaaaagaagggaagattgaaaccaagaagagcaacatctcaaattctagagaagcctgaagattcaggttcagatgcactagtgcctgaagatatagatgacctgaaaataagatagttcagactctgattataggcagcctatagagcaagatagctctggagatgatgaagaagctgaacaacttaggaaatttgcaaagaaaatcaagagaaacattagggcaaggaagctaggagttcatagtagccaggctgtagagatacttgatgatgcactggtgcctgaaaatatcaacttagaagatgatggcagtctgtattataactcaagtgatgactactcctatgaggagaatagtgaaggagaaacaattagatggaagagcactaataataggtttaacaaaaaaggcatcatttcctgtgttctctcttagcatggcatttagatcaagtaggcagttaaagaaggcactagtgaagtacgggctgacaacacacagacatattctattcccaaaggatgaaagggacaaggttagggcaacctgctattgaccaggatgtaaatggctaatatatgtgtcaaagacaagtaggtctaaatggttccaagtggccacttttaataatgagcattgttgtccacctaggagagataacaagctagtcacatccaggatcatcatgggagggctgggaattctcgaaatggaaaaattcacatctacgcttaggctacgatggttgtggctgtttgatacaagcagaccttgggagctgatggagatgccttgcaatatgcgagatgtacaactcttccaggcatgcacaaaaatcacagtaggagatggcaaaaaaaactcttttttggaaagacaattggttaccaggtttgtgcccgaaagatcttgctcccaacctcttcaaattggcaaaaataaagaataggaaggtggaaacataaatgatagacaacacctggctacattcttttagacagatcactaatatagaaaccatccatgaattagtgcaattgggatccctcctcaatcaaataactctttctgatcaacatcatgatgaaatatcttggacaagaaatgcctcatgaatcttctcggttaaaagcgcctgccgcttccaattcatgggttcggtgattgatcatattttcaacctaaattggaaggctcattcttcatcaaaaggctcttacagcagaaaacctgctaattagacactgggaatgcgactggatctgtactttatgcagagaagcttttgaagatacagaccatctgttttgccaatgcaacttcatcaagcaggtatgggcaagaattgccgctgaaaaagggattattcccaatcctaacatttccaccactaacagtggatgtgttctctagggtccactggccttaaaagccaaaccaggtcaaggatcggaatcctgttaaagacatggtggcatgtttggttgcaacaaaacggaaaaaaaaatcaattcccaagccccaagtctacaaagaacaatatcactcatcctcgacgacatacaggagcaggatatggttttcaaacctccatgaagggagaaagtcctgtactcattgctagagttggttgttttaagaatattttgtaatctcaactttgtaaacttggctttctaatctcctaaatatatctggctccttgctagagttggttgttttaagaatattttgtaatctcaactttgtaaacttggctttctaatctcctaaatatatccggcaaatcttttgccgctttcacttcaaaaaaaaacatccaggatcatagtaaataaatattttgatgttatcaaggataatccgacatggaaagtggaacatattaagaagtcagttctaaaggacatgcttgttgatgtgcccatttcaaagtgcaagcgggccaaagccttagtgctacaagaagcattggataaaactaggggagagtctcaagagtgtatgattatcaattggagttgttaaggagcaaccctgggagtattgtagttgtgacccttaatccagatatacttgacaagaaagtatttgagaggttttatgtatgctttgatgcttgcagaaaagggtttcttgctggttgtaggagagtaattgggctagatggttgtttcttcaagggtgcttgtaatggcgagctaatatgtgctattggaagagatgctaataattagatgtatcccattgcatgggcatcagtggagaaagaaatatatgattcatggtattggtttcttgggtagctaaaaaagatctcaatataaatgatggaggtgaaggatgggtgataatttctgaccagtaaaaggtatgctttttaactatttatcttttaacaaaatgtgcaatgggtcctaagttgtaataaatattttgaattacctgtcttgtagggactcataaaggcagtggctgagcttatcactagagtagaacataggatgtgtgcaaggcaaatatatgcaaactggagaaaaaaggacactgaccagaagcttcagaaaaaaatctaaaactgtgcaaagtcatcttgtagggagcttttcaactataatagagcaaagctagcacaagacacccctcaaggagccaaggacatgatgaccaccacacctgagcattggagcagggcattcttccagctagtgtcaaattgtgactccgctgataacaacatgtgtgagtctttcaacaactctattatggattcaaggttctttctagttatctctatgaatgaagccataagattcaaggttttttcaacattagctctctttgaccatgtcctgtacatattttttttctgaggctcagccctcaactctgctctatcaatatgtaaggcaaaacctcttcccttttgaaagttcaagtgctattaatttggttttggtgattaatgataaatccaattatatgagactaatttttttataagcattctttgcctagtgtcatgtggatatgaaagtgaagtttgtgataggtgattcccggacttcatatgagttgaaatagaaatgttaattgttcgtggacctaaatcacaaggatgaaatgcattgacctaaatcacatctttctctctatgcacatattgatatattcatatataatattttcatgtgattgacatatggatttgagactaatgttttgttgagccatatcttgtttagtctcttcacattgagaatatggagatgatgaaggtatgcttctaccttaatgtctacatatgataaataccttctattcttgtatagggtaagctcacgatgttttatctctagttatgcatactttttcttcacacacaaaaaaattgtatgcatacatttaggggggtaaatcctataccttagttatgcatgtattttgtcacatcctgattttcgtcttaggatttataaattatttaataaattattattagaatttatattaaatgttcattaatttacaagtgaagttaattgtggaaaataaaatttcctaaatataaagcatggatgtatttaatttttattaaattctccatggttaattatactctctggaattttctcggattttttggagctcaactcttaattttaatcatacaaagaacaattcagtaattatccacatattaaattaatcattaaatggtctgattataattttgttaagtactttgagtgtccaagtattttcaggatttttcttgaaattatttgagcattggaagtatttttaacaattcaaagatcatttcagtgattaatttaattggaaaagtaattaaaattcaccttttccttttcgggccgaattagggaaagtcctctcactctcggcctagtctcctctcagcttgcagtcctttccctctctttcccgaagtctgctttgtgtccctcctttaatcagtccttggaagtagaagcccagccgaaagtctagtttgcttccctgggcactgttcatcttcaagcttggacagaagcctgagccagccgtcctgtgcctggaatcgaattcgtttttgagtttatctctccaactaaccctcggtttttccggctcaaatcctctcggttggagtccgatctcttcaatccaagcctataaatagcatcccctagtcgccctctttcgtttgccccatctcccgagctctctcgtgcctcgtagtgccgccgccgcgccacccaaaccgccgccgtcgccggccggcgaacagccgcctcgcgccgtcgttttagccgtcgccgccgcctcctcacgccgccgtcgggtgcgcgtggaagaggggaagctccgccgcccttcgccgtcgccaccggtcgccggagagccgccgccgccgtccaccgaaccgccgccgccgcacaagctcgtcgccggtcgccatccgtggtcgttcgtcgcattggttagtaccggtgagatcgcgttgttctcctctacgcgtaggtgccctccaaaagtccggccgagtcccctagcgccggcgaggtcgtcgccgatgacgagtcgacattgatgacgtcagcatgacgtcataaccttttctttttagtttttttaatagatgcaaatagtttaaaacttcggaaattcataactaattcatcgtagctccgattcgagtggttcaagttgctaagtttttctaaaatcaagatctacatgttaaaaatatccacatgtactgtttatgattgtttttgtactgttttgttgattttgttcatttgctttagtttccgtcgttccggaggagagcgttttcgttgaggaaggttcggaagtgtttgcggaagctcaaggcaagtcacccagatcccaaacaaccctttgaacatgttgaacccgtttaaagctaatgatttatttcaacttatgcattattttcgaatgtcatcgggtgatgagcctttcccaattaaataatggccgaacatgactttattttcctatgggttataatttgattagcttggaccttatatattggattggttcagctaaatgccatatgtatgtttgcttagtcatgcttaaacattagctaattaaaggggattaaatataaatcatattatattattattaattacggttatatttaatggtagctcacgatggttaatcgtgttatgttatgtaaattaattggtaattaaaactggattaaggtgggttgtgagcacatggttttgaaggtcgtgctcatgacaattaaggaccggttcgcgagctactgttgtgaaacatttaccgtgccaaccacaagccagtgtgagcaacggctttaccttttgtatagcatgattcattacggggcaccagactgtgaagcggcgagaagtccatgggggtcgctggggagtccattgcctttggttttgagggggagattatgatccaggaacggtgcactgtggtgagttgtgttgtgcgaggggtattgtcacagttcctttccgaggtaccgtggtggtgctaaggcgcatggtgacatgttgtgggattgcgtcttgtgggtacagtggtacacctctgatcaaagtaaaactattcgaatagccgtgtccgcggttatgggtgagttgagcaatgtttttcgtgattagtcccacattactcattaatgttaataatgtgataattaatttgactcctggtttggaatggataattcctggtttggaggtttgatctgtacgaccggggttggctgttcaggtttggttgggcctgtgcagcattggggtgctgttcagtgtcgattaaaattgatgattaattactctactgatttacttctaaatgtttgcttaatgctgctttcgcaaatgaacctatattatgccatcctttggtatccttgtgcatttgcatatttgctgtgtggcttgttgagtatgtcatatgctcattcttgcaataatcatcaaacctcagttgaagaaaaaggatccagaaggagaagatgtttggcttatactccagttgagctgcctgtgggagtggagctgaagccatcgctagaccgttaattccgctgctattttccttttcttttgtaagtatgtaacattattattatgatggatttgtatattaaattgtcagtttgtgtacctcggctgattcctggacgaggattttatgcacaaattagtttggaaattactagtgaatttctgggcgtgacatatttgatccaagtttttcacttgcatttaattgggatctttacatttgagtacatgacacttgtgatattggttaatactcatccacttccttttatatgcgcgattggttgatcaacatgtagaggttgacaaccagatcattgagaccaataatttcattgagttgaatgagaaacattggtcccaaggattgaaaaggtgttgatgctcaatcgatatcattacagctaaaatactaagaatgacagtggagatattgaagatgcggaatacgaagtggctattatggcaagacgatcttcaaatgattgatgctcggtcgcgatggaccatgtgacagtgaagggcaagcaaggggcttggcgccgaagagccaaatccggtggtgaatggcgagtgacagctttgtcatgatggaccgtgcgagaccatttgaagctacaagtaaccgcatcaattatttgaagaatatatggtgaaacggttttggcgttgctgttccttaagacaaaggaatgaagatgaaaagaaggcattccaattggtataattctcttcctatataaatttgagtatagtaatatcgtactatcaagagggatgcagcgtcgatgtgtttgtgtatgtttcggtgctcaaagtgaccaatcatagtgctaccttgagagacactcaagctttaacatatcctttgagtggttttaactttgtttttggttgagttaggtagtcctctaagtgagcttttcatagagttcaagatcatcaaaaacggactcccgagcgaaaacttatggtcgttttatcctgtgcttttcggaaattctgaaaatggctgcgaaactgagataggcttctgttgattttttgcacttgtccgaaaatgcattttggaaattccgaaaattacagtcttggcctccaacggctagttttgagaggcttgggtatgtaaactcttccgccctttaagtggctgctgttctggggcaatattagacacatctaaagccaaatagctttttcccatttccctacctttgtggtgcctctttgtaagagggatttgagaaggggagagagttggattgagagagtgagaagttaagagctagcgagtttcactccatactttgagcacttgagttcatagcaaacaaatcttcagttgtgttagttactcttggggactaaggtctcctaaacggctaggtgttgccagtgagcgcccaagattgtggtgtgcctcgaaaagtttgcgaaggctttgatttcgcctctgtaagggaagaaatcaattgtgaaatcaaggagtgcatttgcacaacctcgtgaggaaagggttaaaataaacctagcctttgtggcccctcaacggagatgtaggatccgtggatctgaacttcgagaaacatatcaatgtgtctcctttcttgctttgcttattcttgtcatctctcatattgtgcttgagtttttttttatccaatcacttgtattcttaattaatatagttgatgaccttatatcttgcttcaatctcttgtttgtcaccttttgattcatatacattttatttgtttgagctacaagttcatagctagtgtgttgtttcgttatccgctgaattttcggttgaaactgaaactttcaatcccataccagaagttccgagttgaaccggaagttctcatcattctaatatattatgaagttgtgataatttttttaggaacgcctgttcacacctcccaggcgatatcaaggtccttttacctttccttaaaaaaagacgttgtattcatgcatattttgtgacagtgcattttcagaatcatgtgttccacgataactctgaatgctgaatataatgagttttatagctagacacggttattaacaaagtaggtagaattaaatagtggaagattgtgattggttgagaagtgaaggtagggaaattgaatggtggagggttgtgattggttgagaaggatatgttggtgaagatgttattatatttaggaacaaattatagaggctaaaagtttttatattttaggacggagggacgagggagtactgacttttgtaattctcttgtaggggtgaccaaaagagattcataatatgcagccacatcggacgtacacaaaatataactaaacttttttactgcagagcttataatatgcagtctctttggacagaggagtatgatttttttcttaaaaaaaatcatagctgccaaacaccaccttattacagagtcacttattaggtatacacgcatgcaccgctcagttattagtaatgaaacaaagcatatccagagaccaccttattacagagtcccaattcccttatggggagtcatccttaccaaaaaaaaaaaaagaaatatcgtggctgcatggaaaatagaaccttcatttcaggatttgcagcatcggcaggtttggcaatgttttttttctttttgaggtttggcaatgatttttagagtgaccatataagctgctactgacatcgtaacagttaaagcgaaatgtgccagcttcgaagccttgatagatttggctcggatggctgcagctatcctgcagaaacaaaaatacatgacaaaataaattagtctttccattacgctctagtaacatctacaccttcatagctctgcactaataaaaattatttagggaaattaaatgacacaattgaaagagcatcgatctcccaagataaattatcaaattaatagtaggcccatttcaactggagatagccaagaaacgagatatccccaaaaaaaaagtaaattttgtacatgagtctagacaactataatatccagattaatatacaaaaaatattttatttagatgcaaaagggtatgtaacctagttgttgcaatgaactgagttataccccaaggtactgagttccccatagtaacgaatttcaaattagattatttgaaagaccaaattctcatttttttaaaaaaaattaaaaaaaacatttagaacggatttacggatggagtactgaggaagcacaatacaataacatatatagaaaagcatggagagcgtgtccaaggttttacaattaactactttatacttactcggcattacgggattccacacaatgtgggcacttcgtggttgtactggacgagtaagtttgcttggcccctccaaacggatttgcaaatgcaaccttcccgtgattgcaatcaacagaggatgtcgcagtttttgcgcaggtcattttatcacttgaataagggcatattttgctgttaaagtaccttgcagcctgcatgagaaaggttcagagatcagaacatgaattcgatatatatatatatatatatatatatatatattataccgaattcaaatgttcaatataaaacttgtagaagagaaaatattgttggtccctagtccaatgtaaaactctgataataaaagatatcctagtgtagaattcacaagaagaaatattattttcccataaatgtatacgaggtattgtttgacatgccactgttccatataaaacatactccctccatccgtgattgcagtggcgaaactaggatttgaatactgtcacgccctgaagttcttctccctagcaaaaatttaattaataaattgtcgcaagaaattatttgtttaaaggcaagagagaatttttcttggaatcggcatgtggaatttttcttggattctacatgtcaaaatatgctaacaggaattttagtggaattttcagagccttggaaataattttagtggaatcccaagaagttggaggatatacctatagtacaagagtatcctgaggtgttcccagaagacctcactacaatgccaccgaagagagaaatcgagttccagattgatctggcacccggaactgctccaatctacaagaggccgtacagaatggcagctaatgagctagcaaaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacactagagttgaagtccttctcagttgaagatgtcacaaagaagttggtttcgtcgctaccgtcaaggatgcctgtggaatggagtcgcccactgtagaagtcaagtcttcaggcttagctcgtttttttcctcttttttccgctgcatttgtaatcttttatatttttgtaagacgtggatctgtatgtcaataattgtcgtttgtgtaccctggctggtcctggacaggggtttaatacacattcagcttagaaattcttagttggtatcagagccgaccttgaccgtaggacaagccaactggaaaccctaagagtcctcttaaaccttttcatttgcacatgccttttgcacttggatttgtttcggtataattttggggtttgctcttttgatttgtgggaaaaatcttgatcgctatttaatcgtatttctcggctagaggcagtctagggttctagcaaaactttatttggaatttatttggccttcagtcgggaatttgttaggtgatatgcactaagtcgtgtctagattcgatgggcatttttatgtgtatattatagctacgcatctattttgtgcattaatttatcgtttagtcagttgcattagtatctttgtctgggttcatgaaaaatgttccacgcataaaaatcatcatgctcggcgagttatttgagtcatttgttgctttatttaatttggttttgagcatgtgttggttcctatccctctgtcctctttagatgtcagacctgttctctgatcgcaagcgctgctccaagcttcagagtcgccgcctttatccttaacattttcttagttttggctgcttgctagtttctgtgtttaggtttgttgcttgtgggttagtcggcggtcgatatcatgtgttagtggtatgactgccttaattaggagttgtttgctttctttttagttttttaatcaagattaaattaattgcacttaaatctataagaaagattagtttccaagccatctgttttcttcctttctcttatttctacctatcctcgtccagatggtgaagacagggaatgatccccgtgcctccaatgacgctaggggcagcgaagagcagaccgatggagctcatatcagtggtgcatctgacagcagttcatctccaccgcccgagaacccaacggtcactcagatgatgacaatgatgatacaacagatgcagcaacattaccatcagatgttgcagcaggcgcagcagaaccagcagtctggtcctccatcatcacacctgtccaaactgttagactttcatcatatccagccacccactttctcaagcaccaccaacccaatgtaggccaacgactggctccgtgcgattgagaagaagctgaaccttctgcaatgcaatgaccaagagaaggttgcttttgctacacatcagttgcaaggtcccgcttctgcttggtgggataactacgtggtgacccgtccagattcaacggaggttacttgggcagagttttgtcaaagcttcaggaaggcacaaattcctgaggggattatggcacaaaagaaaagagagttccgcgcactgcatcaagaaaccaggatagttacagagtacttgcatgagttcaaccgccttgcgcgctacgctcctaaggatgtgcgcaccgatgccgagaagcaggagaagtttttgtttggtctcgatgataaattgaccaaccagctgatctccggagtctatgatgactttgagaagctcgtggacaaggctatccgtcaggaagagcaacgcaacaaaatggaccgaaatagaaaggtagctcagatcagctttcctcaggggaacaattagaagcctcgcttcatgacgggacagctaggtgagccttccaccctgatcatccgtcagcaccatccttaccacccgagtaacttcaacaacgactacaacggtggcagtcacaacaacagtaagcagcataaccacaactcgacttcacccccattaatggcaccagctcagtcagatccgccagctatgtcagctcagtcagaacagctcaagaaggagtctgcaggaaagccaagaccctgcttcaactgtggcaagcacggccactttgctggcaagtgtccgaagctaaagcgcgttggacctaggttcgtccaggcccgcgtcaatcatgcgtctgcagagaaagcacaggcatcaccagaggtcgtgctgggcacgtttccggtgaactcatatccagcaacagttctctttgattctggtgcctcgcattcttttatatccaagagatttgctggggcacatggattatcggtagtggaacttaaaatactgatgcaggttcatacccctggaaatgacatgaggacagcacactactgcccctcagtgactatagagatcaagaggtcacggtttctatccaacctcatccttctcgaatccaaagacctagatgtcattctcggaatggattggttgaccagacacaagggagtgatcgactgcgcaagtcgcactatcaccctaagcaacgacaaaggggagaagatcaccttccgttctccagtgtcacagaagtccgtagcgagtctgaatcaggctgttattgaggatcagacagaaatagcggaaaaaaatcccaagaagttggaggatatacctatagtacaagagtatcctgaggtgttcccagaaggcctcactacaatgccaccgaagagagaaatcgagttccagattgatctggcacccggaactgctccaatctacaagaggccgtacagaatggcagctaatgagctagcagaagtcaaaaagcaggttgacgaacagctgcagaaagggtacatccgaccgagtacttcaccttggggtgctccggttatctttgtggaaaagaaagacaagaccaagaggatgtgcgttgattatcgcgcccttaatgaggtcacaatcaagaacaaatatccgttgccaagaattgatgatctgtttgatcagctaaaaggagctaaggtgttttccaatatagacctgcgatcaggctatcatcagttgagaattcgggaagaggatattcccaagacagccttcgccactcggtcttgctctcttttcccccacaccagagttgaagtccttctcagttgaagatgtcacaaagaagttggtttcgtcgctaccgtcatggatgcctatcgaatggagtcgcccactgcagaagtcaagtcttcaggcttagctcgtttttttcttcttttttccgctgcatttgtaatcttttatatttttgtaaaacgtggatctgtatgtcaacaattgtcgtttgtgtaccctggctggtcctggacaggggtttaatacacattcagcttagaaattctggttcgtgaatatctgggcgtgacaattacgagggggaactaaattgacaagtgatcataattatattttttcttaaaactaggaaggtagcccgcgcacatgcgcgtgcaccttatttaatgtgcatgaaattttgttagggatgtccatgtgtgggtgtttctctatctaaataaaaattgaacttatttaatgtgatttgaatgctggttataattttcttatgattacccttgcagcacataaattctaaactaaaattacttgagactgtacacttcataatttataagaaaatattatgtcgaaacaatagatgtagttcctatgagaaaattttggtcattttgacttctcgcatagatatcttacccccaaacatttgctcaaaaagtcatttttttgctagatagtatttgaagttttacatattttcattccattagctttgctagaagtttgaatgtttctgtttagaatgggttttcaaaccaattttttttttaaaaaagataatttttgttaaattttgattcttttcatgtacattttttaaagaaatttggagaattccactctatgaagcatatttgaaatgatttgatttctgcaatttgggttaaaaacataagtgggttgagcctacaacctgacatggggtaaagtcatctcttctgaattatctcacttcaattgagtaagaaatattaaaatagaggtcatgtaataaatacacattattatgttgtctataaaaaattaacgctagatggggtacaaattatgacgtaaaacacgatatcatttaaagttttcctctaatttattggtgacttcatagatcatatagataatttagactctatgatcatcttaagattatttatttatcttctaaattgatcattgattgataaaaaagcaccaaggtcatattatataggtaagtagcccccatatacatgttgagagaaattaataaatttgatagaaagtgttagggtctaacaggatataagtaatgggtcaaccagctttattaaaaattaaggtgggatattctgattttcaatgacgaattttagtatcttttttaatttattgttggcctcaagatggatgtgggtctagaatataatttttatgttagcatttaaatatagacaatatgaatattaatgtattgatttcactaaaaatataatagttcgaacagatcataagttgaatatatgatttgaaaagttataaatattttatttatattgttcctataagtgctagtaagagagagaaggacagggacagtgggatacatggctagacctaatatgtggaggttaatttgtggtttttcctccataaagattaatttaattttaattatcataatataaaaataagagaaaaggaacatcacaccgcacggggacgggaagggagggaggaggatgttttttcttaaaaaaatgattgatctaatgacctaaaataatgtgttggatgtttaagtcgaaaacaatggtcggatgttttgtttttaacttaagagagaccagtagtggtttagaaatatttataggatgtttaatgtatttaacattgcaggggccgagagtgaggaaataaggtttgtgagtttttttaaataaaaatctaataacaacctaaatgatatgtccatcgatttaagtcaaaatggtgttttgttcttaattttttatgattttctctaatttataatttaggagtgtcactgtgtggtttataagatggttaatgggctttaacgccgcataggagcgcggagggaggtttgggatatatttttttagaaaaagataaatctaataacctaaaataatgtatatagatggtcgaatgtttttttaaggttttctctaatttaagagtgctatatactcatcccgtcccataaaacctgaacttaaaataggatgtggcatatgcgagaacagcgaatttggacatgtgtttagaaatatttatatgatgttgattgaactatttatttattaggtgagaatataggaagttggctagatctagtaggttgatgggctttttaggcccataaaaaggtatttaatttaaattatatggggatttaaaaaaaggagaggaacggttggttggaggaatcgcacgtacgtgcgcgcggaggctcacgtccggacggagttatttttcttgtgaagatagatctaaatatgaaaattaatgggcccaccaatttaaataaaaatcaatggtcagattttactaattttttagagtgacacatggggacttaagagcatttataggataccacatggcagccttagagcgtttgtaggaagtttaatggacttttagtatataatagatagattatatgcaaatttcaatgttttctttaggtaatgatgcatcgtattaacatgaaaaacatattacaacaaaaaacataggcaggaagttatactgcatatacttatttatttatgaaatttagcatgataagaatgttgagcaaatatatcataagcggtgaaaatatcgaccgagataaaagtctagataaataggctttcatctatatcgattttgataaaatgattaacaaactatctatcttgcaagtattaaggaatatttagaaatttgagatggtagccatctaacgacatgattatgattatgagatattaataaaatgtagtattatacaaggaaaaggaaaaaaagaatggcatggcttgtgcttcttttggttagtgactaattaatcctacacgataaacataagaagctggaaattcagcatggcacacgatgtgatgctgttagctaagctgtgcatgcatcggcagaatcctatgacttgctctgactttgagtcactgacatgggccaactggatagagggcacacatatcagtgacacaagttagagaaaagtaagttagaggatctctatttggttgggttgtagtttaaggctgcgttcggtataggaagttcccaacccctcttcctcgttttctgcgcgcgcacttttcaaactattaaatggtgtgtttttttgcaaaaagtttctacacgaaagttgcttaaaaaaatcatatagatctattttttaaaaaaattagttaatacttaattaatcgcgcattaaatgctgctccgttttatatgccaggagtgaggttcccaaccctcactcccgaacacagcctaagagccttattggttgcctatattttctaataagccaaaacggcttattaagaaaactgtttaataaaaccaaaaagatgtggtggtttaggcttcagaatctataggctgtttaaccaagcccttcttgcccgtcaagcttggcgtcttatagaattccctgatatcctctatgcaagagttctgaaggcgaagtatttcccccaaggatccctaattgatactaccttcagttgcaacattttcccgacttggcgtgctattgttcgtgggctggagttattgaaaaaagggatcatatggagagttggtaatgggaagtctatctgcgtgtggagagatccctggattccacgtgatcactcaagaagacctatttctttgagaggtaattgttggctaaaatgggtgtctgatttgatagaccaagatggctcttggaatattacagagatcaatagatgcttccttggtatagacgctgagatcatcccaactatctgtctgtctcctcatttggaagaagattttttggcttggcacccagataagacaggccggttctcagtgcggagtgcctacagccttgcttgtaagctggcaaacactgaagattcgtcaagctcatctgtagtgggtacacacaaagcctgggactcaatctgaaagtgtaagatgccacagaagataaaggtctttgcctgaaaagctgcctcaaactgtttaccaaccattgtcaacaaaaaggtacgaaatttggagtcgacagatacctgaatcatttgtaatcaggagaagggggatactgctcacgccctctgcaggtgcccacacgcgaggaacttgctgtcagccatgttcaatgcaggcaacatctctcttgatgtggaaaaatctcgtttcggtaatgagtggctatttgacatgctggagcaactccctgcccatgagcacgagatgttcttaatgacgctatggcggaattggcatgttcgcaatgaaatcacccatgataaagcagcccctccgctggaagtttcgaaaagatttgttgaaagttacatagcccgcttttccagatcaaggaatcaccgctgaaagatgtggaaaaagggaagtctgtagcgagtttgtctgtcactggcagggtaagagacagagcttctgatgatcatcgagttccgaatcccgtattgcattaggtgaaacctcaggttggttggatgaaactcaatgttgatggatcctttgatgctgccctatgtaagggaggaattggtatggttttacgggatagcagtgggaatacaatcttcgcgtcctgtaaaccgctgaacagatgcacaggtgctctcgaatcagaactgcgtgcctgtgtagaaggtctgaatctagttctccattggaccctgctcccaattctagttgaaacagattgcatgtctgtagtgcaactgttaaatgatggggaaagggatcggtcggaattggctaacattgttcatgaggctaaacgcttgctagccgggactaggagaattctagtcagtaagatccatagaagccagaatagtgttagtcacctgttagctaacagggccaaagttgactctgtctctggggtttggttggaaggaagttgtaattttatcttacgtttagtgcgtgaggacattttaagagagtaatatatttcttctttccccgcaaaaaaaaaaagaaatacaagttaatttatatataaagcttttatatatttgttcgtagcaaggtaaaagccaatgctataaagaaatttacgttgaaaataagttgaaatcaactttaaattcaagttttaaaattcaaactttagcttttgctttgtgttattaggccaaccgatgaggctctaagcagttgtgttgggggaggctaggcctcctcccgccccctggcttcatcccttcgtgattgacaagtgcacaagcaaaacgaaagaaatatagtagtccctctaccccaatttgaccgtccactaagattttgaggttttttctaaatgaccatcatacaataagtgggagtaaatgggaatcgctgaatgcgctgcacgcatgcaaccgtatgcatgtaactagccaagattaatttctgatggtgtaactaggtatgaaaatggttcataaagtttcctatttcctgagaggtttttgaaacggaaagtgtcagtcagaattttatcggaaatttttagaaatggaaatgaattcagattttttttttcaaaatcggaaatgaatacggtgaggctactatcggtcgaaaaccggaatcggtcagaaactttccggagataaatttgaaaacttttcgaaaacagaaactttttatatatagcttattagcttcagccttctctactctatatatgtttagatttctacataatattgagatggttagttgaatgtagataattttttagtacggtgctttagatacgtgtccaccccctacagtagcaggctcaccatgagcttctcactaggctcccgcgccgctcccttcctgtctcccaagggtgtgacctgaggaattcccgcgctcacaccgtgatctccgccggagattcgccggcgacagggagcgccgccgcgtcgccctagaatcgtcagtccatcgcctgacatactcttcagtattcctattccttttcatatgacttaaaaatcgatcttatgtttactacaccatctaataacaataaaaatactaattaaaaaagcgcaaggagtatcatttaagagcgggttgtttcatgtgtggttgccaccacttccacgtcgctaacagacttattaattgtaaaagtaaggtactctgttcatcgtactccgtacagagtagcatcaatgatagaaacttcaccttttttttaatgtttgataaaatgggatgcgtcacctacggatggaccaacggattgttggtcgttggtatagcaatatcaatattattatggctcttagttgactcaactgacaagtctacgcctgctcttactatttaagaagcttccaatgcgctaacgcagcccagcgatctgcgcgtcacaactcacaaagccggggtagcttgaggtagtggtgccctggattctaaggtataccttgctatacactgatccttatgtaagttcgtctgtaatatatacacgtaactggtaaaatttgtccgtgcaattgcactagctagtttctaatattatttcatttcaagcaaattagttacttgctccggcctaaatatagcggcctaatttgatatacaaaggcagcaatattttaaaacgaaaaaaagtgcgtgatacatatataatataatttcttgatattgtttgttttttcacgtgccctactgcacatttatacctgcgaatatgccccctttagcacattctcaaaagttggaagccaacaggaaatctttggtgtcgctaaaattcttaaattctaggtgtgtttagttcgcaaaaagaatttttttagttgtcacatcggatgtttgactggatgttggaaggagttttcggacacgaatgaaaaaactaatttcataactcgcctgaaaaccgcgagacaaatcttttgagcctaattaagccgacattagcacatgtgggtcactgtggtacttatggctaatcatggattaattaggctcaaaagattcgtctcgtgatttccatgcaaagtgtgtgattagtttttatttttatctatatttaatgctccatacatatatccaaagattcgaggtgacgtttttgggaaaaaaaaattgaaaactaaaccatgcctctttaaaaaagttgtgtcaaaacctgcgcaattttagatactagtatttaactgtgattggtggcgtccatgcctcctgcaatatacttgccatgaatgtccacgaggatattttatattactccctccgatttcatattaattgacgttttagataaggttgaagtcaaactttataactttgaccatcaataattttaaaaatatttagtttaaaggaactagaacaatatatataaatttgtctttcaaaacaccataataaaagtaaacatatatttatttattatatatattataatagaaaaataaaggtcaaagatatattttgtagaccgtgttcttgtccaaaacgttaattaaaatgaaaccggagggagtatataaaaaagaatagaatccattccagagttttagcactccagaaattttggaagttcgattgtgaaatgccaaaactgtcatcaatttaaagctgccagaaaaagggtaggtgatatcaatatattgtcgtgccaaaaatatataaaaatatatggttgccctgattcctgtgtgaagcaacattttcactgcactgctccaaacacgccgaaggaggaatcaattcaccatgatccactctagctaggacccgtaaaaaatggacagtttggtcagcaggctactccctccatcctagtttaatcatcccctaactaaaggcgctaagaacaataacagcaaaatattcatcattcttaaaattaatcctctcatggattaagtgttccatcgcttcgtgtcttatggattgctaatggtttaaatataatataaattaatcttgtttggttgcaagtaacacattccaatgatacacatttagtactcttaatttgcacaaataaacgaagatgatgattattttgaaaaggccttaaaaatattaggggatgattaaaatgggatgaaggcagtagtatttcagagcttgcttctccatgtgaacattttgtcaagaatgagaatcatcggtaattcaattcccgtaagggctaatacgtgaaacggattccaacatatattagagttagggctccagggtgagctaggtatggagagggccagaggggacgctagggagagaaaaaaagagagtcaggagggcttttgtgctcagatggttcgggcttctaaattactgttttatattatgataactagctgggtggtccacgcaattgcgcggctagccaaaaaaatcatttttttaagtatgattttacttaaaatttattaaatagctatctcattgttaagactttgaaagaccaaaccttatcatcctcgtgtttctaattatatagttttaaaaatcacaccaattgctaccccttatgtcatcttctttatttgcttgctcgatctatcactatttctattcattcatcttggaacatttaaaaattagattttatagtttttagagtttattgtcacgttgggtttcgtttttataatttctagatgtcccgtcaaacgttgccattatactcctatacagcctgtccactatctcttctcttttattgtcattgagattttaaaaatcgaactgtgacgccccacacttttatctttagtgataaaagtgtgagaacatagattattatttaacaaccattattttgccaaataataatccaccatcagagatcgcaacagagaaatagttagaactacctttaattcatccctaggagcattaaggtcatctctactccatctagagtacactcataacattgaatagagtttgtagcaactccccgtagactcccatccaggagatagtcgtgaatcacgatttaatttagcactgcgcaggcttgtatcactgtacccatagctactcttaacatgtttgactgtcgcacttcactagatgcggcaccatgctaagagtacagaacttttcccctacttcaacttactacactccacgtttgtgttgagcctatcagccctccacaccaccgcgctactatatgcgcctggaatgcacttcatcggcattcatggggtttatatcatctcccatcctactactacgtacccatgtggagtataataaacttgataaggtaccaggtccagcccgtcttaagacgaatctatggtcgacacggtatatacggttctttgatacgagtgagggggtgattagtccttatatttatacaccgtatgtagggagagccctgacctgccatcatcatcaatcatctcatccctgagctccccctacccaccatactagtatcctgatgatctccatcatcatcggcttgtcaatcatatcatcatcgttcatttcattatattctagaaaatactttttgatgcaatactaggagaaatatttttatgaaatagatttttaagttgaaatagaattatcatctaccaacatgatcaaaagagagacttgcctgagtttctgtagccggtactatcaaatgacccaatttctgactctagccttttccctgcattttattgtatacattgattttcaattaactttcaaacttgaagaatataattggcttatctatctatattacagtgcacctaaaattctagcctgatgtacaatttctagcattccattaatttgtattgagtatatatattagttacttgatttaaactagacttgatttacagatttattgacagagttttgctaagcttaatgttagtgtagacaactagtgtgcactaagcaatttaacccttattcctgctctcctcacttatgtctctctctctctctctctctctctctcgcacatacaacaagctgcatctagttactcatccccttcttccattttcttggctgttgctgctgctaatggctttcttcttccccaactctgctcctcccttccatctacagcaccacccatggcgctgccaccccggcgcccacggaggtcgacgccagccaccaccactacacaccccaagctagctcactgcaaatccccttttctccccctcccgatttctcctcttcctcccatggtccaagccctaccaacagcgtctgctttctctctctgtgtgtgtccctctctctctctcatgctaccaaatggatgtgatgccactaatagtgatgtgaaagtgcaggaaaatagtgcctcgtgccatggctgctctatgaggtggcaagaatggcaagatttgaggggctcacctttgtctaagggacaagttcctccatggttgtgctcccgtgttcgtcctcgccaatgtgttggtctcttctcctccttgatagatcatctccttgtctagccaatttttcttctccccttcctagccgacatagagatggtatgagtatttggctgagaactaatttggctactaactattgggattgagggattggttcttgaaatggattgggcagaatcttgcattccgctgatttgtggattttgggactttggctattccctcctcgctccctattgctctcctcctcccctgatctgctcactcctcaccaagtgcttggggctcatatgcatgcatcagtgagcaaatgggcatggctgtagccatgctttgactgcttgactgagaggtgatgaggttgtgctactacctttgtggccttgtgtgagtcctcctatgtgcagctatgtgattggtggaaaattagtactgctggtgaattgaggtccctttggtgaggttacttctttatatgagatgtgtgacttcttagtgttaattagccggagccggatgacgaacccaacttaagggaggggtgccagacggtattagccgatctaggtatctcggtgaatggttgaatatacaccacttcgtgtatgggtctgacggcaatatttatttacatattaccttttgtgcataaaagggtcaagctatgcatgtcctgtgcaaccgtatattcaaatatatgatgtattgtattattagtgtaagtgtatgtatatgctgactgtttacagtggcgtttgtttgtactatatttccaattatcactattatattgtggttgtatattggacattgtttgtttgtttaacttcgacgaatgtgaatttcataaattttgagtggcttattcttatttccaacaattttgctagttaactaattaattagtgatatatgccacttaatttttaatttttaaaatagcttaaatttccgggtaacataattatagtttgggtttatttttactttccaaaagtcccgccaaaccatcagcggttttgccattgtactcctctacggctcgctcgctgcctcccttctttattgccttctttattgtcattgagatttaaaatagaacatgattatcattggttttttttactttttagaatttctaaatctttaaaaattggacttgtagttttattttttataatttttagaagtctcatcaaacgatgccactatgcccctctgcagcccgtccgccgcctactctttattgtcattgtgattctaaaaatcgaacataactatcattacaattcattttttattttctagaagtcccgtcaaccgtcggaggctctgcaactatactcttatacaccccgctcgttgcttctcctttttattgtcattgagattttaaaaatcgaaaatgattatcaatgtggttttctttctttatactttctagaagtcccggcaaccgctttacttgtttacttcacggcatacctgatgtccctccttttaatcgtcattaggattctatttggtgttttattaataatttttatatgccgtattaaccaccaccaactctactactttatagccatgttacttaatttatttcgtcatgtgttttagatggtcttttctttcaatagtctttatttttatcacaaattttagttatttataaattttattcctaatataaatcttttttttctaatttcagaatttattttttctaaaaaattagttaatattgtattgtgttcttttaatgtttttattttttattttgaattttatttgtttcaaaattgtattcctacttgaactctgttttaaattttctaattttggatattattatatttttattcgaaattttaattaatcttgtattgggttcttatatggatttttctttcaatattgcttctttttaattacgaatttcagctaactacttgaactcttctttattttcttttgctaatttcatatttatttttatttttattccgaattttaattaatctcgtattgggttattagatggactcttcttttaatattccttatttttaattccgaatttcagctatttttaaattgtattcctacttggactctcgtttccttttctaatttggattttattttatttttatttcaaattttgattaatctcgtattgggttcttatatggaaacttcttccaatattgcttatttttaattccgaatttcagctatttttaaattgtatttctacttagactctcctttccttttctaatttgtgattttattttacttttatttataattttgattaatctcgtattgagtttttatatggaaacttctttcaatattgcttatttttaattccgaaattcagttatttttagattgtatttctacctggactctccttttcttttttttttctccgattaatgtgggaatttctaacccccacagcgaacgtggtgcctcctttcaaagctattttaataatataatagatagatagatagattaccgtatttctaaatacaccaatatttattatctatttctttatttgacccataatttagaagcccatcaactcctcaaccaaatatatgagtgcaaagttaaaagggagacaatttgtaatttgcatagtgtatccttgaattaattttcttatattatatggttatgcgaaataaaatgtgtgattttagatatttgttattgatttttgtcgataccaatgcattttcgttcatattgttctgtttttggtttccgatattattatactgtttttattttcgaatttaccgttttcgtttccaagaaaacaattgggatgttttcggacctttttcatcccaggtaagtggtcaaggcgcgcgattgtacgtccattacacgcactcggtaattccagatgcaaaattgatttaccgctagtttccaatttccaacgatgcaggtaagatccacagcaacgccatgaacacgcaggtcgacgtcgagaatgtggacgtggtcatcaagcctagaatggtacctgcccatcagggttggcagactagcctctgcgactgcttcggagacggctgcgaatcatgtatgcaaagctacgactgactggatttttctggtttggtggtacaatgcaatgttttttccgtttcatggcttaatttctcgacctgttggcagtttgtttgagtgcttggttcccttggttgtcgatttcctgcatcggtgaaatcgtcgatcaaggcttcacaggtaggggtcatctcctctcccatagccccatccaaagtgctttgctttggaccggttaccgataaaacagaagagcgtttggattcagatataaaattaaagaaaccatcaaactgaatttagatcgaattaatatccgctgatcaggtggttaattaattatcggtattcagtttcaaaattttgcattttcacgcttattattatatccggttacagatatgtatgtgaagattttttacatttgcttaccgatatgcatgttttctctcttgtcaatttccttttggtctcctcaccaattagagtggtgctgtatctgcttcatctacctcattgccgcttatttcggcgtgtggtgggcgtacgcggggtggtaccgcggaaagctcagggcgcagtatggcttgccggaatcgcccctgccggactgcctcacccatgtcttctgccactggtgcgcgctggctcaggagcacagggagctcgccgcccgtggatacaacgtgctgaatggaacttactccctccgtttcaaaatatttgacaccgttaactttttagcacatgtttaaccgttcgtcttatttaaaaaagtttgtgaaatatgtaaaactatatgtgtacatgaaagtatatttaacaatgaatcaaatgatatgaaaagaataaataattacttaaattttttgaataagctaaatgatcaaacacatactaaaaagttancggtgtcaaatatttaaaagggagtagtatactccctgctatatatgcatgtgccgctttagacgacactgccaaggcgatgcaaaccccaagatctaacggcgttttctttggcgattggcatatgcaggttgggacggccggccgcaggtggctgcagtaccgcctccgtcgcgtagtgcgcccgcagtccaggctccgatgaggcgatgaaccaggagcaaataaatagctcgctccgtccaccgaacgaagccataagataagtggcccagtgcgagctgtctatctaccaaaattataacaaaattataatagaaaaaatgatacctcgtgatatttttataaagactgtaaaattacttatctatatatctatatccaacagctgtgtaaagaagccaggcatctgaataatatttgacatcgccctagtttgataaactaggaagagaagaaaagcccgtccacataagcaggcatatgtttctcaaactttttattatatatcttaaatatgtgagatgtatatctatgtgtcttctttaagaataatattattctactttaaatttgttgtatttttttttctcactataagtttataagttttagattgctctaaacgttggttatggttttattgcaagtatccacgcagtggtggatcgaagaattttcttgaaactccgcaaagctaaaaatagataacaaatgtacacaatttcatactacttcaaaaaacatttactatgaacgtgattgtgattttttaagcatttgctttgctggtttgcttaagtacggtaattaagtacttcctactgttgtatgtggctggatggtaaataatcacataaatcaagtcctaatctactgctgtgtgcgttgaagcccgggcagctgcccatgtggctccgccattgtatccatggaacaaattctaaactaaaattgttaaaactacagaatcccaagactatggaatcttgaatttatgtaaaaatatcgtgttgcaataattctgttagttattgtgaaattatgaaactatagatgttcttttgaattttttagcatgcttctagaattcaagcttctaattccgcttcagagtgcctcgccagcatattctacgacagaaagtttgacgggtgtcaattggaaattccacattagctagggaccggattttccagccggcagcacggagaaggcactgatgatcctaggtcattggtgcaactataacctttgaggtgcacacgatgcaaaaaaaaaaaaaaaaattgaggcacacacgacgcaaaaaaaaaaaagagaagaggctcgattcggtcgaatccgatgctttgagtcactccccgttgccccagattacaaatcgaaaaaaaaaacaaacttctgtacatgctaaactttctgtacaagcttaatcacatttttttaaaaagaaaaataaactgttgcacatgctaaatcacaaattcaaccaaaaacagaacctctcgtcatcaaacggataggtgacgtgacatggaaagggaaggggagcatggcaaggtacccagatctagcggtcattgagctcgagacagcgccctcacgtcaccccaacgtaggggaagggggtgccctacatgttgtacatgctgtacatggcaaggtacccggatcttattgatggcccccgcagcagacccgtaccagtggcaatatccgcttccccttccccatccccttccccttctctacctcctccctacccctcaccgcctccggcgaacaccgcgccacggtgccagtggcctgcacggagggtaagtgcgcttggggtgggggggggg

SEQ ID NO: 80506 - DNA, 9321 bp, Oryza sativa
agatctcctcctattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccacaagaagagtaggtagaagtagtgcatgtggtatccccttgagatataaaaggaggaccttgcccacctaaaaaggggggaggagatcgagagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcctccggccgaaccggcaaaggggggcctgcgcggtctcccggtgaggagccccacgctccgtcagtcgccgctctgaaaaatattttttttgtcaatctgatcgcatggggagtctaagccgaccattgtattctccagtgatttccagaaaataatagattttagagtttagatccctctcaccttttttttttggagttacattcattatatttctgtgataaaattaacagtaaatttgtaattttgggataaatttgatgttacatctatatttttgtgatacggcccatcaaattttgtagttttgtgaaatttactctacgttgaaattgaaaattagcacatataaagctatacacaaaatccaactcacatacctttctgttattttctgtacaaaataagtatctactccttttgaaatcttaagtgtagtttctactaatttaataattccattttttttcaaaacataattgttaacggatgtggattcttaattctaacatggactttatctagatccaaaaacatgcatggtgctgttgtatcctttcttttccttctataatgaaattggcagagctcctaccctttctcctaaaaaaaaaatctaacatggactttgaattaataaatagaaagtcataatagatttggactaaaaactaataaatatgaggaaaactgtatttggtgtgctctttaatttcgacttttcttgataagataattggtatatttcaaataattgattgtttggttggcggccaaagtttgtcatgctagactttgagagtatcacagttaattaagctaagtcgtactcttattttctagcgaaagtttatcacggttaaggctaaaaaatatggcttgcttcacttatggctataatggagttgtggtaaagttagcctccagccaagtaaacccttttttatatcctccgtacaaatttgtacttggctttagaccttttttttcaaaaaaagtttaagatcaacagttaagaactactacagtattaagttgtatgattttatatttggaaccttactaatttaatcccaaactttgtaatacttcgcagtaactagccatttgctagtggcatatactcttcatctaatctaagcctttgtaatttgatcccgcctaaatggatgactagatttatttatttactatttatttgattaacatgggtttttttacataatgacaatcagtatagctgtacagatatcaagatatataagtaagaacagttcgaagtttccctgcatacgaaggatcaaattgacaaaatgacttgaattagcatgagtgtccatgtcctactctccaagtctccattgcactcgcagaagctaatattttagtattatgctgacttttgcaatagcacgcaaaaaacattgctatattttatcatgagatattatgtaatcaccgaatatgggttaagatgcgacgccatggaagctccactgtatgtcacgatcatcgtcagtttgtcactgattgtgctggatcagcagcgccaatggatgaggagtccataatggattagcttttggcgccccctctttgtcgcgattgtttctcctcttttctgatttcccccccgttgaacgtggatcacgcaattgatggccgatcttctgagctactggcacgcgattctcttgtctttcccgttcccataattttcccacgacatgagaaaaataagttattgtctaaaaaaaatgagaaaaatatgttctctattgacgaagctaagcctggcagcggataaagcagctcacacggatctaggggatatcagccgctcgcgtaaagacggccggccggtggtgtcccgttgcgtgccggtcgccgcatgatgagtcagcttcagatagatgatcctctctctcctcgccgtctcctcctgtccggtcgtttttctccgcttcgatacgcgggccgggcccccgcttttcgcatgcatctttcggccgcgctcgcgagcgcacagcccaaatattcccgtggcccatctcctcctccgtctcggcggtcttgcgcgaaaaccccgtcgtcacctacaacgaactaaccgcgacttccgcacggaaatcaccgagagaacaaagagccgcgcgcacgcgacgggtttgggtcgaaacggacgtcgttttcgcaaaagtacggggcttttccggcaccaccaatcgggcggggcggtgtgttacaggggaattactcgggtcaacacgatgttgggtacaagcaggaaagtttgggttggatagagtggtaactaaactgccatgtcagggacagatcgaccagtgagtggttgaattaccatgggctctctgatgatccgcgctaagcaacaacagggggattcccgtcactttctttcgttgttgtttttctcgataggctaattaacaagaatagattaggcgaaagaaaaagcgcgagtgggggcgcaaaagcgagccggcgaggataaggcccctccacaggctccccaaccgcatttgtttagtccaatccatcgtgtttccacgtggcgacccaacccctcggagtagacctgcgttccaaacagtttacaggtcgtctgctcgcggagtcgcggctcgcccctccccccccccccccccccctcttgatttatatatacccccacccgcccgtggctccgtcgctgctgccgcgcgcctccgctccattcctgattcctcctcccaactcttgcttccgttttccgtgcccctcctgccgacaaacccacacctgaatagctcatcctcacctgatcagctgaacctgtttgagagaaagaagttagttggccatctcgccctcgctagaaaaaggaaaaaaaagaaggaaaggagaaggaggagagagcttgctttgctgctgggttgttgctaatggtgttctactacaaggcgaggccggacgccggcgactacaccatctacatgggcgccgacaagaacgagaacgaggagctcatcaagtacggcctccccgaggacgtctggtacgtacgtacgtgcattctccgcacacgtactgtagtagctcgtcgtcgatcctcgcgtagcggcattgcacatttgcgtttgcgcttcgcgcgcgtacacacgtacgatcggctagtcgcacgcgtaggctcgcgatcggcagctacatgagaggtggagaggagagctcgccggcggcaggtcggcagctgcgaggaggaggaggattgaggctttgacgaggccatgacgaggcgtggtggggacatcccaacgcccccaacgaccaaactctactataaaagatgtctaccagatcgaccccgtctaggaggagtacgtaactgctcatgctcagcaacaagttgcaactctgtctgtagccatcgcctgccatccgcactagtactactacagtactactactgtgaccactaccacagccttttgtttgcttcctccatctaggggacctcacctcgatctccttgggtttccaatgcttaaaagtacttttctgcttaattcgtcaaattacgcctcatctgaaacatgtagagatatttattccgatccatgttaagatgaactatatagtgctgtaggaattttcttagaagtaagaacaaagatatatataaacgtacgactggttgttttgatggaaaggtcggtttaaagtggattcttcccttctaatttcgacaaggaaaattgcttttgtcccgtcaggttccacgtggacaaggtatcctcggcgcacgtctatttgaggctcaagaaaggcgagtcgatagatagcatctgcgacggtctgctggaggactgtgcacagcttgtaaaggctcattccattcaaggtacgcactcatttcagacaacatttgagtgtagaggtagcgcatagcttaattagctttcttttccaccatctgctttgtgtgcttgtggctagattcttttggtttctaacgatcaactagtaaattttcactcgtgcaaaaaagtagggtagatacagtttaccacaaaagattctgcagttacgaagaatttatcatggatagatgcaggttctcaaaagaaaaggaaacgtttacttgcaaataatgataatcatttgcacctccaattatgttatccacggatagaggaaatagagcatggtgtgacctgtcggatattcgtgtggcctacaattctacaaagctgcagcatcacattatattgctggttacagacaggaatcttaattttgtttttgcttttccaccccggcctttttcttttcagcaacttttagcttcttgtattattggcactagctacagtgggccccttggatcaattatccgcttgggttgatttggcctatgtgaggggattgtgtgataattagaacgtgacgagtatgtgtcttggatcactggatgatatttgcagcttgcatgtgcttgtcgtgcaggaaacaagatgaacaatgttgaggtggtctacacgccctggtccaatctcaagaagtccccatccatggatgtcggtcaagttggcttccataataccaggatggtaagctgctagggtggtctaacatcctcttctttgtacataaaaaatttacagcagcatatatatgctcataacaatggcaggtaattgatttctatgagggggttacaaggttagaaactattggtaaaaggaaggtccatgttgcagagagacacacacaaataccccctccaatcaaacttgctcgagtcagagccatgaattatctacttatggataagttaaatatcttgagaagtaaacataactgattgtttaaaacaatttatccaagcaatacaattgaagaaaattttacgagaaaatgtatttgtagaggcatatggagcaaataacatgagcaagttagttaggtagatgaaaagaatgcggcacccgtttcctacattttagaacagcaattttgtgacaaggtagttattttcacccaacatacaagtgcattatatgcgagacatactgtgttctttccggggaaaaaaatattgtggcgcattttttataatttaaataaatccaggctatatatatgtatctggctaggctcgctatctactactccctccgtcccaaaataagtacagttttagcactgttcatgtccaatgtttgaccgttcgtcttatttgaaatttttttatgattactacttttattattattagatgataaaacatgaatagtactttatgtgtgactaatttttttaatatttttcataaatttttcaaataagacgaatgatcaaaatgatgaacacggatatatatggctgcacttattttgggacggaggtagtattattatcttttaaaaaaaaactagtactactacattattaagagcaccaacaagccatcatgacatcaatggtaggggtctatcctccaaaaatatatagttatgcaataatttgatttcaccaacatgttaatatgttgcaacatattatgactagtgccactgtttcatcaaacacaattcaacaaaaatatcgcttaaaatgccatatacacgaagtactcatggtaccgaaaatattatttgtctggaaagggaacaaaatgtaaacagcagagtaatgtacaggctgtctagatatatattttttattaggaccaaattgcttaaacctgcattattgcgttcaacttgcttttgcatcatattttgatggagatacattttggaactaacagttgttgatatcttttggagttggcgtacattatcctgcccatatattatagaaaacgggttttatttttctgaaaaagaaaagaaaaagaagctagcgcctcttgtttccgaagggtcactggaaaaggccgccagctgattcgtcgaggggttggggtgtcaattccgcagatgcaattttgggagcatttgcataatcgatctgcacgggaacactgacagacagagagtgaccagccttgcaacttgcaaatccatctcttgttagccagccaccgcaagttgtagctgccgccgatcgatcagatgccagtgatctcctgtcatgctttcctttggcatctaatcgagatccactcatccaccaaaccagctgcatctcatcagcaataataggatgtgtcacgacgctggctgatcactgatgcatggcaggttcgcgtggtgatcgtcgagaagcgcgtcaatgagatcatcaacaggttgaacaagaccagggtagagcgccggcctgatctgaaaggtacacgcacgcacggacgacacgcatcgatcgatcgattgatcagatattcaggcattacacatacaattaaaatcgactaatccctttggcctttgtacgccgcagccgagaaggacgcgtcgaacgcggcggagaaggcggagaggaagatgcagctgaaggagaagaggcggcgggaggagatggagaggctggagaaggagaggcgggcggagatacggagctacaagggcctcatggtcgccgagaagatgacctccaaccgccagatcgcctccgccggcaactccatgcaggagatggaggacgacttcgtctgatccatccatccatccgtccgaagccagcaaccgctcccgggcatgcgtgcgtgcgtgcgtgcgtgcgtaacgtacgtgtgcggccacgtgtttctctgtacatcatccatccatataagcgtgcgtgatcgtctcaccggtcagtctccctggaacggtttctgcagttctgctatagtagtggtagtagcacatctctgtacatacacatggtccctagcaatgggcacagatgagaaagaaggcaacgcgattttcggtatttcgatatttctacatgtcgtagtagtatttggcagctgagtgggccgcgtgacggcgccgatgcaaactctagttgatctgacagtattacgtgatcagttaccgactccaatgaacgtcaagtggtcttcaacatctttcggatcactcgtaggtattgctactcagcagtatttttctccttcgaccaacaggaaccaactttgtgtctacgttgttcactgctgatacgtgaacacaagatgttcaacagtcattttattcagctattacagggctcactgagacaaactaaattgaatcagaagaggagataacattaacacttaattgcaattctgactttctaagccaacttcgccagttatcacgagcgaagaacgggtaattttatcgggaaaaacaggggagtaccaattaccaagtgtacaacagaggaaaacggacgagaaggctaacgggcgaccgctcgctaccagcgatctttttttttttctttttttttcttttcctcttttaataagtttatgcacttaaagtttacacatctaaagtttgtaaagcgaatgtttataagtcaaaagtttatatactcaattcaaattcaaattcgaatttaaatactttatatttttctcttttagtaagtttatacacctaaagtttacacatctaaagtttatccacctaaagtttgtagagcgaatgtttataagtcaaaagtttatatatccgattcaaattcaaattcggattcaaacattatatgtatgtaatatttctatacacaaagtttatgctgcaaagtttacggtataaagtctatgcacatgaatgaatattagattttttttcctaattttcttttactaattttattttgaaatttatgatgtaatagaaaagttaaaaagagagatgaaagaggagtattaggagggagggacgggtgatcgctaggaggagagggaagcaatcacccgcccactagcaatacccggaaaacggacgtgtatgaatgaagaaaaaagcaaggctacactgccataggcccacaataattttggtcctttaggcccatgctattagcctgataatctctttagaataggatgacagcctgcttcatcaagctgggccaaaaatctgaacagcaggactgcgataataacatgctaaccatatgggcttgtctagatgatgaatacaggcatacagcagtacagcctccacgttgtcaaggaaaacttcgcaagaacatgtcgcgaaaactgaacggaatttgttcatggagacgccggtcgccaggacgggcactgccacggtgaacgcagttctgagcgccattactggtcaccattgatgcatccaagtgggtaatcaagagagatagataaagttagtcgtggctttctatgggcaggcaaggtgcatgctcatgacggttgctgctgagtgccgagtcgcctgggctagggtgtgcgctccgacagtatggcgacctgggaataccaaacctcggactaatgggcatcgcactccgttcgcgttgggcctggctgtggcgggtatcttcggataagtcctggcaaggattaagcgtaccttgttctcttaaccattcacagtgcaagcccgggttagaaaggatcacgaggtgacacataggatgaagccctttaaaaacattttctccacggatcaagttaccttacagtgagacccacaaatattttacagcatttcattctcttgcatcaaatatctcaccaaatgatgaggacgtaactagctcggtgtcggtgacatgggatcaggagtatcatgactagaggtttgaggcagacacaatcgcacacgtggcctggtacccccgagggacgtcgggcccgagggtgatgcgttcgccctccttttagtccccccgaggggg

SEQ ID NO: 80507 - DNA, 9410 bp, Oryza sativa
gcgcgccgccttcgctcttccaaatagtcgaggtcatctctgcgaagctgatcttgatcagcctcgcaatacatggtgacccgaggggacctcagggtgagctcagatgggagaaccgcctccgcgccgtagatgaggaagaaaggcgtttccccagttgctcggcttggcgtggttcggtttgcccagagcaccactggcaactcctcgatccacgagtcgccgtgcttcttgaggatgttgaaggtcttggttttgaggcccttaaggatttccgcgttggcgcgctccacttggccgttgcttctgggatgggcgggtgaggcgaagcagagcttgatgcccatgtcttcgcagtagccaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgatagcgacatacagatactcgaacccgcccggggcccgcctgaacggacccaggatatcgagcccccagacagcaaacggccatgaaagaggtatgatctgcagggcctgagccggctggtgggtttgcctggcgtggaactggcacgccctgcaccgccggaccaagtcgaccgcatcgttgagagccgttggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgataaagggtcccttccaccagcacgtagcgcttggagatgcgctggacgcgttcactcccttcgcggtcctcgggtagagtcttatctgtgaggtacgcctggatctcaacgatccaagcgatcaatctaagagagctgggagcgctctcctcgggtcccgaggcctggactccgacgggcctcgggggccgttcaggcgcgtccgtctcccctagggggtcggtgtcacgccctgaagtttccccctctccttgctttaaaaattggctaaataaatcgtccgaagaaattatcttaattaacctagagctaattccctaattaataaatgcaattaataattggaattggcattgtgggatttttcttgggttccacatgtcacaatatattaacaggatttttagtggaattttcagagccttggaaataatttttaccaattaaaaatcaccaaagtgcaatttttaatcccaggaaaaatcctttcttccttttctttttcttttccttctttctctgttgggccgtcggcccactccctcccgcgcccggcctcccctttgttgggccggcccaagccgcccctccctcctctctcgggacgccgacaggtgggccccacctgtcggtcgtctccttcctccggcaaccgctgctgccgtcgaaaccgccctcgtcgccgctgccgtttcccgccgttctccgcgccccactccgcccgcacctcgcgcccacgtcgccgccctctcccccgcatctcccggcccgcatgcgcgcccgcaaatgggcgggaatcgatttgaatccacctctctctctctctcctccccacgtcgccggccaaatcgggagggttcccggccacgtcctcccctccctcgcccataaaagcactcccccgagtcccctccctcgtttcccccatttgccgtcctctcccacgccccctaccgcgcccgcgccgtcacacccgagctccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcgcttctcccctcgcgagccggtgagttcttccctcccctccatctccggccggcaattcaagccgccgtggtcgtcgtctcctctcctaacgcctctccatcttctcctagggtgtcgccgccgctgtccgtgcctccgcgtcgccggtcatcgccgccgcctttcatcctccgctttggtcgccgtgctcaccggtgacgctcccctccgctcccctttttccctctctcccgtgtgcgccgccgtcctatcgcgcgtgcgctgtcgccttcagccgctgccgccgcttttcgccccgtccgtgtcgcttcctgcgccgccgattgccgtcgccggcgaccgtgcgcgtcgccgccggttgccatggccggccggccggttttgaagccgagccgagccgtgcctagccgccgccgtgccgtccgatcggcctcccggccgatccggaccgtcggtcccgtggaccggcggtggaccccccccgcgtggtcccggtccacggtggaccggccaccttgtgccgctgacccatggggcccgcttgccggcgcccccttcctctctcttgaaccgctgacatgcgggccccgcctgtcggcgccgcccccccttccgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggcttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcatccttttacaatgtcatgtgggataggtcctaatactcagccatttattgtttaccttatgccattgataacttgggtatcaaaatgactagatgttggtttaggaaatacttagccatgcttagttcaactagcacacacatggggatcacattattacatagactttgactatgagcatagctttggattggtgccaccgcaatggtgtgagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaagtggttggttgggcctgttgcaacgtggtgtagcgttggacagtgtttggttaatgttgattaattactacaactgttttactgccttcaactaccgtttttaaatgctagctttatgcaaaagaacctctagcttcctttggttatatcttgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatatgcatatgcccttttgcacctggaattgtttcgggaaaatttggagttttgcctttttggtttgcgggaaaaatcttggtcgttctttcggatcggattttttttttaaaaaaaagaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacccgactcgaacaacgccaatggcaggcgaagagccgatcaatggagcacgtgccaacggtgcatctgacaacagtccgtccccaccgcccgagaacccaacaattgctcaggtgttggacaatcagactcagatgatgacaatgatgatgcaacagatgcagcaacagtaccatcaggtgttgcagcaggtgcagcagcaagcacagctgcagcagcagaacctgcagtttggtctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccaactggggcagaagttacttggacagagttttgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcggttcacgatgggacatcacggtggaccttccaccatgattatccggcagcaccgtccctaccacccgggtagcttcaacaagaaccaccatagtggcagccacaacaacagtgagcagcacagtctcaaccctactccgagttcactaaagattccagctcaatcagttcagccagctctgccagaacagcccaagaggttggtagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggtcgatttttccagccaacctcattcttctcgaatccaaggacctagatgtcatacttggaatggattggttgacaaggcacagaggagtgattgattgcgccagccgcaccatcaagttgaccaatgcaaaaggagaggtggtaaccttccagtccccagtgccgcagaagccaaggatcagtttaaaccaggctgctggtgaagaacaagaggtagcagtggagaaaaccactaagaagctggaggatattcccatagtcagagagtatccagaggtttttccggacgatctgaccacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgtgttgactaccgcgcactcaatgaggtcaccatcaagaacaagtatcctttgccaaggattgatgatctgttcgatcagctgaaaggagctactgtgttctctaagatagaccttcggtcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggtttttatcgatgacatacttatctactccaagtccgaggaagaacatgagcagcatcttcggctggtacttgaaaagttaaaagagcaccaactatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatctttactcaacctgatttgaatcttagacagcgaagatggttggagctgatcaaggattatgatatgggaatacattatcatcccggcaaggctaatgtggttgcagatgccttgagcaggaagagtcactgcaacgtcgcatgggtagaggaactatgctgtgaggttcaacgtgatttgggacatttgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctaatactaaccgaggctcatcaaactcaatattccattcatcccggcagtaccaaaatgtaccaagacctcaaagaaaagttctggtgggtcagcatgagaagggaaatagctgaattcgtagcactctgcgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaaatggctcacttcattccggtgcacactacctactcagggaagaaattagcagaactctatctggcaagaatcatgtgtttacatggtgtacctaagaagatcgtgtctgatcgaggaagtcaattcacttcaaagttctggcagaaattgcaagaagaattgggaacccgtctaaacttcagcactgcttaccatccacaaacagatggccagaccgagcgagtcaatcaaatactagaggatatgttgagagcctgtgcgcttgactttggtggagcatgggacaaaagcttaccgtatgctgagttctcgtacaacaacagttaccaagctagtctgcagatggcaccgtttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcaatctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgaacttccctccaacatgcttggcatccacaatgtgttccacgtctctcagttgaaaaaatgtttgagagttcctgaggaacaggcaagtccggatcacatcgaaattcaggaagacttgacg

SEQ ID NO: 80508 - DNA, 11281 bp, Oryza sativa
tcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgtcgtcgagctcgtactccaccgccacctccacgccaaagtcctaggcgggagaaggcacttgagagggccgaaggatccgcgacttcgacatccacaggaggtggagaagggcggcgagatgaggagcgtcgcctcctcgtctacggcaacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcagtcctccgccaccaaggcctctggtgctgctgccaccggctccgcatcgtcaagacggagggcgcggcgagcggcagccgctgttcgccattcggccgccactccttcgtcaatggctccgacccgggaagatctgcgtggggaaccggatgcccgcatcagtatcgagcgtcggcgtaatggccgacgtgctccccacgcaaaggagggcgcctcctcgtccggagtgtcgcctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttctcatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaaggacgaggccggcgctcccaacagggaacgcccaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaggtttccaagagcctggggccaccattgctaccgtcgatgggggagcgtgtgctcacgtttctcgccggagcttcaaggccatgaagcgagagcttctggccacggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgaagccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgtcgggccccggtggccccatctctgtccatggcgacctcaaagtcgcgctcgcttgtctggagcagcgcacggaccacctcgccgctgcatccgagcccgagggtggcgacgagaggcttggcgcctccgcccccgccaccccgaggcagcggatgatcacaggcaacgaggtcccggtcaaggaggttgccctgggcgacggcccgtccaagaccacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctatatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagataaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctcatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccaccgcctcctggtgttaggcgactcccagctggtcgttaaccaagtctgtaaggagtaccggtgctctgacccgcagatggacgcctacgtgcaccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagacgggaccctctatcggcgcgcggctaatggaatcctcctgaagtgcattcctcgggaacaaggtgttgtgcttcttgccgatatccatgaaggcgaatgcggagcccactccgcctcgcgcaccttggttggtaaagcttttcgccagggtttctattggccgacagctcttaatgacgcggtcgacctggtccggcgatgtagagcgtgtcaattccacgccaagcaaatctatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattctttaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatagtcaagaagtatggcgattcatggatcgaggagttgccagcggtgctctgggcaaaccgaactacaccaagccgagcaaccggggaaatgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccggggcctacaacatatgcatattcttatttctcttacatctgtatttcaataaaagcagtttcaatttcctaaaggctgtatctgtactgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcaaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttgtcggcgtactttacggtccgccctctccagaggcccacttgccgactggcgcaatctaggcgggagacagcgtcccaaagcatgccgggccctacctcgcctgccaagcggagggcttcgacctccccggcggacaagtccagcgcgccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgtggcgtgcctcctcctcctgcgctgcctcgcggagggacaggctaaccgccagctgttgcgccgcggcctcggccccctcgagagctcgctcccgctcggtgagcgcgtcctcgcggaggcggagtgtgaactcttcttcggcgcaagcagcctcgtgcgccgccagcgttgcttcccggatggtaacggcggcctcgcggtccgccagatccctctccacgacgcaggcgcgctcttccagcgccatggcgcgcgcctcaagggcctcttcacgctgccgggacgccgcttcggtctccgccgcccgctgttctcgggcagcagcagcatcaagcaccccctgggcggcgtcgagcttcttccttagctccgcctcccagctcccatattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaagacctccacctgggcgcttaacccatccaacaccgtggtgtttgcggcagccaaggcctgcagaaggggctctgcgttcagtggggcgatagaaggcgtggggcagagccgccttggagaggatgccacgcggttcgggccgccgatagaagtgccggactcggggatgtcccccggacccggttggtcctgagcgtcgcccgagggagtgggcccaagcgacgcgcccgcagcctcgtcgccagctgccccagaagttgtcgcctgagcgtcgcccgagggagtgggcccaagcgacgcgcccgcggcctcgtcgcgagctgcctcagaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctacggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgctgctgacacgcgccgccccgccccctcggggaggagatggaggaggtgttcctccctgcttcctcttcccccgggcgtcggcagggcggctgctccccgggcccctgtcgcgggacccagaagcacgaccccctctcggggtaaattgttcccccctgcggctcccgcctgcgccgtcgtggccctttggagctcgctcctctgaggccccgaccgccatcataatggtcaggatggaggcgcggtctggaacgctgcagagggggaggattccttggggaatgagggccgcctctacggagttgagattcagcacccgttggaccaatatcttgaagtcctcaggagcccaatcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacagaccgctccgggtagtctggcgccgggcgtccctcgcccagcgtgactatctcccggccggtggcagattccggcatgaagcggcgcggcagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctactcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcatgggtttttg

SEQ ID NO: 80509 - DNA, 2676 bp, Oryza sativa
tgtctagattgcattcttcacaaatcacaactacccaaacccaccattacatgacaccccgtaaaccaagcagcgcaatcgttgtcgagctcttccactttaggatcaatgtcgagctcttccatcttctcccaaaaatcgatacccaaaacttcacatagatttctcatcacttttaatcgttccatggctgcaagcacgaaaacaaagagaatcagcagagcgagtggattaaaacacgaagaagagatccagcaacagatgaacccaacccagaatcgtgacctgctactgcgttgaaaccgccaaaacaccatgaatcaacagaaacacccatttagggaggaaacaccgtgaatcaacccatgaaatcaacaataaccagagagttttaaacacccattcaggaaggaaacaccattaatcaacaataaccagatatatagttttaaacacccattcatgaagaaaacaccatgaatcaacccattcagcgccgaacaccagcaaggagaaagcgagagagaaaattaaacaggagaaaaccaacgaaatctgcgagagagagagagacagagagagagagagagagaggaagctaaccactagttgatcacgccgcctgcctcccgccgcctgcttcctctgatcaaaggagtcacgcacgctgatacagcgagggaagaatcagatacagagaagaacatggggaggaatcgaaccagagaagcaattcaatctttatagagaggagagaagagaacgatgagagagagagagagagagagagagagagagagagagagagctcactctgcgtttcctcgtgggagagaaggggcgcacggtgcccggcttggagaggccgatagatatttataggcgccgctaactggttagccggatcaacttggggagtactcctaaatcttaccgcctggaagcctggaaccacctccatcagaaactcacaaaaagtagagctattcagtaattatgtgcaggtgccactgaaaaacagttaaaaactctggcccaaaaacactattctgtcactacataacaccaaacacaggtgagcacccaggaaaaatcaatttattgtggtgtgatttaagtgaaccatctttcagttagtgatttaagtgaaacacggaatattaaattctaactagagttaaagcacacaatcaagctaattcattcattctaactagttttgaactcttaaatagttagcaataaaagctcctctttctggcacactggcactgacattaccgccaattatactaggttagaatgaagagtacaaagttacctccaccaacattgcaatacattcttggaacctccctttttcacagctcaaaaggtcttctagaaactgaaactaattaactaactagggttagcctaaaagttaccagaaattatagggcagcattgcaaacggcaagactgttatttaagcaatactttcctatgcagtgagaggttctcctatataaagtcttaagagcccaacaggaaaagcaataatcatgatcattaatggagattatgtaaatacagcatactcactgagaatgagcaaaaggatatctatgagataaacacatgctccttttggaacaaatccgattcatcaccataatttatttgtagctatttcaaaattaactcgttctttttcaaattattccctagaaacaagcaagttcgatagaatcaataccatcatatacacagatgcaacaaaaagcataccagacttaatacaaaacttacatcgaccttcgatacttgttgacctgcatgttcagtttttcctaactggacaccaaaaaccaatctattctggaactttcatgtctagggacagttttcaagctgcacattttagagaatctaacaaagcgaatgctaaatctggtgtgcatgacaacacaaactattgcagaatagtggtcatgtattaacatttgagaccttatatttctcatttgttgaccatgacaaagaaattcaagcagaagatatcattcagatttcagaagtactagagtaagatgtaaagaaacaaaaaaggtcggggcaagacaaatagcttggtactatgcatttgcattaaagaccatacatatataccgcatagacatgctgcatcaggcaaattaaaggaggcttaactgacagtttgacatggtcaatgataaatggagttagttaaccaccagtaaagactaagaaatatacattgtgttaacattgagtgaactacaaccagagcaatcaatcagcagcaagaaaataacagcattaagggggaagggggaagaaaaatagatgggaacagtaaattttccgactgcactgtgatttgtgaagggaaagaactgtagcggtggaactgtagaagtggcacccggccagccgcccagccgtcgatgcgacgatgcgcacatcagctagtgtttacagatgtgcttagcaatatgtaactgcttttgtttgcttcatagatagcgtgcttatttttagcatcagtgcttagtatagcgcttaaccacatgtaagcaccgtgtctgtctaacagtaacccaccagtattaacaagggcactttatatttcatcacacacacacaaactacatatatatagtatactttctt
